United States Patent 11,739,335 (NUCLEIC ACIDS ENCODING CRISPR-ASSOCIATED PROTEINS AND USES THEREOF) - sequence listing, part 15

SEQ ID NO: 11260 - RNA, 3480 nt, Artificial Sequence
  Cas13a variant__Leptotrichia buccalis__WP_015770004.1__Cas13a(K1080A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugaggggaaaagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaaaauaagggaguucuaccaugaaauuaucggacggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgaaaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaggaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgauagagccuugaagaacgcugugaugaaauccguagucgacauccugaaggaauauggcuucguggccacauucaaaauuggggcagauaagaagaucggaauacagacuuuagagucagaaaagauuguucaccucaagaaucugaaaaagaaaaagcugaugaccgacaggaacagcgaggagcuuugcaaguuggugaaaaucauguuugaauacaagauggaggaaaagaagucugagaacuga

SEQ ID NO: 11261 - RNA, 3480 nt, Artificial Sequence
  Cas13a variant__Leptotrichia buccalis__WP_015770004.1__Cas13a(K1082A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugaggggaaaagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaaaauaagggaguucuaccaugaaauuaucggacggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgaaaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaggaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgauagaaaguuggccaacgcugugaugaaauccguagucgacauccugaaggaauauggcuucguggccacauucaaaauuggggcagauaagaagaucggaauacagacuuuagagucagaaaagauuguucaccucaagaaucugaaaaagaaaaagcugaugaccgacaggaacagcgaggagcuuugcaaguuggugaaaaucauguuugaauacaagauggaggaaaagaagucugagaacuga

SEQ ID NO: 11262 - RNA, 3480 nt, Artificial Sequence
  Cas13a variant__Leptotrichia buccalis__WP_015770004.1__Cas13a(K1087A)
augaaggugaccaaagucggcgggaucagccacaagaaauacacauccgagggaagacugguuaagucugaaucagaggaaaacaggacugacgagcggcucagugcccuucugaauaugcgcuuggauauguauauuaaaaaccccagcuccacggaaaccaaggagaaucagaagcgaauagguaaauuaaagaaauucuuuucuaacaagaugguguaccugaaagacaauacacuaucgcucaagaacggcaagaaagagaauaucgaucgugaauauucagagacugacauucuggaaagcgauguaagagacaagaaaaacuucgcugugcuuaagaaaaucuaccugaaugagaacgucaauagugaggaauuggagguguuuaggaacgauauuaagaaaaagcucaauaagaucaacucccugaaauauucuuucgaaaagaauaaagcaaacuaccaaaagauaaacgagaauaacaucgaaaaaguugaggggaaaagcaagcggaauauuaucuaugacuacuaccgcgaguccgccaaaagagaugcguaugugucaaacgucaaggaggcuuuugacaaacuguacaaggaggaagauauugccaaacucguguuagagaucgaaaaucugaccaaacuugagaaguauaaaauaagggaguucuaccaugaaauuaucggacggaagaacgacaaagagaauuuugcaaagauuaucuaugaagagauccagaacguaaauaacaugaaagaauugauugagaagguuccugauaugagugagcugaagaaaagccagguguucuacaaguauuaccuagacaaagaagaacucaaugacaagaacauaaaauacgccuuuugccacuucgucgaaaucgagaugucucagcugcuuaagaauuauguguacaaacgccuguccaacauuucaaaugauaagaucaagcgaauauuugaguaucaaaacuugaaaaagcucauugaaaacaaacuguuaaauaagcuggacacauacgugagaaacuguggcaaauauaauuacuaucuccaggauggugagaucgcuaccagcgacuucaucgcaaggaaccggcagaaugaagccuuucuucguaacauuaucggggucaguucuguugcuuacuucucccugcgcaauauuuuggagacugaaaacgagaaugauauaacaggaagaaugaggggcaagaccgugaagaacaauaaaggcgaggaaaaguacguaagcggggagguggacaaaaucuauaacgaaaauaagaaaaacgaggucaaggaaaaucuaaagauguucuacucguaugauuuuaacauggacaacaaaaaugagauugaggauuucuuugccaacaucgacgaagcgaucucuuccauucggcauggaauagugcacuucaaucuggagcucgaagguaaggauaucuuugcauucaaaaacauugccccaucagagaucaguaagaaaauguuucagaaugaaauuaacgagaagaagcugaaacuuaagaucuuccgacaacugaauagcgcuaacguuuuucgcuacuuggagaaauauaagauacucaauuaccugaaaagaacgagguucgaauuugugaacaagaauaucccguucguccccuccuuuacuaaauuauauucucggauugacgaccugaagaacagccuaggcaucuacuggaagaccccuaaaacaaaugaugacaacaagacuaaagagauuaucgaugcccagauauaccuccugaagaauauuuauuacggggaguuccuuaacuauuucaugucaaacaauggaaacuuuuucgaaaucaguaaagagauuaucgaauugaauaagaacgacaagcgcaaucugaaaaccggcuuuuacaagcuccagaaauucgaggauauacaggaaaagaucccaaaagaguaucuggcaaacauucaaucccuuuacaugaucaaugcugguaaccaggacgaagaggagaaggauacauauauugacuuuauccagaagauauuccugaaaggguuuaugaccuacuuggccaauaacggaagacucagccugauuuacaucggcucugaugaagagacgaauacuucauuagcggaaaagaaacaagaguucgacaaguuucugaaaaaguaugaacagaacaauaacaucaagauucccuacgagaucaaugaguuccuaagggaaauuaaacucggcaacauacugaaguauacagagcgucuuaauauguuuuacuugauccugaaacuccugaaccauaaggaauuaaccaaccugaaagggagucuugagaaguaucagagcgccaauaaggaagaggcauucuccgaucaguuggagcucauuaaccugcuaaaucuggacaacaaucgggugacugaagauuuugagcucgaagcugacgagaucggaaaauuccuggacuucaacgguaauaagguaaaagauaacaaggagcuuaaaaaguuugacacaaauaaaauuuacuucgauggcgaaaacaucauaaagcaccgagccuuuuauaauaucaagaaauacgggauguugaaccuguuagagaagauugcugacaaagccggauacaagaucucuauugaggaacucaaaaaguauucgaauaagaaaaacgaaaucgagaagaaucacaaaaugcaagagaaccugcauagaaaguacgcaaggccucgcaaagaugaaaaguucaccgacgaggauuaugaaagcuacaagcaggccauagagaacauugaagaguauacgcaccuuaaaaauaagguugaguuuaacgaacugaauuugcuccagggccugcuacugcggauccuccauagacugguggguuacaccuccaucugggagagggaccuucgcuuccgauugaaaggggaauuuccagagaaccaguauauugaagagauauucaauuuugagaacaagaaaaaugucaaguacaagggcggacaaaucguggaaaaauacauuaaguucuauaaagagcugcaccagaacgaugaagucaagaucaauaaauacucaagugcuaacauuaagguguuaaaacaggagaagaaggaccucuauauccggaauuacauagcgcacuuuaacuauaucccccaugcagagauuucucugcuugaaguucuggagaaucuacguaaacuccugagcuacgauagaaaguugaaaaacgccgugauggcuuccguagucgacauccugaaggaauauggcuucguggccacauucaaaauuggggcagauaagaagaucggaauacagacuuuagagucagaaaagauuguucaccucaagaaucugaaaaagaaaaagcugaugaccgacaggaacagcgaggagcuuugcaaguuggugaaaaucauguuugaauacaagauggaggaaaagaagucugagaacuga

SEQ ID NO: 11263 - RNA, 4170 nt, Artificial Sequence
  Cas13a variant__Leptotrichia shahii__WP_018451595.1__Cas13a
augggcaaccuguucgggcacaagagaugguacgaggugagggacaaaaaggauuuuaaaaucaagcggaaagucaagguuaagcgcaauuaugacggaaacaaauacauucucaauauaaacgaaaauaacaauaaggagaaaaucgauaacaauaaguucauucgaaaauauaucaacuacaagaagaaugacaacauucuuaaagaauuuacccguaaguuccaugccgguaauauccuguuuaaauugaagggcaaagaggggauaaucagaauugaaaacaaugaugacuucuuagagacagaggaagugguacuguauaucgaggcuuacggaaagagcgaaaaacuaaaggcacucggcauuacuaagaaaaagaucauagaugaggccauuaggcaggguaucacgaaagacgauaagaaaauugagaucaagcggcaagaaaacgaggaagagaucgaaauugacauacgcgaugaguauaccaacaagacacugaaugacugcuccaucauucuuagaaucauagagaacgaugaacuggagacuaaaaagucuauuuacgaaaucuuuaaaaauaucaacaugucauuguacaagauuaucgagaaaauuauagaaaaugagaccgagaagguguucgaaaacagguauuacgaggaacaccuccgggagaagcugcugaaagacgacaagaucgaugucauucucacaaauuuuauggaaauccgcgagaaaaucaagaguaacuuagagauucugggguucgugaaauuuuaucuuaauguuggaggcgacaagaagaaaagcaagaacaaaaagauguugguggagaaaauacugaauaucaacgucgaucuaaccguggaagacauugcggauuucguaaucaaggaacucgaguuuuggaauauuacuaaacgaaucgagaagguuaagaaagugaacaaugaguuccuggaaaagagaaggaaccggacauacauaaaauccuauguccuucuggacaagcaugaaaaauucaagaucgagcgugaaaacaagaaagauaagauugugaaauuuuucguggagaauaucaagaacaauucuauuaaagagaagaucgaaaagauauuggcugaguuuaaaauugacgaacucaucaagaaacuggagaaggaauuaaagaagggcaacugugauaccgagauuuucgggaucuuuaagaaacacuacaaggucaauuucgacucgaaaaaguuuagcaaaaagucagaugaggaaaaagagcuguauaagauaaucuaccgcuaccucaagggaagaauugagaaaauccuuguuaacgaacagaaggugaggcugaaaaagauggagaaaauugaaaucgagaagauauugaaugaaaguauucuauccgagaagauccugaaacggguaaagcaguauacgcucgaacauaucauguaccuggguaaacuucgacacaacgacauugacaugacuaccgugaauacagaugacuucucucgccugcacgccaaggaggaguuggaucucgaacugaucaccuuuuucgcaagcacuaacauggaguuaaauaaaauauuuuccagagaaaacauuaauaacgacgagaauaucgauuucuuuggcggggacagggaaaagaacuauguccuggauaagaaaauucuaaacucaaagaucaaaauuauccgggaccucgauuucauagacaauaagaacaauaucacaaacaauuucauucgcaaauuuaccaagaucggaacgaacgagagaaauaggauucugcaugccaucaguaaggagcgugaucuucagggcacucaagacgauuacaacaaagugauaaauauuauccagaacuugaagaucagcgacgaagagguuucuaaagcucugaaucucgacguggucuucaaggauaaaaagaacauuauaacaaagaucaaugacauuaaaaucuccgaagagaacaauaacgauauuaaguaucugcccucauuuagcaaagugcuuccugaaauccugaacuuguaccggaauaacccaaagaaugagccguucgacaccauagagacugagaaaaucguacucaacgcacugauuuauguuaauaaggaauuauacaaaaagcugauccuagaagaugaccucgaggaaaacgagaguaagaauauuuuucugcaggagcuuaaaaagacauuggguaacaucgaugaaauagacgagaauauuaucgaaaacuacuauaaaaaugcccagaucucugcuuccaaggggaacaauaaagccauuaagaaguaccagaaaaaggugaucgagugcuauauaggauaccugcgaaagaacuaugaggaacucuucgauuuuagcgacuucaaaaugaauauucaagagaucaaaaagcagauuaaggauaucaacgacaauaaaaccuacgaaagaauaacggucaagaccucggauaaaacaauugugaucaacgacgacuuugaguauaucauuucuaucuucgcgcuguuaaacuccaaugcagucauuaacaagauaaggaaucgcuuuuucgccacuucaguguggcugaacaccagugaauaccagaauaucauugauauccuugacgagaucaugcaauugaacacacuccggaaugaguguauuacugaaaacuggaaucugaaccuagaggaauuuauacagaaaaugaaggagaucgaaaaggauuucgacgauuucaaaauucagaccaagaaagagaucuuuaauaacuacuaugaggacauuaagaauaacauccugacagaguucaaagaugacauaaauggcugcgauguucucgaaaagaaacuggaaaagaucgugauuuuugacgaugagaccaaguucgaaaucgacaaaaagagcaacauucuucaagacgagcagagaaaauuguccaacaucaauaagaaagaucugaagaagaaaguagaccaguacauaaaggauaaagaccaggagauuaagucuaaaaucuuauguaggauuaucuuuaacagcgauuuccucaagaaguauaaaaaggaaauagacaaucugaucgaggauauggaaucagagaacgagaauaaauuucaagaaauuuacuaucccaaggagcgcaaaaacgaacuuuacaucuauaagaagaaucuguucuugaacauuggcaauccuaacuuugacaaaaucuacgggcucauaaguaaugauauuaagauggcugacgccaaauuccuguuuaacaucgauggaaagaauauccggaaaaacaagauuuccgagaucgacgcaauacugaaaaaucuaaacgauaagcucaacgguuacagcaaggaauauaaagagaaguacauuaaaaagcugaaagagaaugacgacuucuucgcuaagaacauccagaauaagaacuauaaaucuuuugaaaaggauuacaaucgagucucagaguauaaaaagauucgugaccuuguggaguucaacuacuugaauaaaaucgaaaguuaucugauagauaucaacuggaaguuagccauucagauggcgagauuugaaagggacaugcacuacaucguuaauggccuccgcgagcuggggauuaucaaacuuagcggauacaacacuggcauuucccgggccuauccaaaaagaaaugguucugauggguucuacacgacaaccgcauauuacaaguuuuucgacgaggaaucguauaaaaaguuugagaaaaucugcuacggcuucggaauagaucugagcgaaaacuccgagauuaauaagcccgaaaacgagucaaucaggaauuauaucagucauuuuuacauugugcgaaacccuuucgcugacuacucuauagccgagcagaucgaucgcgucagcaaccuacucuccuauucaacucgguacaauaacagcaccuaugcuucuguguuugaaguauucaagaaagacgugaaucuggauuacgacgaguugaagaaaaaguuuaaacugauuggcaacaaugauaucuuagaaagacucaugaagccaaagaaaguuuccguccuggagcuugagaguuauaacagcgacuacauuaagaaucugaucauagaauugcucacaaaaaucgagaacaccaaugacacucuguga

SEQ ID NO: 11264 - RNA, 4170 nt, Artificial Sequence; identical to SEQ ID NO: 11263
  Cas13a variant__Leptotrichia shahii__WP_018451595.1__Cas13a

SEQ ID NO: 11265 - RNA, 4305 nt, Artificial Sequence
  Cas13a variant__Leptotrichia shahii__WP_018451595.1__Cas13a(long)
augggcaaccuguucgggcacaagagaugguacgaggugagggacaaaaaggauuuuaaaaucaagcggaaagucaagguuaagcgcaauuaugacggaaacaaauacauucucaauauaaacgaaaauaacaauaaggagaaaaucgauaacaauaaguucauucgaaaauauaucaacuacaagaagaaugacaacauucuuaaagaauuuacccguaaguuccaugccgguaauauccuguuuaaauugaagggcaaagaggggauaaucagaauugaaaacaaugaugacuucuuagagacagaggaagugguacuguauaucgaggcuuacggaaagagcgaaaaacuaaaggcacucggcauuacuaagaaaaagaucauagaugaggccauuaggcaggguaucacgaaagacgauaagaaaauugagaucaagcggcaagaaaacgaggaagagaucgaaauugacauacgcgaugaguauaccaacaagacacugaaugacugcuccaucauucuuagaaucauagagaacgaugaacuggagacuaaaaagucuauuuacgaaaucuuuaaaaauaucaacaugucauuguacaagauuaucgagaaaauuauagaaaaugagaccgagaagguguucgaaaacagguauuacgaggaacaccuccgggagaagcugcugaaagacgacaagaucgaugucauucucacaaauuuuauggaaauccgcgagaaaaucaagaguaacuuagagauucugggguucgugaaauuuuaucuuaauguuggaggcgacaagaagaaaagcaagaacaaaaagauguugguggagaaaauacugaauaucaacgucgaucuaaccguggaagacauugcggauuucguaaucaaggaacucgaguuuuggaauauuacuaaacgaaucgagaagguuaagaaagugaacaaugaguuccuggaaaagagaaggaaccggacauacauaaaauccuauguccuucuggacaagcaugaaaaauucaagaucgagcgugaaaacaagaaagauaagauugugaaauuuuucguggagaauaucaagaacaauucuauuaaagagaagaucgaaaagauauuggcugaguuuaaaauugacgaacucaucaagaaacuggagaaggaauuaaagaagggcaacugugauaccgagauuuucgggaucuuuaagaaacacuacaaggucaauuucgacucgaaaaaguuuagcaaaaagucagaugaggaaaaagagcuguauaagauaaucuaccgcuaccucaagggaagaauugagaaaauccuuguuaacgaacagaaggugaggcugaaaaagauggagaaaauugaaaucgagaagauauugaaugaaaguauucuauccgagaagauccugaaacggguaaagcaguauacgcucgaacauaucauguaccuggguaaacuucgacacaacgacauugacaugacuaccgugaauacagaugacuucucucgccugcacgccaaggaggaguuggaucucgaacugaucacauuuuucgcaagcaccaacauggaguuaaauaaaauauuuuccagagaaaacauuaauaacgacgagaauaucgauuucuuuggcggggacagggaaaagaacuauguccuggauaagaaaauucuaaacucaaagaucaaaauuauccgggaccucgauuucauagacaauaagaacaauaucacaaacaauuucauucgcaaauuuaccaagaucggaacgaacgagagaaauaggauucugcaugccaucaguaaggagcgugaucuucagggcacucaagacgauuacaacaaagugauaaauauuauccagaacuugaagaucagcgacgaagagguuucuaaagcucugaaucucgacguggucuucaaggauaaaaagaacauuauaacaaagaucaaugacauuaaaaucuccgaagagaacaauaacgauauuaaguaucugcccucauuuagcaaagugcuuccugaaauccugaacuuguaccggaauaacccaaagaaugagccguucgacaccauagagacugagaaaaucguacucaacgcacugauuuauguuaauaaggaauuauacaaaaagcugauccuagaagaugaccucgaggaaaacgagaguaagaauauuuuucugcaggagcuuaaaaagacauuggguaacaucgaugaaauagacgagaauauuaucgaaaacuacuauaaaaaugcccagaucucugcuuccaaggggaacaauaaagccauuaagaaguaccagaaaaaggugaucgagugcuauauaggauaccugcgaaagaacuaugaggaacucuucgauuuuagcgacuucaaaaugaauauucaagagaucaaaaagcagauuaaggauaucaacgacaauaaaaccuacgaaagaauaacggucaagaccucggauaaaacaauugugaucaacgacgacuuugaguauaucauuucuaucuucgcgcuguuaaacuccaaugcagucauuaacaagauaaggaaucgcuuuuucgccacuucaguguggcugaacaccagugaauaccagaauaucauugauauccuugacgagaucaugcaauugaacacacuccggaaugaguguauuacugaaaacuggaaucugaaccuagaggaauuuauacagaaaaugaaggagaucgaaaaggauuucgacgauuucaaaauucagaccaagaaagagaucuuuaauaacuacuaugaggacauuaagaauaacauccugacagaguucaaagaugacauaaauggcugcgauguucucgaaaagaaacuggaaaagaucgugauuuuugacgaugagaccaaguucgaaaucgacaaaaagagcaacauucuucaagacgagcagagaaaauuguccaacaucaauaagaaagaucugaagaagaaaguagaccaguacauaaaggauaaagaccaggagauuaagucuaaaaucuuauguaggauuaucuuuaacagcgauuuccucaagaaguauaaaaaggaaauagacaaucugaucgaggauauggaaucagagaacgagaauaaauuucaagaaauuuacuaucccaaggagcgcaaaaacgaacuuuacaucuauaagaagaaucuguucuugaacauuggcaauccuaacuuugacaaaaucuacgggcucauaaguaaugauauuaagauggcugacgccaaauuccuguuuaacaucgauggaaagaauauccggaaaaacaagauuuccgagaucgacgcaauacugaaaaaucuaaacgauaagcucaacgguuacagcaaggaauauaaagagaaguacauuaaaaagcugaaagagaaugacgacuucuucgcuaagaacauccagaauaagaacuauaaaucuuuugaaaaggauuacaaucgagucucagaguauaaaaagauucgugaccuuguggaguucaacuacuugaauaaaaucgaaaguuaucugauagauaucaacuggaaguuagccauucagauggcgagauuugaaagggacaugcacuacaucguuaauggccuccgcgagcuggggauuaucaaacuuagcggauacaacacuggcauuucccgggccuauccaaaaagaaaugguucugauggguucuacacgacaaccgcauauuacaaguuuuucgacgaggaaucguauaaaaaguuugagaaaaucugcuacggcuucggaauagaucugagcgaaaacuccgagauuaauaagcccgaaaacgagucaaucaggaauuauaucagucauuuuuacauugugcgaaacccuuucgcugacuacucuauagccgagcagaucgaucgcgucagcaaccuacucuccuauucaacucgguacaauaacagcaccuaugcuucuguguuugaaguauucaagaaagacgugaaucuggauuacgacgaguugaagaaaaaguuuaaacugauuggcaacaaugauaucuuagaaagacucaugaagccaaagaaaguuuccguccuggagcuugagaguuauaacagcgacuacauuaagaaucugaucauagaauugcucacaaaaaucgagaacaccaaugacacucugaagaggcccgccgcaacuaaaaaggccgggcaagcuaaaaagaagaaaggaucuuauccuuacgaugugccagacuacgcguauccguacgaugugcccgacuaugcauacccuuaugaugucccagacuacgccuga

SEQ ID NO: 11266 - RNA, 4158 nt, Artificial Sequence
  Cas13a variant__Leptotrichia sp. oral__WP_021744063.1__Cas13a
augggcaaccuguucgggcacaagagaugguacgaggugagggacaaaaaggauuuuaaaaucaagcggaaagucaagguuaagcgcaauuaugacggaaacaaauacauucucaauauaaacgaaaauaacaauaaggagaaaaucgauaacaauaaguucauuggugaauuugugaacuauaaaaagaauaacaauguacuuaaggaguucaaacgaaaguuucaugccggcaacauccuguucaaauugaaggggaaagaagagauuauccguauagagaauaacgacgacuuuuuagaaaccgaggaagugguccuguacaucgagguguauggaaagagcgagaaacuaaaggcucucgaaauuacaaagaaaaagaucauugaugaggcaaucagacagggcauaacuaaagaugacaagaaaauugaaaucaagaggcaagagaacgaagaggagauugaaaucgauauccgggacgaguacacgaauaagacccugaacgauugcuccauuauacuucgcaucauugaaaaugacgagcuggaaacuaaaaagucuaucuaugagauauucaaaaacauuaauaugucauuguacaagaucaucgagaaaauuaucgaaaacgagacagaaaagguuuuugagaauagauacuaugaggaacaccucagggagaagcugcugaaagauaacaagauugacgugauacucaccaauuucauggaaauccgggagaaaauuaagaguaacuuagaaaucauggguuuugucaaauucuaccugaaugugagcggggacaagaagaaauccgagaacaagaaaauguuuguagagaagauccuuaauacaaacguugauuugaccguggaagacauugucgauuucauagugaaagagcugaaguucuggaauaucacuaaacgcauugaaaaggugaagaaauuuaacaacgaguuccuagaaaaucgaagaaacaggacauauaucaagucuuacguccuccuggacaaacaugagaaguuuaaaauugagcgggaaaauaagaaggauaaaaucguuaaguucuuuguggagaacaucaaaaauaacucgauaaaggagaaaauugaaaagauccuugccgaguucaagauuaaugaacugaucaaaaaguuggagaaagaacucaagaaaggaaacugugacaccgagauauuuggcauuuucaagaagcacuauaaaguaaauuuugauucaaagaaauucagcaacaagagugacgaagagaaagaacuguacaagaucauuuaucguuacuuaaaaggccgcaucgagaagauacuggugaaugagcagaaggucagacucaaaaagauggagaaaaucgaaauugaaaagauccuuaacgaguccauucugucugagaaaaucuugaagagggugaagcaguacacgcuagaacauauaauguaucuggggaaacuccggcacaaugauauuguuaagaugacugugaacaccgacgauuuuagccgacugcacgcgaaagaggaacuugaccuggaguugaucacauucuuugcuuccacuaauauggaacucaacaagaucuucaacggaaaagagaaggucaccgacuucuuugguuucaaucugaacggccagaagauuacauuaaaagagaaggugcccucauuuaaacugaauauccuaaagaaacucaacuucauuaauaacgaaaauaacauagaugagaagcugagucauuuuuacagcuuccaaaaggaaggguaucuuuugcgcaauaaaauccugcacaacucuuacggaaauauucaggagaccaagaaccucaaaggcgaauaugagaauguagagaagcugaucaaagaacuuaagguuuccgacgaggaaauuucaaagagccugaguuuggaugugaucuuugaggguaaagucgacauaaucaacaagauuaauucucucaaaaucggggaauacaaggauaaaaaguaucugccuuccuucagcaaaauuguguuagagaucacgagaaaguuuagggagauaaacaaggacaaacuguucgauauugaaucggagaagaucauccuaaacgccgucaaauacgugaauaagauucucuacgagaaaauaacuucuaacgaagagaaugaauuucugaagacacuuccagacaaguugguuaaaaaguccaacaauaaaaaggagaacaaaaaucugcucucaaucgaagaguauuacaagaacgcacaggugaguagcuccaagggagauaaaaaggccauuaaaaaguaucagaauaaaguaaccaacgcuuaccuggaauauuuagagaauacuuucacagagaucauugacuuuucuaaguucaaccugaauuacgaugaaaucaagaccaaaauagaggaacggaaggacaacaaaagcaagaucauuaucgauucaauuaguacgaauaucaacauaaccaaugacauugaguauaucaucuccauuuucgcacuuuugaacagcaacacauacaucaauaaaauacgcaacagauuuuucgccacuucugucuggcucgaaaagcaaaauggcaccaaagaguacgacuaugagaacauuaucucaauucuggaugaagugcuacugaucaaucuccugagggagaacaauauaacagacauucuugauuugaagaacgcuaucaucgacgccaagauuguugaaaaugaugagacuuacaucaaaaacuauauuuuugaaaguaaugaggagaagcugaaaaagcguuuauucugcgaggaacucguggacaaagaagauauacggaagaucuuugaggacgagaacuucaaguuuaaauccuucauuaagaaaaaugaaaucggcaacuuuaagaucaauuucgggauucugagcaaccuugaguguaacucugaagucgaggcgaaaaagauaaucggaaagaacucgaaaaagcuggagagcuuuauucagaauaucauugaugaauacaaauccaauauccgaaccuuguucucaagugaguuccucgaaaaguauaaagaggaaauagacaaccugguggaggauacagaaucugagaauaagaacaaguuugagaaaaucuacuauccgaaggaacauaaaaaugagcuauacauuuacaagaaaaaccuguuccucaauaucgguaaccccaauuuugacaagauuuauggccugaucagcaaagauauaaagaacguagacaccaagauucuuuucgacgaugacaucaaaaagaauaaaauuuccgaaaucgaugcaauauugaagaaccugaaugacaaauuaaacggguacucaaacgauuauaaggccaaguacgugaauaaacucaaggagaacgacgacuuuuucgcuaaaaauauccagaacgaaaauuauagcucuuuuggagaguucgagaaggauuacaacaaaguuuccgaauauaagaagauuagagaucuggucgaguuuaauuaccuuaacaaaaucgaaaguuaccugauugacaucaauuggaagcuagccauacagauggcaagguucgagcgcgauaugcacuauauugugaacggccuccgggagcuggguaucaucaaauugagcggguacaauacuggcauuucuagagcuuauccuaagaggaacggauccgacggcuuuuacacgacaaccgccuauuacaaauucuuugacgaagagucauauaagaaguucgagaaaaucugcuacggguucggaauagaucugagugaaaauagcgaaauuaacaagccagagaaugagucgauccgcaacuacauuucccacuuuuauaucgugcgaaaccccuucgcggacuacucuauagccgaacaaaucgaucgggucagcaauuuacucucauauaguacucguuacaacaauuccaccuaugcaucuguuuuugagguguucaaaaaggacgugaaccuggauuacgacgaacuuaaaaagaaguuuagacugauugguaauaacgauaucuuggagaggcucaugaaaccuaagaaaguaagcguccuggaacuagaguccuauaauucagacuacauuaagaaccugaucauugagcuucucacaaaaaucgaaaauaccaacgauacucuguga

SEQ ID NO: 11267 - RNA, 3459 nt, Artificial Sequence
  Cas13a variant__Leptotrichia wadei__WP_021746774.1__Cas13a
augaaggugaccaaagucgacggcaucagccacaagaaauacauugaggaagggaagcugguuaaauccacaucugaggaaaacagaacuucagagaggcucagugaacuucugagcauacgguuggauaucuauauuaagaaucccgacaacgccuccgaggaggaaaaucgcauccgacgugagaacuuaaagaaauucuuuucuaauaaggugcugcaucuaaaagauucgguacucuaccugaagaacagaaaagaaaagaaugcugugcaggacaagaacuauucagaggaggauauuagcgaauacgaccuuaaaaauaagaacaguuucuccguccugaaaaagaucuugcucaaugaggaugugaacucugaggaacuggaaauauuuaggaaagacguugaggcaaagcugaauaaaaucaacagccucaaguauuccuucgaggaaaauaaggccaacuaccaaaagauuaacgagaauaacguggaaaaggucggagguaaaucaaagcggaauaucauuuaugauuacuaccgcgagagugcgaaaagaaacgacuauaucaauaacgugcaggaggcuuuugauaaguuauacaagaaagaagacauagagaagcuguucuuucuuauugaaaauagcaaaaagcacgagaaauauaagaucagggaauacuaucauaagauuaucggccggaaaaacgauaaggagaauuucgccaaaaucauuuacgaagagauacagaacguaaauaacaucaaggaguugauugagaaaaucccugacaugucugaacugaagaagucccagguguuuuauaaauacuaccuagacaaggaggaacucaaugauaaaaacauaaaguaugcauucugccacuuuguugagauugaaaugucacaacugcuuaaaaauuacgucuauaagcgccugagcaacaucaguaacgacaaaaucaagcgaauuuucgaguaccagaauuugaagaaacucaucgaaaacaagcuguuaaauaaacuggauacguaugugagaaacugugggaaguacaauuauuaccuccaggugggagagauugccaccucugacuuuauagcuaggaaccggcagaaugaagcauuccuucguaacaucauuggcgucuccagcguugccuacuucucgcugcgcaauaucuuggagacagagaacgaaaaugguaucacugggagaaugaggggaaaaaccgugaagaacaauaagggcgaggaaaaauauguaucuggcgagguggauaagauuuacaacgaaaauaaacaaaacgaggucaaggagaaccuaaaaauguuuuauuccuacgacuucaauauggauaacaagaaugaaauagaggacuuuuucgcuaacaucgaugaagccauuucaaguauccggcaugggauugugcacuuuaaucuggagcucgaaggaaaggacaucuucgcguuuaaaaacauagcaccaagcgagaucuccaagaaaauguuccagaaugagauuaacgaaaagaaacugaaacuuaagaucuuuaaacaguuaaauucugccaacguuuucaauuauuacgagaaggaugugauuaucaaauauuugaagaacacaaaauuuaauuucgucaacaagaauauaccguuugugcccagcuucaccaaacucuacaacaagauugaagaccugcgaaacacuuuaaaguucuuuuggucaguaccuaaagacaaggaggagaaagaugcucagaucuaccugcuaaagaauauuuauuacggugaguuccucaacaaauuuguuaagaauaguaagguguucuuuaaaaucacaaacgaagucauaaagaucaauaaacaacgcaaccagaagaccggccacuauaaauaccagaaguucgaaaauauugagaagacggugccagucgaauaucuggccaucauucaauccagagagaugaucaacaaucaggacaaagaggaaaagaacacuuacauagauuuuauucagcagaucuuccuuaaaggguuuaucgacuauuugaauaagaacaaucugaaauacauugagagcaacaauaacaaugauaacaacgacaucuucucuaagauuaagaucaaaaaggauaauaaagaaaaguacgacaaaauacucaagaacuaugagaagcauaauaggaacaaagaaauuccccacgagaucaaugaguuugugcgggaaauuaagcugggaaaaauccuuaaguacaccgagaaccugaauauguucuauuugauacucaaacuguuaaaccauaaggaacugacaaaucuaaaaggcucacucgagaaguaccaaagugcaaacaaggaagagacuuuuagcgaugagcuggaacuuaucaauuugcugaaccucgacaauaaccgcguuaccgaggauuucgaacuggaggcuaaugagauugguaaauucuuagacuuuaacgaaaacaagaucaaagauagaaaggagcugaaaaaguucgacacaaauaagauuuauuuugacggggaaaacaucauaaaacacagggccuucuacaauauuaagaaauauggaaugcuuaacuugcucgagaagaucgcggauaaagccaaguacaagaucucccugaaagaacuaaaggaguacucuaauaaaaagaacgagauugagaaaaauuauaccaugcagcagaaccugcaccguaaguacgcacggccuaagaaagacgaaaaguuuaaugaugaagacuauaaagaguacgaaaaggcuauaggcaacauccagaaauauacgcaucucaagaauaaaguggaguucaacgagcugaaucuuuugcaaggccuguuacucaagauucugcaccgacuuguaggguacacuucgaucugggaaagagaucugagguuucgcuugaagggagaguucccagaaaaccauuauauugaggaaaucuuuaauuucgacaacagcaaaaacgucaaguacaaauccggucagauaguggagaaguacaucaauuuuuauaaagagcucuacaaggauaacguugaaaagcggucaauuuauagugacaaaaaggugaaaaagcugaaacaggagaagaaggaucuauacaucagaaauuauauugcccacuucaacuacaucccccaugcugaaauaucucugcucgagguccuggagaaucuuaggaaauugcugagcuaugaccgcaagcugaaaaacgccauuaugaaguccaucguggauauccucaaagaauacggcuucguagcaacauuuaagauuggggccgacaagaaaaucgagauacagacccuggaaucagagaagauugugcaccuuaaaaaucugaagaaaaagaaacuaaugacugaucgaaacagcgaggaacucugcgagcugguuaaggucauguucgaauacaaggcuuuggaguga

SEQ ID NO: 11268 - RNA, 3459 nt, Artificial Sequence
  Cas13a variant__Leptotrichia wadei__WP_021746774.1__Cas13a(G403D)
augaaggugaccaaagucgacggcaucagccacaagaaauacauugaggaagggaagcugguuaaauccacaucugaggaaaacagaacuucagagaggcucagugaacuucugagcauacgguuggauaucuauauuaagaaucccgacaacgccuccgaggaggaaaaucgcauccgacgugagaacuuaaagaaauucuuuucuaauaaggugcugcaucuaaaagauucgguacucuaccugaagaacagaaaagaaaagaaugcugugcaggacaagaacuauucagaggaggauauuagcgaauacgaccuuaaaaauaagaacaguuucuccguccugaaaaagaucuugcucaaugaggaugugaacucugaggaacuggaaauauuuaggaaagacguugaggcaaagcugaauaaaaucaacagccucaaguauuccuucgaggaaaauaaggccaacuaccaaaagauuaacgagaauaacguggaaaaggucggagguaaaucaaagcggaauaucauuuaugauuacuaccgcgagagugcgaaaagaaacgacuauaucaauaacgugcaggaggcuuuugauaaguuauacaagaaagaagacauagagaagcuguucuuucuuauugaaaauagcaaaaagcacgagaaauauaagaucagggaauacuaucauaagauuaucggccggaaaaacgauaaggagaauuucgccaaaaucauuuacgaagagauacagaacguaaauaacaucaaggaguugauugagaaaaucccugacaugucugaacugaagaagucccagguguuuuauaaauacuaccuagacaaggaggaacucaaugauaaaaacauaaaguaugcauucugccacuuuguugagauugaaaugucacaacugcuuaaaaauuacgucuauaagcgccugagcaacaucaguaacgacaaaaucaagcgaauuuucgaguaccagaauuugaagaaacucaucgaaaacaagcuguuaaauaaacuggauacguaugugagaaacugugggaaguacaauuauuaccuccaggugggagagauugccaccucugacuuuauagcuaggaaccggcagaaugaagcauuccuucguaacaucauuggcgucuccagcguugccuacuucucgcugcgcaauaucuuggagacagagaacgaaaaugauaucacugguagaaugagggggaaaaccgugaagaacaauaagggagaggaaaaauauguaucuggcgagguggacaagauuuacaacgaaaauaaacaaaacgaggucaaggagaaccuaaaaauguuuuauuccuacgauuucaauauggacaacaagaaugaaauagaggacuuuuucgcuaacaucgaugaagccauuucaaguauccggcauggcauugugcacuuuaaucuggagcucgaagggaaggauaucuucgcguuuaaaaacauagcaccaagcgagaucuccaagaaaauguuccagaaugagauuaacgaaaagaaacugaaacuuaagaucuuuaaacaguuaaauucugccaacguuuucaauuauuacgagaaggacgugauuaucaaauauuugaagaacacaaaauuuaauuucgucaacaagaauauaccguuugugcccagcuucaccaaacucuacaacaagauugaagaccugcgaaacacuuuaaaguucuuuuggucaguaccuaaagauaaggaggagaaagacgcucagaucuaccugcuaaagaauauuuauuacggagaguuccucaacaaauuuguuaagaauaguaagguguucuuuaaaaucacaaacgaagucauaaagaucaauaaacaacgcaaccagaagaccggucacuauaaauaccagaaguucgaaaauauugagaagacggugccagucgaauaucuggccaucauucaauccagagagaugaucaacaaucaggauaaagaggaaaagaacacuuacauagacuuuauucagcagaucuuccuuaaaggcuuuaucgauuauuugaauaagaacaaucugaaauacauugagagcaacaauaacaaugacaacaacgauaucuucucuaagauuaagaucaaaaaggacaauaaagaaaaguacgauaaaauacucaagaacuaugagaagcauaauaggaacaaagaaauuccccacgagaucaaugaguuugugcgggaaauuaagcuggggaaaauccuuaaguacaccgagaaccugaauauguucuauuugauacucaaacuguuaaaccauaaggaacugacaaaucuaaaaggaucacucgagaaguaccaaagugcaaacaaggaagagacuuuuagcgacgagcuggaacuuaucaauuugcugaaccucgauaauaaccgcguuaccgaggacuucgaacuggaggcuaaugagauuggcaaauucuuagauuuuaacgaaaacaagaucaaagacagaaaggagcugaaaaaguucgacacaaauaagauuuauuuugauggugaaaacaucauaaaacacagggccuucuacaauauuaagaaauaugggaugcuuaacuugcucgagaagaucgcggacaaagccaaguacaagaucucccugaaagaacuaaaggaguacucuaauaaaaagaacgagauugagaaaaauuauaccaugcagcagaaccugcaccguaaguacgcacggccuaagaaagaugaaaaguuuaaugacgaagauuauaaagaguacgaaaaggcuauaggaaacauccagaaauauacgcaucucaagaauaaaguggaguucaacgagcugaaucuuuugcaaggccuguuacucaagauucugcaccgacuuguaggcuacacuucgaucugggaaagagaccugagguuucgcuugaagggggaguucccagaaaaccauuauauugaggaaaucuuuaauuucgauaacagcaaaaacgucaaguacaaauccggacagauaguggagaaguacaucaauuuuuauaaagagcucuacaaggacaacguugaaaagcggucaauuuauagugauaaaaaggugaaaaagcugaaacaggagaagaaggaccuauacaucagaaauuauauugcccacuucaacuacaucccccaugcugaaauaucucugcucgagguccuggagaaucuuaggaaauugcugagcuaugaucgcaagcugaaaaacgccauuaugaaguccaucguggacauccucaaagaauacgguuucguagcaacauuuaagauuggcgccgauaagaaaaucgagauacagacccuggaaucagagaagauugugcaccuuaaaaaucugaagaaaaagaaacuaaugacugaccgaaacagcgaggaacucugcgagcugguuaaggucauguucgaauacaaggcuuuggaguga

SEQ ID NO: 11269 - RNA, 3909 nt, Artificial Sequence
  Cas13a variant__Leptotrichia wadei__WP_021746774.1__6xHis-Tag/Twin-Strep/SUMO_Cas13a(G403D)
augggcagcucccaccaucaccaucaccauucuucagggcuggugcccagaggaagucacauggccagcuggucccacccucaguucgagaaggguggcgggucuggaggcgguucagggggaucggcuuggagccauccacaauuugaaaagaugagugacuccgaggucaaccaggaagcaaagccggagguuaaacccgaagugaagccugagacccacaucaaucucaaaguaucugauggcagcuccgagauuuucuuuaagauaaagaaaacaacuccacuuaggcggcugauggaagccuucgcgaagcgccagggcaaagagauggacucauugcgauuuuuauacgaugggauccguauucaggcugaccaaacgcccgaagaucuggacauggaggauaacgacaucauugaggcccauagagaacagaucggagguaguaugaaggugaccaaagucgauggcauaagccacaagaaguauaucgaggaagggaagcuagugaagucuacauccgaggaaaauaggacuucagagcggcucagcgagcugcuuaguauucgccuggacaucuacauuaaaaacccugauaaugcaucugaagaggaaaacagaaucaggcgggagaauuugaagaaauucuuuuccaacaagguucuccaccugaaagacagcgugcuguaucucaagaaucgcaaggaaaagaacgccguccaggauaagaauuacucggaggaggacauaucugaauaugaccugaaaaacaaaaauuccuucucagugcugaaaaagauucuuuugaacgaggauguaaauagugaggaacuggaaaucuuucgaaaggacguugaggcuaaacuaaacaagauuaacagccucaaauacuccuucgaggaaaauaaggcaaacuaucagaaaaucaaugagaacaauguggaaaaggucggaggcaagucuaaaagaaacaucauuuacgauuacuauagggagagcgccaagcggaaugacuacauaaacaaugugcaagaggcuuuugauaaacuguauaagaaagaagacaucgagaaacuuuucuuucugauugaaaacucaaagaaacaugagaaguacaaaauccgugaauauuaccacaagauaauuggucgcaaaaaugauaaggagaacuucgccaaaaucaucuaugaggaaauucagaaugugaacaauaucaaggaguugauugaaaagauaccagacaugagugagcucaaaaagucccaggucuucuacaaauacuaucuggauaaggaagaguuaaacgacaaaaacaucaaguacgcguuuugccauuucguugagauugaaaugagccagcugcucaagaauuauguguacaaaagacuuucuaacaucucaaaugauaagaucaaaaggauuuuugaguaucaaaaccugaagaaauugauagaaaauaagcuacugaacaagcucgacaccuacguacggaauugugggaaauauaacuacuacuuacaggugggagagaucgcaacaagugacuucauugcccgaaaucgccagaacgaggcuuuucuuagaaauaucauuggcgucagcuccguggccuauuucucucugaggaacaucuuggaaaccgagaaugaaaacgauauaacuggccggaugcgcgggaagacaguuaaaaauaacaagggagaggaaaaauacgugucgggugaggucgacaagaucuauaacgagaauaagcaaaacgaagugaaagagaaucucaagauguuuuacagcuaugauuucaacauggacaauaaaaacgaaauugaggacuuuuucgcaaauaucgaugaagcuauuuccucaaucagacacggcauaguacauuuuaaccuggaguuagaggggaaggauauuuucgccuuuaaaaauaucgcgcccagugaaauuucuaagaaaauguuccagaacgagaucaaugaaaagaagcugaaacuaaagauauucaaacagcucaacagcgccaauguuuuuaacuacuaugagaaggacgugaucauuaaauaccugaagaauaccaaguucaacuuugucaacaaaaauaucccuuucgugccauccuuuacgaaacuuuacaacaaaauugaagauuugaggaauacucugaaguucuuuuggucagucccgaaagacaaggaggagaaggaugcacagaucuaucuccugaaaaacauauacuauggagaguuccuuaauaaguuugugaaaaacagcaagguuuucuuuaaaauuaccaaugaagugaucaagaucaacaagcaacguaaucagaaaacaggccacuacaaguaucagaaauucgaaaacauugagaagacuguacccgucgaauaccuggcuaucauucagucucgggagaugauaaauaaccaagacaaagaggaaaagaauaccuauaucgauuuuauucagcagaucuucuugaaggguuucauugacuaccucaacaaaaauaaccugaaguacaucgaguccaauaacaacaaugacaacaaugauauauuuaguaaaaucaagauuaaaaaggacaacaaagaaaaguaugauaagauccugaaaaauuacgagaagcacaaccgaaauaaagagauuccucaugaaaucaacgaguucgugagagaaauaaaguuagggaaaauucuaaaguauacagagaaucucaacauguuuuaccugauccuuaaguugcugaaucacaaagaacucaccaaccugaagggcagcuuagagaaauaucagucugccaauaaggaggaaacguucuccgacgagcuggaacuuaucaacuugcucaaucuggauaacaacaggguuacugaggacuuugaacuagaggcuaaugagauuggaaaauuccuggauuuuaacgaaaauaagauaaaggaccgcaaagagcucaagaaauucgauacaaacaagaucuacuuugacggcgaaaauauuaucaaacaucgggccuucuauaacauuaagaaguacgggaugcugaaucuuuuggagaaaaucgcagauaaggccaaauacaagauaucacugaaagaauuaaaggaguauaguaacaaaaagaaugagaucgaaaagaacuacaccaugcaacagaaucuccacagaaaauaugcuaggccaaagaaagacgagaaguuuaacgaugaagacuacaaagaguaugagaaggcgauuggaaauauccagaaguacacucaccugaaaaacaagguggaguucaaugaacuuaaccuguugcagggucuccugcuaaaaauucugcaucgccucgucggcuauacaagcaucugggaacgagaccugcgguuccgucuuaagggggaguuucccgaaaaccacuacauagaggagauuuucaauuuugauaacucgaaaaaugugaaguacaaguccggacaaaucguagaaaaauauaucaacuucuacaaggaguuguauaaagacaauguggaaaagagaucuauuuacagcgauaaaaagguuaagaaacugaagcaggagaaaaaggacuuauauaucaggaacuacauagcacauuuuaauuauauuccucacgccgaaaucucacuccuggagguccuugagaaccugcgcaaacuacucaguuacgaucggaagcugaaaaaugcuauuaugaaguccaucguggacauauugaaggaauacggcuucguggccaccuuuaaaauuggugcagauaagaaaaucgagauccagacgcuggaaucugagaagauuguccaucucaaaaacuuaaagaagaaaaagcugaugaccgacagaaauagcgaggaacuuugcgagcugguuaaagugauguucgaauauaaggccuuggaguga

SEQ ID NO: 11270 - RNA, 3459 nt, Artificial Sequence
  Cas13a variant__Leptotrichia wadei__WP_021746774.1__Cas13a(R474A,R1046A)
augaaggugaccaaagucgacggcaucagccacaagaaauacauugaggaagggaagcugguuaaauccacaucugaggaaaacagaacuucagagaggcucagugaacuucugagcauacgguuggauaucuauauuaagaaucccgacaacgccuccgaggaggaaaaucgcauccgacgugagaacuuaaagaaauucuuuucuaauaaggugcugcaucuaaaagauucgguacucuaccugaagaacagaaaagaaaagaaugcugugcaggacaagaacuauucagaggaggauauuagcgaauacgaccuuaaaaauaagaacaguuucuccguccugaaaaagaucuugcucaaugaggaugugaacucugaggaacuggaaauauuuaggaaagacguugaggcaaagcugaauaaaaucaacagccucaaguauuccuucgaggaaaauaaggccaacuaccaaaagauuaacgagaauaacguggaaaaggucggagguaaaucaaagcggaauaucauuuaugauuacuaccgcgagagugcgaaaagaaacgacuauaucaauaacgugcaggaggcuuuugauaaguuauacaagaaagaagacauagagaagcuguucuuucuuauugaaaauagcaaaaagcacgagaaauauaagaucagggaauacuaucauaagauuaucggccggaaaaacgauaaggagaauuucgccaaaaucauuuacgaagagauacagaacguaaauaacaucaaggaguugauugagaaaaucccugacaugucugaacugaagaagucccagguguuuuauaaauacuaccuagacaaggaggaacucaaugauaaaaacauaaaguaugcauucugccacuuuguugagauugaaaugucacaacugcuuaaaaauuacgucuauaagcgccugagcaacaucaguaacgacaaaaucaagcgaauuuucgaguaccagaauuugaagaaacucaucgaaaacaagcuguuaaauaaacuggauacguaugugagaaacugugggaaguacaauuauuaccuccaggugggagagauugccaccucugacuuuauagcuaggaaccggcagaaugaagcauuccuucguaacaucauuggcgucuccagcguugccuacuucucgcugcgcaauaucuuggagacagagaacgaaaaugguaucacugggagaaugaggggaaaaaccgugaagaacaauaagggcgaggaaaaauauguaucuggcgagguggauaagauuuacaacgaaaauaaacaaaacgaggucaaggagaaccuaaaaauguuuuauuccuacgacuucaauauggauaacaagaaugaaauagaggacuuuuucgcuaacaucgaugaagccauuucaaguaucgcgcaugggauugugcacuuuaaucuggagcucgaaggaaaggacaucuucgcauuuaaaaacauagccccaagcgagaucuccaagaaaauguuccagaaugagauuaacgaaaagaaacugaaacuuaagaucuuuaaacaguuaaauucugcuaacguuuucaauuauuacgagaaggaugugauuaucaaauauuugaagaacacaaaauuuaauuucgucaacaagaauauaccguuugugcccagcuucaccaaacucuacaacaagauugaagaccugcggaacacuuuaaaguucuuuuggucaguaccuaaagacaaggaggagaaagaugcccagaucuaccugcuaaagaauauuuauuacggugaguuccucaacaaauuuguuaagaauaguaagguguucuuuaaaaucacaaacgaagucauaaagaucaauaaacaacgaaaccagaagaccggccacuauaaauaccagaaguucgaaaauauugagaagacggugccagucgaauaucuggcaaucauucaaucccgcgagaugaucaacaaucaggacaaagaggaaaagaacacuuacauagauuuuauucagcagaucuuccuuaaaggguuuaucgacuauuugaauaagaacaaucugaaauacauugagagcaacaauaacaaugauaacaacgacaucuucucuaagauuaagaucaaaaaggauaauaaagaaaaguacgacaaaauacucaagaacuaugagaagcauaauagaaacaaagaaauuccccacgagaucaaugaguuugugagggaaauuaagcugggaaaaauccuuaaguacaccgagaaccugaauauguucuauuugauacucaaacuguuaaaccauaaggaacugacaaaucuaaaaggcucacucgagaaguaccaaagugcuaacaaggaagagacuuuuagcgaugagcuggaacuuaucaauuugcugaaccucgacaauaaccggguuaccgaggauuucgaacuggaggccaaugagauugguaaauucuuagacuuuaacgaaaacaagaucaaagaucgcaaggagcugaaaaaguucgacacaaauaagauuuauuuugacggggaaaacaucauaaaacacagagcguucuacaauauuaagaaauauggaaugcuuaacuugcucgagaagaucgccgauaaagcaaaguacaagaucucccugaaagaacuaaaggaguacucuaauaaaaagaacgagauugagaaaaauuauaccaugcagcagaaccugcacaggaaguacgcucguccuaagaaagacgaaaaguuuaaugaugaagacuauaaagaguacgaaaaggccauaggcaacauccagaaauauacgcaucucaagaauaaaguggaguucaacgagcugaaucuuuugcaaggccuguuacucaagauucugcaccggcuuguaggguacacuucgaucugggaacgagaucugagauuuagguugaagggagaguucccagaaaaccauuauauugaggaaaucuuuaauuucgacaacagcaaaaacgucaaguacaaauccggucagauaguggagaaguacaucaauuuuuauaaagagcucuacaaggauaacguugaaaagcgcucaauuuauagugacaaaaaggugaaaaagcugaaacaggagaagaaggaucuauacaucgcuaauuauauugcccacuucaacuacaucccccaugcagaaauaucucugcucgagguccuggagaaucuucggaaauugcugagcuaugacagaaagcugaaaaacgccauuaugaaguccaucguggauauccucaaagaauacggcuucguagcuacauuuaagauuggggcggacaagaaaaucgagauacagacccuggaaucagagaagauugugcaccuuaaaaaucugaagaaaaagaaacuaaugacugauaggaacagcgaggaacucugcgagcugguuaaggucauguucgaauacaaggcauuggaguga

SEQ ID NO: 11271 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggggagggacugagagccagccccaggcggcgcccucuccuuccacugcagccgcgagguugcccccguggcgacggguguuugagaggaggcaggggucgggcuggguucggauuuuggcgcgugaccggcggcuccagagcaucugccaaccacguccaugcguucuuuuucuuuuuacaacugcuagggaauguucucgugaucguacugucacaccauuucggaaaggaauuugguacagcuggcccuggggccacuaugaaagugacgaaggucgauggaauuagucacaaaaaguacauagaggaaggcaaacuuguuaagagcaccuccgaggaaaacaggacaucugagcggcugucggaguugcucucaauccgccuggacauuuauaucaagaauccagauaacgcaagcgaagaggaaaaucgaauuagaagggagaaccugaaaaaguucuuuaguaauaaagugcuccauuuaaaggacuccgugcuguaccuuaaaaaccggaaggagaagaaugccguccaggauaaaaacuauucugaagaggacaucagcgaauacgauuugaagaauaaaaacuccuucucagugcugaagaaaauacuacucaaugaggacguaaacagugaggaacuggagaucuuucguaaggauguugaagcuaaacuuaauaagauuaacagccugaaguauucuuucgaggaaaacaaagcaaauuaccagaagaucaacgagaauaacguggaaaaagucggugggaaguccaaacgcaauauuaucuaugacuacuacagagagucagccaagaggaacgauuauauaaauaacgugcaggaggcuuuugacaaguuguacaaaaaggaagauauugagaaacucuucuuccugaucgaaaauagcaagaaacacgagaaguauaagauucgggaauacuaucacaaaaucaucggacgaaagaacgacaaagagaauuuugccaagauuauauacgaggaaauccaaaacgugaauaacauuaaagaguuaaucgaaaagauacccgacaugagugagcugaagaaaucucaggucuucuauaaguacuaccucgauaaagaggaacuuaaugacaagaacauuaaauaugcguuuugccauuucguugagaucgaaaugucccagcuguugaagaacuacguguauaaacgccuaagcaauaucucgaacgauaagauuaagagaaucuuugaguaccagaaucugaaaaagcucauugaaaacaaacugcuuaauaagcuggacacuuauguaaggaacuguggcaaauacaauuauuacuugcaagugggcgagauagcaaccucugauuucaucgcccggaaccgccagaaugaggcuuuucucagaaacauuaucggggucuccucaguggccuacuucagucugaggaauaucuuagaaacagagaacgaaaauggaauuaccggucguaugcggggcaagacuguuaagaacaauaaaggggaggaaaaguaugugagcggagaggucgacaaaauauacaacgagaacaagcagaaugaagugaaagagaaccugaagauguuuuauuccuacgauuucaauauggacaacaagaaugaaaucgaggacuuuuucgcaaacauugaugaagcuaucucuagcauugcccacggcaucguacauuuuaaucuagagcucgaggguaaagauauauucgcguucaagaacaucgccccuucagaaauuaguaaaaagauguuucagaaugagaucaacgaaaagaagcugaaguugaaaauuuucaagcaacuuaauuccgcaaacguuuuuaauuauuacgagaaagacgugaucauaaaguaucugaaaaacacaaaguucaauuuugucaacaaaaacauuccauucgugcccagcuuuaccaagcucuacaauaagaucgaggaccugcgaaacacgcuuaaauucuuuuggucugucccuaaggauaaagaagagaaggacgcucagauuuaccuguugaaaaauaucuauuacggggaguuccucaacaaguuugugaaaaauucaaaaguuuucuuuaagauaacuaacgaagugaucaaaauuaauaagcagagaaaccagaaaaccggccacuauaaguaccaaaaguucgaaaauaucgagaaaacaguaccagucgaguaucuggccauuauccagaguagggaaaugauaaacaaucaggauaaggaggagaaaaacacuuacauugacuucauccaacagaucuuuuuaaagggauucauugauuaucugaauaaaaacaaucuaaaguacaucgaaagcaacaauaacaacgacaauaacgauauauuuuccaagauuaaaaucaagaaagacaauaaggaaaaauacgauaagauucucaagaacuaugagaaacacaaucgcaacaaggagaucccgcaugaaauuaaugaguucgugcgggaaaucaaacugggcaagauacuuaaauacaccgagaacuugaauauguuuuaucugauccucaagcuguuaaaccacaaagaacugacaaaucuuaaggggucuuuggagaaguaccagucggcuaacaaagaggaaaccuucagcgacgagcucgaacugauuaaucuacugaaccucgauaauaacagaguuacggaggacuuugagcuggaagccaacgagaucggaaaguuccuugauuuuaaugaaaacaaaauuaaggacaggaaagaguugaagaaguucgacacuaauaaaaucuauuuugauggugaaaacauaauuaagcaucgcgcauucuacaauaucaaaaaguauggcaugcugaacuuacucgagaaaaucgccgacaaggcuaaguacaaaauuucccugaaggagcuuaaagaauacucaaauaagaaaaacgagauagaaaagaauuauacaaugcagcaaaaccugcaccgaaaguacgcgcggcccaaaaaggaugagaaauucaaugacgaagauuauaaggaguacgagaaagcaaucgggaacauucagaaguauacccauuugaaaaauaagguggaauuuaacgagcucaaucugcuacagggacugcuccugaagauccuucaccguuuggucggcuacacaaguauuugggaaagagaccugagguuccgcuuaaaaggugaguuuccugaaaaccacuauaucgaggagauauucaacuuugauaauucuaagaacgugaaauacaagagcgggcagaucguagaaaaauacauuaauuucuauaaggagcucuacaaggacaacguggaaaaacgguccaucuauucagauaagaaaguuaagaaacugaagcaagagaagaaagaccuuuacauugccaauuauaucgcucauuuuaacuacauaccacacgccgagauuagccugcuagaaguccucgagaaucugagaaaguugcugucuuaugauaggaaauuaaagaacgcaaucaugaaauccaucguggacauucucaaggaauacggcuucguggccacuuuuaagaucggagcugauaaaaagauagagauucagacccuggaaagugagaaaaucguccaucuuaagaaucugaaaaagaaaaaguugaugacggaccgaaacagcgaggaacucugcgagcugguuaaggugauguucgaauacaaagcccuagagggcgggggagguucuggcgggggaggcuccggugggggcggaucagugaguaagggcgaggaacuguuuaccgggguaguccccauucuuguggagcucgacggagauguuaauggccacaaauucagcgugucgggugaaggggagggagacgcaacauauggcaagcugacuuugaaauuuaucuguaccacagguaagcugccugucccauggcccacuuuagugaccacacucaccuacggcguucagugcuucucccgcuauccggaucacaugaagcagcaugacuucuuuaaaucugcgaugccugaaggguacgugcaagagcggacuauauucuuuaaggaugacggaaacuauaaaacgagagcugaaguaaaguucgagggcgauacacuggucaauaggauugagcuuaaagggaucgacuuuaaggaagauggaaacauccugggccacaaguuggaguacaauuauaacagccauaacguguacauuauggccgacaaacagaagaaugguaucaaagugaacuucaagauucgucacaauauagaagaugggucaguccagcucgcagaccauuaccaacagaacacccccaucggagacggcccaguucugcuaccugauaaucacuaucugaguacucaguccgcccuuucuaaagaccccaacgagaagcgcgaucacauggugcuccuggaguuuguaaccgcugccgguauuacauugggcauggacgaauuauacagcagaggggcaggagcuggcgccggggcgggagccggcucccgguuccaguguaggaucugcaugcgaaauuuuucagaucggagcaaccugagucgccauaucagaacccacacuggugagaagccauucgcuugugacauuugcgggaggaaauuugcaauaucuuccaaucucaacagccauacaaagauccacacgggaucgcaaaaacccuuccagugucggauuugcaugcgaaauuuuucaagaucugauaaccuggcccgccauaucaggacccacacuggcgaaaagccuuucgcuugcgacauuuguggucguaaauucgccacaaguggcaaucuuacccggcacacaaagauccaucugagagggucccaguugagcauaguggaugcaccagagcagagggaaggagcgucucaagucagcguguccguuacuuuugaggacguggccguccuauucacccgcgaugaguggaagaaacuggaccucucacagcgaagucuguauagagaagugaugcuugagaacuacagcaauuuagcuucuauggccggcuccccgaagaaaaagcggaaaguuuga

SEQ ID NO: 11272 - RNA, 3549 nt, Artificial Sequence
  Cas13a variant__Leptotrichia wadei__ERK53440.1__Cas13a
auguacaugaagaucaccaaaauugacggcgugagccacuauaagaaacaggauaaggggauacugaaaaagaaguggaaagaccucgaugagagaaagcaaagggaaaagaucgaggcccgguacaacaagcagauugaauccaaaaucuauaaggaguucuuucgccuuaagaauaaaaagcgaauugaaaaagaggaggaccagaacaucaagucucuguacuucuuuauaaaagaauuguauuuaaaugagaagaacgaagagugggagcugaaaaauaucaaccuagaaauucucgaugacaaggagcgugucaucaagggauacaaauucaaggaagauguuuacuuuuucaaagaggguuauaaggaauacuaucugaggauucuuuuuaauaaccugaucgagaaagugcagaaugagaacagggaaaagguacggaagaauaaagaguucuuggaccucaaggaaauauuuaaaaaguacaaaaaccgcaagauugaucugcugcucaagucaaucaauaacaauaaaauuaacuuagaguauaagaaagaaaacgugaaugaggagaucuacggcaucaaccccacaaaugacagagaaaugacuuucuaugagcugcuuaaggaaauuauagagaaaaaggaugaacaaaagaguaucuuggaggagaaacuggacaacuuugauauuacgaauuuccuagaaaacaucgagaagauauuuaaugaagagaccgagauuaacaucaucaaagggaagguccucaaugaacugagggaguacauuaaagaaaaggaggaaaacaauagcgacaacaaacuuaagcagaucuauaaucuggaguugaagaaauacauugagaacaauuucuccuacaagaaacagaagucuaaaucgaagaacggaaagaacgacuaucucuaccugaauuuccugaaaaagauaauguuuaucgaagagguggaugagaaaaaggaaauuaacaaagaaaaguucaagaauaaaaucaacucaaauuuuaagaacuuauucguucagcauauccucgacuauggcaaacuucuguacuauaaggagaaugaugaguacauuaaaaacacaggucaauuggaaacuaaggaccuagaguauauaaagaccaaagaaacacugauccggaagauggcugugcucgucagcuuugcagccaauaguuacuacaaccuguucgggcgcguguccggagauauucuuggcaccgagguaguuaaaucuagcaagacuaaugugaucaaagucggcucccacauuuuuaaggagaaaaugcugaacuauuucuuugacuucgaaaucuuugaugcgaauaagauaguggagaucuuggaaucaauuaguuacagcaucuauaacgugcgaaauggggucggacauuucaacaagcucauucuggguaaauacaagaaaaaggacaucaacacaaauaaaagaauagaggaagauuuaaacaauaacgaggagauuaagggcuauuuuaucaagaaaagaggggaaauugagcggaagguuaaagaaaaguuccugucuaauaaccuacaguacuauuacuccaaagagaagaucgaaaauuacuucgagguguaugaguuugaaauacucaagcguaaaaucccuuucgcuccaaacuuuaagcgcauuaucaaaaagggagaggaccuguucaauaacaaaaauaacaagaaguacgaauauuuuaaaaauuucgauaagaacucagccgaggagaaaaaggaauuucuuaaaaccagaaauuucuugcugaaggagcucuacuauaacaacuuuuacaaggaguuccugagcaaaaaggaagaauuugagaaaauuguacuugaagugaaggaggagaaaaagaguaggggcaauaucaacaauaaaaagucuggugucuccuuccagagcauagacgacuaugauacgaagauuaacaucucggacuacaucgcaucuauucacaaaaaggaaauggagcggguggaaaaauacaaugaggagaagcagaaagauacugccaaguauauccgagacuuuguugaagagauuuuccugaccggguucauaaacuacuuggaaaaggauaaacgccuccauuuucugaaggaggaguucuccaucuuaugcaauaacaauaacaauguggucgacuuuaacauuaauaucaacgaagagaaaauuaaggaguuccugaaagaaaaugauucaaagacacuaaaccucuaucuguuuuucaauaugaucgacaguaagagaauaagcgaauuuaggaacgagcuugugaaauacaagcaauucacuaaaaagcgguuggaugaagagaaagaguuucugggaaucaagauugaacucuaugagacccugaucgaguucguaauuuuaacacgcgaaaagcuggacaccaaaaaguccgaagagaucgaugcuuggcuuguugacaaauuguacgugaaggauucuaacgaguauaaagaauacgaggaaauacucaagcuguuugucgacgagaaaauucuaagcucaaaggaggcaccguacuaugccacggacaauaagacucccauccugcucaguaacuucgagaaaacaagaaaguacggcacccaguccuuccugagcgaaauccagucuaauuauaaauacucaaagguggaaaaagagaacauugaagauuauaauaagaaggaggagauagaacagaaaaagaaaaguaacaucgagaaacuucaagacuugaaagucgaacugcacaagaagugggagcagaauaaaauuacugaaaaggagaucgagaaauacaacaauacaaccaggaagauuaacgaauauaauuaccucaaaaacaaggaggaauuacagaauguguaccugcuucacgagaugcugagcgauuugcucgcucguaacguugccuuuuucaauaagugggaacgggacuuuaaauucaucgugauagcgaucaagcaauuucugcgagagaacgauaaagagaagguaaacgaguuccuaaauccuccagacaacuccaaaggcaagaaagucuauuuuucugugucgaaguacaagaauacgguugaaaacauugaugggauccauaaaaauuucaugaaccugauuuuucucaauaacaaguucaugaauagaaaaaucgacaagaugaacugugcaauauggguguauuuuaggaauuacauugcccacuuccugcaucuucacaccaaaaacgaaaagaucagcuugaucucccagaugaaucuguuaauuaagcucuuuucauaugauaaaaagguccagaaccacauccugaaaaguacaaagacucuucuggagaaauacaauauacagauuaacuucgagaucucuaacgacaagaaugaaguguucaaguauaaaauuaagaaccgccuauacagcaaaaagggaaaaaugcucgguaagaauaacaaguuugagauccuggaaaaugaguucuuggaaaacguaaaagcuaugcuggaguacuccgaguga

SEQ ID NO: 11273 - RNA, 4158 nt, Artificial Sequence
  Cas13a variant__Clostridium aminophilum__WP_031473346.1__Cas13a
augaaguucagcaaaguggaccacaccagauccgccgucggcauccagaaggcuacagauucuguucaugggaugcuguacacugaccccaaaaagcaagaagugaacgaucucgacaaaagguuugaucagcuuaauguaaaggcaaagcggcuguauaacguguucaaucagucaaaagccgaagaggacgaugacgaaaagcgcuuuggaaaagucgugaagaaauugaaccgagaguuaaaggaucugcuauuccaccgugaaguuaguagauacaauagcauugguaacgcgaaguauaauuacuauggcauaaaauccaacccugaggagaucgugucuaaucucgggauggucgaaucgcugaagggagagagggacccacagaaagugauuucaaaacuucuguuguacuaucuccggaaaggccugaagccggguacggaugggcugcgcaugauccucgaagcuagcugcggauuaagaaaacugaguggcgacgagaaggagcuuaagguauuuuugcaaacccuggaugaagacuucgagaaaaagacauuuaaaaagaaccuaauuagguccaucgaaaaucagaacauggccguucagcccucuaaugagggcgacccuauaaucgggauuacucagggacgguucaacagccaaaagaaugaagagaaguccgcaaucgagcgcaugaugucaauguacgccgaucucaacgaagaccaucgagaggaugugcugagaaaacuuaggcggcugaacgucuuguacuuuaauguggacaccgaaaagacagaggaaccaacccuccccggugagguggauacuaacccugucuucgagguuuggcacgaccaugaaaagggcaaagagaaugaucgucaguuugcuacauucgcaaagauucugaccgaagaccgcgagacgaggaaaaaggaaaaguuagccgugaaagaggcucugaacgaucucaagagugccaucagagaccacaauauaauggcguaucgguguagcauuaaaguaacugagcaggauaaggacgggcuguuuuucgaagaccagcgaaucaaccgcuucuggauucaccauaucgagucugcaguggaaagaauccuugccuccauuaauccagagaaauuguacaagcuaaggauaggauaucugggcgagaaggucuggaaagaucuccugaacuaccuuucaaucaaguauauugcuguggguaaagccguuuuucacuucgcaauggaagaccuggggaagaccggacaagauaucgaguugggcaaacucagcaauagugugucuggcgggcugacauccuuugacuacgaacagauacgggcugaugagacuuuacagcgccaacugagcgucgaaguggccuucgcggccaacaaucuauuuagagcaguaguuggacagaccgguaagaaaauugagcagucgaagucugaggaaaacgaggaagacuuccuccuguggaaggcugagaaaaucgccgaauccaucaagaaagagggcgaggggaauacacuuaagucaauuuugcaguuuuucggaggcgcuaguagcugggaucugaaccauuuuugcgccgcauaugguaaugaauccucugcccucggguacgagaccaaauucgcugacgaucugaggaaggcgaucuacagccuucguaacgaaacguuucacuucacuacacugaacaagggcucauuugacuggaaugcaaaauugauuggagauauguucagucacgaggccgcuaccggcauagccguggaacggacucgauucuauuccaacaaucuccccauguuuuacagagagagcgaccugaagaggaucauggaucauuuauauaacacauaccacccucgcgcaucucaagucccaucauucaauaguguguuuguccggaaaaacuucagacuguuucuaagcaauacccucaacacgaauaccuccuucgacacagagguguaucagaagugggaaucugggguuuacuaucuguuuaaagagauuuacuacaacucguuccuuccgagcggagacgcccaucacuuguuuuucgaaggucugaggcgcauccgaaaggaggcugauaaucuccccaucgugggcaaggaggccaaaaagcggaacgcaguacaggacuuugggcguagaugugaugaacugaaaaauuuaucccugucagcgauuugccagaugauaaugacugaguauaacgaacaaaauaacggaaacaggaaggucaaaaguacccgcgaggacaagcggaagccugauaucuuccagcauuacaaaaugcuuuugcucagaacacugcaggaggcuuuugccauuuauaucaggcgagaggaguucaaguucauuuuugaccuaccaaaaacucuguacgugaugaagcccguugaagaguuccucccuaauuggaaaucuggcauguuugauagccugguggaacgcgucaagcaguccccagaccuucaacggugguauguguuguguaaauuccugaacgguagauuacucaaucagcugucagggguaaucaggagcuacauacaguuugcaggcgauauccagcgucgcgccaaggcuaaccacaaucggcuuuauauggacaacacccaaagaguggaguacuacucuaauguucuggaagucguggauuucugcauuaagggaacauccagguuuaguaacguguucagcgacuauuuucgagaugaggacgccuacgcagacuauuuggauaauuaccuccaguucaaagacgagaagaucgcugaagucucuuccuuugccgcgcugaaaaccuucuguaacgaggaagagguuaaggccggcauuuauauggauggggaaaaucccgugaugcagcggaacaucgugauggcuaaacuauucggaccggacgagguacugaagaaugucgugccuaagguuacucgcgaggaaauagaggaauacuaucaacucgagaaacagauugcacccuacagacagaacgguuacugcaagucagaggaagaucagaaaaagcugcuuagguuucaacggaucaaaaaucgaguggaguuccagacgauuacagaauuuagugagaucauaaacgaauugcugggccaguuaaucagcuggucguuccucagagagcgcgaccugcuuuauuuucagcugggguuccacuaccuaugucuccauaacgauaccgagaagccagccgaauauaaggagauuuccagggaagacggaacugucauccguaaugcuauucugcaccaaguggccgcaauguacguuggcgguuugccuguguauacccuggcggauaaaaaguuagccgcuuuugagaaaggggaagccgacugcaagcucucuaucagcaaagauacagcaggcgcuggaaagaagauaaaagacuucuuucgguacucaaaguauguacugauuaaagacagaaugcuuaccgaucagaaccagaaguacacuaucuaccuggccggcuuggaacucuucgagaauacagacgaacaugauaacaucacggacgucaggaaauauguggaucacuuuaaguacuaugcaaccagugacgagaaugccauguccauucuggaucuauacucugaaauccacgaccgcuucuuuacuuaugauaugaaguaccagaaaaacguggcuaauaugcuggagaacauucuucuccgacauuucguccugauaagacccgaguucuuuacagggagcaagaaaguuggagaaggcaagaaaaucaccuguaaggcgcgggcccaaauugagaucgcagaaaaugguaugagguccgaggacuucacauauaaauugucagaugggaagaagaacauuagcacuugcaugaucgcugcccgcgaccagaaauaccugaauaccguggcccguuuacucuacuauccacacgaagcuaagaaaaguauaguagauacgagagagaagaaaaacaauaagaagaccaaccggggagacggcacauuuaauaaacagaaggguacugcaaggaaagagaaggacaacggcccccgcgaguucaaugauaccggguuuucuaacacaccuuucgccggauuugacccauuccgaaacuccuga

SEQ ID NO: 11274 - RNA, 4035 nt, Artificial Sequence
  Cas13a variant__Eubacterium rectale__CVRQ01000008.1__Cas13a
augcugagaagggacaaggaggugaaaaagcucuacaacgucuucaaucagauccaaguuggcaccaaacccaagaaauggaacaaugaugaaaaguugagcccugaggaaaacgagcggcgcgcccagcagaagaauauuaaaaugaagaacuauaaauggcgagaggcuugcuccaaguacguggaaucuucacagcguauaaucaaugacguaauuuucuauaguuacagaaaagcaaagaacaagcugagguauaugcggaaaaaugaggauaucuugaagaaaaugcaagaagccgagaaguuaagcaaauucuccgggggaaagcuggaagacuuuguggcguacacacuacgcaaaucucucgucgugucgaaguaugauacucaggaguucgacucacuggcugccaugguuguguuucuugaguguauugguaagaacaauaucagcgaucacgaaagagagauagucugcaaacuguuggaacucaucaggaaggacuucaguaaacuggauccaaacgugaagggcucccagggggcaaauauuguacggucuguucgcaaccagaauaugaucgugcaaccgcagggagaccgauuucuguucccccaggucuacgccaaagagaacgaaacggugaccaacaagaauguggagaaggagggccucaacgaauuuuuacugaauuacgcuaaccuugaugacgagaaaagagcagaaagccuuaggaagcugcggcguauucuagaugucuauuucuccgccccuaaucauuacgagaaagacauggacaucacacucucagauaacauagaaaaggagaaauuuaauguuugggagaagcacgaaugugguaagaaagagacugggcuguucguggacauuccagauguacuuauggaagcugaggccgaaaacaucaagcuggacgcgguggucgagaaacgcgagagaaagguguugaaugauaggguucggaaacagaacauuaucugcuaucgauacacccgcgcaguggucgaaaaguauaauaguaacgagccccucuuuuucgaaaauaacgccaucaaucaauacuggauucaucacauagagaacgcuguggagagaauccugaagaacuguaaagccggaaaguuauucaaacugaggaagggcuaucucgcagaaaaaguauggaaggacgcuauuaaucuuaucagcauaaaauacauugcccugggcaaggcgguuuacaacuuugccuuggaugacaucuggaaggauaaaaagaauaaagagcuagggaucguggacgaacggauucgcaacggaaucacaucuuucgauuaugagaugauuaaggcacaugaaaaucugcagagagagcucgcugucgacauagccuuuuccgugaacaaucuggcuagggccgucugcgacaugucaaaccuugguaauaaagagagcgauuuccuguuguggaagcguaacgacaucgcagauaagcucaaaaauaaggacgauauggccagugugucugcuguucugcaguuuuucggcgggaaauccagcugggacauuaacaucuuuaaggaugcguacaaaggaaagaagaaauauaauuacgaagugcgguucaucgacgauuuacgaaaggcaauuuauugugccagaaacgagaauuuucacuucaaaaccgcucugguaaacgacgaaaaguggaacacugagcuauuuggcaaaauauucgaaagggagacagaguuuugccucaaugucgaaaaggaucgcuucuacucgaacaaucuguauauguucuaccaagugucugagcuucggaacauguuggaccaccuguacuccagaucaguuaguagggccgcacaggugccuagcuauaauuccgucaucgugcgcaccgccuuuccagaauacauuacgaacguacucgguuaucagaagcccucuuacgaugcugacacucuggggaaaugguauagcgccuguuacuaucuucugaaggagaucuacuacaauucauucuugcagagugaccgagcacuccaacuguuugaaaaauccgugaagaccuuaagcugggaugacaaaaagcagcagcgggcgguugauaacuucaaagaccauuuuucugauauuaagucagcuugcacaagucuggcccaggucugucaaaucuauaugacugaguacaaucagcagaacaaucagauaaagaaagugcguagcuccaacgacucuaucuucgaucaaccuguguaucagcacuacaagguccuacucaaaaaggcaauugccaaugcuuuugccgacuaucugaaaaacaauaaggaucuuuucggauuuaucggcaagccauucaaagcaaacgagauuagagaaaucgacaaggagcaguuuuugccggauuggaccucgaggaaauacgaagcucugugcauagagguuagcggcucccaggagcuccaaaagugguauauuguggggaaauuccugaacgcccgcucauuaaaucugauggugggaaguaugcggucuuacauccaguacguaacagacauuaagagaagggcggccagcaucgguaacgaacuucaugucuccgugcacgauguugagaagguggaaaaauggguccaggugauagagguuugcucauugcucgcuagccgaaccucuaaucaauuugaagacuauuucaacgacaaggaugacuacgcacgcuaucugaaauccuacguggauuucaguaauguagacaugcccagcgaguauucugcccuagucgauuuuuccaacgaggaacagucagaccuguacguggauccuaagaauccaaaagugaaccggaauaucguccacaguaagcucuuugcugccgaccauauucugagagauaucguugagcccgugagcaaggacaacauugaagaguuuuauucgcagaaagcagaaaucgcguacuguaagauaaaaggcaaggagauuacggccgaggaacagaaagcuguacuuaaguaccaaaaguugaaaaauaggguggagcugcgugauaucgucgaauauggggagaucauuaacgaauuacucggacagcugaucaauugguccuucaugcgcgagcgggaccuucuguacuuucaguugggcuuccacuaugacugccucagaaacgauucuaagaaaccugaggguuacaagaauauuaaaguggacgaaaacagcauaaaggaugccauccuguaucagauuaucgggauguacguuaauggcgugacugucuaugcaccagagaaagacggagauaagcuaaaggaacaaugugugaaaggcgggguuggagugaaggucucagcuuuucauagguacaguaaauaccugggucucaacgagaagacacuguauaacgccggccuugagauuuucgaaguaguggcagagcacgaagacaucauaaauuugcgaaacgggaucgaucauuuuaaauacuaucugggagacuaccgguccauguuaucuauuuauagcgagguuuucgaucgcuuuuucaccuacgacaucaaguaucagaagaaugugcucaaccugcuucagaauauucugcuaagacacaacgucaucguggaacccauacucgaguccggcuucaaaacuauuggugagcagacaaagccgggggccaaacugucaaucaggagcaucaagagugauaccuuucaauacaaaguaaagggcggaacguugauuaccgacgcuaaggaugaacgguaccuggagacaauacgaaaaaucuuauauuacgcggaaaaugaggaagacaaccucaagaaaucuguggucguuacuaaugccgacaaguaugagaaaaacaaggaguccgaugaccagaauaagcagaaagaaaagaaaaacaaggauaauaaaggcaagaaaaacgaggaaaccaagagcgacgcagagaagaauaacaacgaaagacugucguacaauccuuucgcuaaccuuaauuuuaaacugucaaacuga

SEQ ID NO: 11275 - RNA, 3858 nt, Artificial Sequence
  Cas13a variant__Herbinix hemicellulosilytica__CRZ35554.1__Cas13a
augaagcugaccagaaggcggaucagcggcaacuccguggaccagaaaauuacagccgcuuucuaccgcgauaugucucaagggcuccuuuauuacgacucagaggauaaugacugcacugauaaggucauagaaaguauggacuuugagcgaagcuggcguggaagaauccugaaaaacggugaagaugacaagaaucccuucuauauguuuguuaaaggcuuggugggguccaacgauaagauuguaugugagccuaucgacguggauucugacccagauaauuuagacauucugaucaacaagaaucuaacgggauucggcaggaaccucaaagcaccggacucgaaugauacccuggaaaaccuuauacggaagauccaggccgguauucccgaggaggaaguccugccugaguugaaaaagaucaaagaaaugauucagaaggacaucgugaaucgcaaggagcagcuccugaaaucaauaaagaacaauagaauaccauuuagccuggaggggaguaaacucguucccuccacaaagaaaaugaagugguuauucaaacugaucgaugugccuaacaagacuuuuaaugaaaagaugcuugagaaauacugggaaauuuaugacuacgauaaguugaaagcgaacaucaccaacaggcuggacaagacagauaaaaaggcucggucuaucagccgcgccgucuccgaggaacuacgagaguaucacaagaaucucagaaccaacuacaauagguucgugucaggagaccggccagcagccggccuggauaacggcgggagugcuaaauacaaucccgacaaggaggaauuucuucuguucuugaaagagguagaacaauauuuuaagaaauacuucccuguuaagagcaagcauucuaacaaauccaaggauaaaucacucguggacaaguauaaaaauuacugcagcuauaaggucgugaagaaagaggugaaccguaguauuauaaaucagcuggucgcaggauuaauccagcaggguaagcugcucuacuauuuuuacuacaacgacacuuggcaagaagauuuccuuaauucuuauggccuguccuacauucagguugaggaggccuucaaaaagagcgugaugacaucguugucuugggggaucaaccgccuaaccuccuuuuucauagacgauucaaauacgguaaaauuugacgauauuacuaccaagaaagcuaaggaagccaucgagaguaacuauuucaauaagcugagaacauguagcaggaugcaggaccacuuuaaagaaaagcucgcguucuuuuacccaguguaugucaaagauaagaaagaccggccggaugacgauaucgagaaccugauugugcuuguuaagaacgcaaucgaauccgugucuuaccugcgaaaucgcacuuuccauuuuaaggagagcucauugcucgagcuguuaaaagaacuggacgauaagaacaguggacagaauaaaauugacuauuccgucgccgcugaguucauaaagagagacaucgaaaaccuauacgauguguuuagggagcaaauucggagccucggcaucgccgaguacuauaaagcagacaugaucucugauugcuucaagaccuguggucuggaauuugcucuuuacucacccaagaauaguuugaugccugccuucaaaaacguauauaagcgcggggcgaaucugaacaaagccuacauuagagacaagggaccaaaagagacaggcgaucagggccagaauagcuauaaggcacucgaagaguacagggaacugaccugguauauagagguuaagaacaaugaccaauccuacaacgcuuacaaaaaucuucugcaguugaucuauuaccacgccuuccuccccgaggugcgugaaaacgaggcucugauuacggauuuuaucaaucggacuaaggaauggaaccgaaaagagacagaagagagauuaaacaccaagaauaacaaaaagcauaaaaauuucgacgagaacgaugacauuacugucaauacauauagguacgaaucuaucccugauuaucagggggagucgcuggacgauuaccuaaaggugcuccagcgcaagcaaauggcccgggcaaaagaagucaacgagaaggaagagggaaauaacaauuauauacaguuuaucagagacgugguugugugggccuucggugcuuaccuggagaacaaacuuaagaauuacaaaaacgaauugcagccaccccugagcaaggagaauauuggccucaacgacacccugaaggaauuauuuccggaggagaaaguaaaguccccuuucaauaucaaaugcagguuuucaauuaguacguucaucgauaacaaggggaaaucuaccgacaacacaagcgcggaagcagucaagacugauggaaaggaggacgaaaaagauaagaaaaauauaaagcgcaaagaccugcuuuguuuuuauuuguuccuccgacugcuagaugagaacgaaauuugcaagcugcagcaccaauuuaucaaguaccgguguucccucaaagagcguagauuccccggcaauaggaccaagcuggagaaagaaacagagcuuuuggccgaacuggaggaauuaauggagcucgugcgcuuuacuaugccaucaauuccugagaucagcgcuaaggccgaaucugguuaugacaccaugauuaaaaaguacuucaaggauuucaucgagaaaaagguuuuuaaaaaccccaagacauccaaucuguauuaccacagugacagcaaaaccccagugacucggaaguauauggcacuucugaugagaucugcccccuugcaucucuacaaagauauuuucaagggguacuaucugaucacgaagaaagaaugccuagaguacauuaagcuguccaacaucauaaaagacuaucaaaauucacucaacgaacugcacgagcagcuugagaggauuaaguugaaaagugaaaagcagaauggcaaggacagccuguacuuagauaaaaaggacuuuuauaaagucaaggaguacguggaaaaccucgagcagguagcucgauauaaacaucugcagcacaagaucaauuucgagucgcuuuaccgcaucuuucggauucacguggauaucgccgcaagaaugguuggauacacacaggacugggaaagggauaugcauuuccuguuuaaggcgcuagucuauaacggcgugcucgaggaacgucgcuucgaggcuauuuuuaauaacaaugacgauaacaaugacgggcggauagugaaaaagauccagaacaaccugaauaacaaaaauagagaauuggucuccaugcuguguuggaacaagaaauuaaauaagaacgaguucggagccauuaucuggaagaggaauccuauugcacaccucaaccauuuuacccaaacugagcaaaauucuaaaagcucacuggaaagucuuaucaacucccugcgaauauugcucgccuacgaucggaagcgccagaaugcuguuaccaaaacaaucaacgaccugcuacugaaugauuaucacauuagaaucaagugggaggguaggguggacgaaggccagauuuacuucaacaucaaagagaaggaagauauagagaaugagccaauuauccaucuuaaacaccuccacaagaaggacugcuauaucuacaaaaacucuuauauguucgacaagcagaaagaauggauuugcaacgggauaaaggaggaaguguacgauaaaagcauccugaaguguauuggaaauuuguuuaaguucgacuacgaggauaaaaacaaguccucagccaauccgaaacauaccuga

SEQ ID NO: 11276 - RNA, 4314 nt, Artificial Sequence
  Cas13a variant__Lachnospiraceae bacterium__WP_022785443.1__Cas13a
augaagaucagcaaagugagagaggaaaacaggggcgccaagcugaccgucaaugcuaaaacagcaguuguguccgagaaccggucucaggaagggauucucuacaaugaccccucacgcuauggaaagagucguaaaaacgaugaggaccgagauagauacauagaaagcaggcuuaaguccucugguaagcuguaucggaucuucaaugaggacaaaaacaagcgcgagacugaugaauugcaaugguuuuuaucggagauugugaaaaagaucaauagaaggaacggccugguacuaucagacaugcucagcgucgaugaccgggccuucgaaaaagcguuugagaaguacgcugagcugaguuauacgaaucgccgaaacaagguguccgggucuccugccuucgaaaccugcggaguugaugcagccacagcugagagacuuaaaggcauuaucagcgaaacuaauuuuauaaacaggaucaagaauaacauugacaauaaaguguccgaggauaucauugaccggaucauagcaaaguaccugaaaaagucauugugucgugaacgcgucaaaagaggucucaagaagcugcugaugaacgccuucgaucucccauauagugacccggacauugaugugcagagggacuuuaucgauuacguauuagaggacuucuaccacguucgggcuaaaagccaggugucucgauccauuaagaacaugaauaugcccguccagccugagggggauggaaaauuugccaucaccgugucaaagggcggcacagaaagcgggaacaaacgcagugcggagaaggaagcauucaagaaauuucugucugacuaugccucccuugaugagagagugagggacgauauguugcggcgcaugagaaggcuggucguucuauacuucuauggaagcgacgauucgaagcucucugacgugaaugaaaaauuugacguaugggaggaucaugcugcccgucggguggacaaccgagaguucaucaagcugccacuugaaaauaaacuggcaaacgguaagaccgauaaggacgcugagagaauuaggaaaaauacugucaaggaauuguaccgcaaccaaaauauaggcugcuaucggcaggccgugaaagcgguugaggaagauaacaaugggagauacuucgacgauaagaugcucaacauguuuuucauccacaggauugaguauggaguggagaaaaucuacgccaaucugaagcaggucacagaauuuaaggcacgcaccggcuacuuauccgagaaaauauggaaggaccugauuaacuauaucucaaucaaauacauugcuauggguaaggccguguauaauuacgcuauggaugaacucaacgccagugacaaaaaggagaucgagcuugggaaaauuagcgaagaguaucuguccggaauaucuagcuucgauuacgaauugaucaaggcagaggaaaugcuacagcgagagacggccguauauguugcuuuugcggcacggcaucugucaagucaaacuguggagcucgacuccgaaaacagcgauuuccugcuucugaagcccaaaggcaccauggacaagaaugacaaaaacaaguuggccucuaauaacauucucaauuuucugaaagauaaggagacauuacgugacacuauccugcaguacuucggcgggcacucacuauggaccgauuuuccuuucgacaaguaccucgcuggagguaaagaugacgucgauuuucugacagaccuuaaggaugugaucuauaguaugagaaacgacagcuuccauuacgccaccgaaaaucacaacaauggcaaauggaacaaggaguugauuuccgcaauguuugaacacgagacggagaggaugacugucgugaugaaagauaaguucuauucuaauaaccugccaauguucuacaagaaugacgaucucaaaaagcugcuuauagaccuguauaaagacaacguugaacgcgccucgcaagugcccagcuuuaauaagguauucguccggaaaaacuuuccugcuuuggugagagauaaggacaaccucgggaucgagcuggauuuaaaggccgacgcagauaaaggagaaaaugagcugaaguucuacaacgcgcuauauuacauguuuaaagaaauuuacuauaaugcuuuccucaacgacaagaauguuagggagcgauuuaucacaaaagccaccaagguggcagauaacuacgaccgcaauaaagagcggaaccugaaggauagaauuaaguccgccggcucagacgagaaaaagaaacuuagggaacaguugcaaaauuauaucgcugaaaacgauuucggucagcguauaaagaauaucguccaggugaacccagacuacacucuggcccaaauuugucagcucaucaugacagaguauaaucagcagaacaaugggugcaugcagaaaaagagugcagcucgcaaggacauuaacaaagauucuuaccagcauuauaagaugcuguuacugguaaaccuucggaaagccuuuuuggaguucaucaaggaaaauuacgcguuugugcucaaaccguacaagcacgaccugugugauaaggccgacuucguucccgauuuugcuaaauaugucaagccuuacgcaggccuaauaagcagaguggccggauccucagagcugcagaaaugguauauugugagcagguuccucucuccagcucaggccaaccauaugcugggcuuccuucacuccuacaagcaauaugucugggacaucuaccgacgggcaagugaaaccgggacggagauuaaucacagcaucgcggaagauaaaauagccggaguugacaucaccgauguggacgcugugauugauuugucuguaaagcugugcgguacaaucuccucagagauuagugacuauuuuaaggaugacgaggucuacgccgaauacaucagcucguauuuagacuucgaguacgauggcgggaacuauaaagacucccucaaucgcuuuuguaacucugaugcagugaaugaccagaagguugcucuguacuaugauggagaacaucccaaacuuaacagaaauauaauucugagcaaguuguacggcgagaggcgguuccucgagaaaaucacugaccgagugucaagaagugauaucgucgaauauuacaagcugaagaaagagaccucccaguaccagacaaaggguauuuuugacucugaagaugagcagaaaaacaucaagaaauuccaagaaaugaagaauauuguggaguuucgcgaccuaauggauuauagcgaaauagccgacgagcugcaggggcagcucaucaacuggauuuaccugagggagcgugaucuuaugaauuuccaauugggcuaucacuacgcaugccugaacaaugacuccaacaaacaggccacuuauguuaccuuagacuaccagggaaagaagaaucggaaaaucaacggcgcuauucucuaucaaaucugugcgauguacauaaacgggcugccucuuuacuauguggauaaggacucaagcgaauggacaguaagugauggaaaagagucuaccggugccaagaucggcgaauuuuacagauaugcaaaauccuucgagaauacuagcgacugcuacgcuucggggcuggagauuuuugaaaacaucucagagcaugauaauauuacggaacuaaggaacuauaucgagcacuuccgcuacuauucuaguuucgaccgauccuuucucggaauauacagcgaagucuucgauagauuuuucacauacgaccugaaguaucggaagaaugugccaaccauuuuguacaacauccuguuacagcauuuugugaaugucagguucgaguuuguuucuggcaaaaagaugaucgguauugauaaaaaggaccgcaaaauagccaaggagaaggaaugugcccguaucacuauuagagagaaaaacgggguguauagcgaacaguucaccuacaagcucaaaaauggcacaguauauguggaugcucgggacaagagguaccugcaguccaucauucgccuucuguuuuaucccgagaaagucaacauggacgaaaugaucgaggugaaggagaagaaaaagccgucagauaauaacaccggaaaaggcuacaguaagcgagacagacaacaggaucggaaagaauacgacaaguauaaagagaagaagaaaaaggaagggaauuucuugagcggaaugggcgguaacauaaauugggaugagaucaacgcacagcucaaaaacuga

SEQ ID NO: 11277 - RNA, 3156 nt, Artificial Sequence
  Cas13a variant__Listeria newyorkensis__WP_036091002.1__Cas13a
augaagaucaccaaaaugagaguggacggcaggacaauugucauggagcggacuagcaaggaagggcagcugggauacgaggguauagauggcaacaaaacgaccgaaaucauuuucgacaagaaaaaggaguccuuuuauaagucuauccucaauaaaacaguucgcaagcccgaugaaaaagagaagaaccgacguaaacaagccauuaauaaggcuaucaacaaggagauaacugaacuuaugcuggcaguguugcaccaggagguaccuucacagaaauuacauaaucugaagagucuaaacaccgaaagccucacaaaacuguucaagccaaaauuucagaauaugaucuccuacccgcccucuaagggggccgagcacgugcaauucugccuuaccgacauugcggucccugcuaucagagaucuggacgagauuaaaccagauuggggaaucuuuuucgaaaaguugaagcccuauacugacugggccgagucguacauacauuauaaacagacaaccauucagaagucaaucgaacagaacaaaauucaaagcccugauaguccaaggaagcucgugcugcagaaauacguuacggcauuucugaauggcgagccccucgguuuagaccugguggccaagaaguauaaacuugcugauuuggcagaauccuucaagcuggucgaccuaaacgaggauaaaucugccaauuacaagaucaaggcuugucuccagcagcaccaacggaacauccuggacgagcuuaaagaagacccugagcugaaucaguacgggauugaagugaagaaauauauacagcgcuacuuuccaaucaagagagccccgaacaggagcaaacaugcgcgggcagauuucuugaagaaagagcucauugaauccacuguagagcaacaguuuaagaaugccguuuaucacuacgugcuggagcagggaaagauggaggcuuaugaauuaaccgaccccaaaacaaaggaucugcaggacauccgcucaggcgaagccuucaguuuuaaauucauaaacgcaugcgcuuucgccagcaacaaucucaagaugauucuuaacccugagugugaaaaagauauccugggcaaggggaauuuuaaaaagaacuugccaaauucuacuacccgauccgacgucgugaagaaaaugauccccuucuuuucagaugagcuacaaaacgugaauuucgacgaggcgauuugggccaucagaggaagcauucagcagauaaggaacgaagucuaccacugcaagaaacauaguuggaagucuauccugaaaauuaaggguuuugaguucgaaccuaauaacaugaaguaugcagauuccgacaugcagaaacucauggauaaggacaucgcuaaaaucccagaguuuauugaggaaaagcugaaaagcucgggcguugugcgguucuaccgucacgacgagcuucaaucuauaugggaaaugaagcagggguuuucccuguugacaaccaaugcccccuucguaccgucauuuaagcgcguguacgcuaaaggacaugauuaucagacgaguaagaacagauacuauaaucucgaccugacuacauucgauaucuuagaguacggcgaagaggacuuuagggcccgguauuuccugaccaaacuggucuacuaucagcaauucaugccuugguuuacugcagauaacaaugccuuccgagacgcugcgaacuuugugcuccgccugaacaagaauagacagcaggaugcaaaagccuucauuaacaucagggagguugaagagggugaaaugccccgggacuacaugggguacgugcagggacaaauugcuauccacgaggauagcauagaagacacaccaaaucacuuugagaaguucaucucccaggucuuuauuaagggcuucgaucgccauaugagaucugccaaccuuaaauuuaucaagaauccuaggaaccagggcuuggagcaaagcgaaauugaggaaaugucauucgacaucaaaguggagcccaguuuucugaagaauaaagaugacuauauagcauucuggaucuuuuguaagaugcucgacgcccgucaccuguccgaacuucggaacgagaugauuaaauacgaugggcaucugaccggagagcaggaaauuaucgguuuggcucuccugggcguagacagccgagagaaugauuggaagcaguucuucucuucagaaagagaguaugagaagauaaugaaaggguacguuguggaagaguuauaucagagggaaccauaccgccaaagugacggaaagacgcccauccuguuucggggcgucgagcaggccagaaaauaugguaccgaaacagugauucagaggcuauucgaugcaaacccugaguuuaaggucagcaaaugcaaucucgcggagugggaacgccagaaggagacuaucgaagagaccauuaagcgacggaaagaacugcacaacgagugggcuaagaauccgaaaaagccacaaaacaaugccuucuuuaaagaguacaaggaauguugcgacgcaaucgaugccuacaacuggcauaagaacaaaacaacucuugcuuaugugaaugaguugcaccaccuacucauagaaauucuggggcguuacguuggcuauguggccaucgcagacagagauuuccaguguauggcuaaccaguacuuuaagcauuccggaaucaccgagaggguagaauauuggggcgacaaucgcuuaaaaucuauuaagaaacuggauacauuccuuaagaaggagggguuguuugucucggagaaaaacgcccggaaucacaucgcgcaucucaacuaccugagccuaaaguccgaaugcacccugcucuaucugucagagagacuuagggaaauuuucaaauacgaccgaaaguugaaaaaugccgugaguaagucucugauagauaucuuagaccgccacggaaugagcguuguguuugcuaaccucaaggagaauaaacaccggcuggucauuaagucccuugagcccaaaaagcugagacauuuggguggcaaaaagaucgacgggggauacauugaaacuaaccaggugucagaggaauauuguggcaucguaaaaaggcuccuggagauguga

SEQ ID NO: 11278 - RNA, 3363 nt, Artificial Sequence
  Cas13a variant__Listeria seeligeri__WP_012985477.1__Cas13a
auguggaucagcauuaagacccugauacaccaucucggcgugcuuuucuuuugcgacuacauguauaacagaagggagaaaaagaucauugaagucaaaacaaugcggaucacuaagguugagguggaucgcaaaaagguacugauuucccgagacaagaaugggggaaaauugguguacgaaaacgagaugcaggauaauacggaacaaaucaugcaccauaagaaaucuucauucuauaagagugucgugaacaaaaccauaugucgucccgagcagaagcagaugaagaaauuaguucacggucugcuacaggagaauagccaagaaaagaucaaaguguccgacgucacaaagcucaacauuucuaauuuucugaaccauagauucaaaaagucgcuuuacuauuuuccugaaaauucaccagauaaaagcgaagaguacaggaucgagauuaaccugagucaguugcucgaagacucccugaagaagcagcagggcacuuucaucugcugggagucuuuuagcaaagauauggaacuguauauaaauugggccgagaacuacauuuccucaaagaccaaacucaucaagaaaaguauucggaauaaccgcauccaaagcacagaaucuagauccgggcaguuaauggacagguacaugaaggauauccugaauaagaacaaaccguucgacauucagucagugagcgagaaguaucagcuugagaaauugaccagugcucugaaggcaacuuuuaaagaagccaagaagaacgauaaagagauaaauuacaagcuaaaaucuacacuccaaaaccacgaacggcagaucauugaggaacugaaggaaaauuccgagcuuaaccaguucaauaucgaaauacgcaaacaccuggagaccuauuuucccauuaagaagacgaaccgaaaaguaggagacaucagaaauuuggaaaucggcgagauucaaaagaucguuaaccauaggcucaaaaauaagauugugcagcggauacugcaggaagguaaauuagcgagcuacgagaucgagucgacugucaacucuaauucccugcagaagauuaaaaucgaagaggcuuucgcccucaaguuuaucaacgcaugucuuuucgccucaaauaaccugcguaauaugguguauccugugugcaagaaagauauuuugaugauaggggaguucaagaacaguuuuaaagagaucaagcacaaaaaguucauucgccaauggagccaguuuuucucccaggagaucaccgucgacgacauugaacuagcuucuuggggacugagaggcgcaaucgccccaauaaggaacgagaucauucaucucaagaaacacagcuggaagaaauuuuucaauaaccccacauuuaagguuaaaaagucaaagaucauuaauggcaaaacuaaggaugugaccagugaguuccuguacaaagagacacuuuuuaaggacuauuucuacuccgaacuggauagcguaccugaguugaucauaaacaaaauggagucuucaaagauucucgacuacuauaguagcgaucagcugaaucaaguguuuaccaucccaaacuucgaauuaucccugcuaacgucugcuguccccuuugccccuucguucaagcggguguaccucaaaggguucgacuaucagaaucaggaugaggcgcagccagacuacaaccugaaacuuaauauuuauaacgaaaaagcauuuaauagcgaggccuuccaagcucaguacuccuuguuuaagaugguuuauuaccagguguuccugccgcaguuuacuacaaacaaugaucucuucaaaucaagugucgacuuuauccugacccuuaacaaggaacgaaaaggauacgccaaggcauuccaagauauacgcaagaugaauaaagacgagaagcccucugaguauaugagcuacauccagucccagcugauguuguaucaaaagaagcaggaagagaaagaaaagauuaaccacuuugagaaguucaucaaccagguguuuauuaaagguuucaauucauuuaucgaaaagaacagacucacuuacauaugucauccuaccaaaaauacaguaccagagaacgacaauauugagauccccuuccacacggauauggacgauagcaacaucgcuuucuggcugaugugcaaguuacuggacgccaaacagcuaucugaacucaggaaugagaugauuaaguuuuccuguagucugcaaagcaccgaagagaucucuacauucacuaaggcgcgggagguuauuggccuugccuugcugaacggggaaaaaggaugcaaugauuggaaggagcucuuugacgauaaagaagcauggaagaaaaacaugucccuguaugugucagaggaauuacugcagagucuuccuuacacccaggaggacggccagacaccagucauaaaucgcagcaucgauuuggugaagaaguaugguacugagaccauucucgaaaaacuguucucguccucugacgauuacaaggucagcgcuaaagacaucgccaagcuacaugaguacgaugugacagagaaaauugcucaacaggaaucacugcacaagcaguggaucgaaaagcccgggcucgccagagacagugcauggaccaaaaaguaucagaacguuauaaaugacaucuccaacuaccaaugggccaaaacuaagguggagcugacgcagguaaggcaucuucaccaguugacaauugaucuguuaucucgucucgcuggauauaugagcaucgcggaccgggauuuucaauucuccucaaauuacauucuggagcgagaaaacagcgaguauagagucaccaguuggauccuucugucugaaaacaaaaauaagaacaaauacaaugacuaugaguuguacaaccucaagaaugcauccauaaaggugagcucgaaaaacgauccgcagcugaagguugaccuaaaacagcugaggcucacucuggaauaccuugaguuguuugauaaucgccugaaggagaaacggaacaauauuucacacuucaacuauuuaaauggccagcucggcaacucuauccuggaacuuuuugacgaugccagagacgugcugaguuacgauaggaagcuaaagaaugcugucuccaaaagccucaaggagauccugucuagccaugggauggaagugaccuucaaaccuuuguaucaaacaaaccaccaucugaagauugacaaauuacagcccaagaagauacaccaccucggagagaaauccaccguaucaaguaaucaggugagcaacgaguacugucagcugguucgcacucuucugacaaugaaguga

SEQ ID NO: 11279 - RNA, 3465 nt, Artificial Sequence
  Cas13a variant__Paludibacter propionicigenes__WP_013443710.1__Cas13a
augagagugagcaaggucaaaguuaaggacggcgggaaagauaagauggugcugguacacaggaaaaccacaggagcccagcucguguacuccggucaacccgucucuaacgagacuucaaauauccuuccugaaaagaagcggcagaguuucgaccugagcacguugaacaaaaccauuauaaaguuugauacagcuaaaaagcagaaauuaaauguggaccaguauaagaucguugagaagauuuucaaauacccaaagcaagaacugccgaaacagaucaaggcagaggaaauucuacccuuucucaaccauaaauuccaggagccugugaaguauuggaaaaauggcaaggaggaauccuuuaaccugacucuucugaucgucgaggccgugcaggcgcaagauaagcgcaaauugcagccauacuaugacuggaagaccugguacauacagacaaaaucugaucuccugaagaaaucgaucgaaaauaaccgaauugaccugaccgagaaucucucaaagcguaagaaggcuuuacuggccugggagacugaguucacagcaagcgggaguaucgaucuuacccacuaucauaagguauacaugacggacguuuugugcaaaaugcugcaggaugugaagccccuaacugacgauaaaggaaagauuaacaccaaugccuaccacagaggccucaagaaagcucugcaaaaccaucagccugcaaucuuugguacaagggaagucccaaaugaagccaaccgggcugacaaucagcuuuccauauaucaccuggagguggugaaguacuuggaacacuauuuccccauuaaaacuucuaagcgcagaaacaccgccgacgauaucgcgcauuaccucaaagcacaaacacugaagaccacgauugagaagcaguuagucaacgccaucagggcuaauaucauucagcaggggaaaacuaaccaccaugagcugaaggccgacacaaccagcaaugaucucauacggaucaaaacuaacgaagcauuuguucuuaaucugacaggaaccugugcuuucgccgcgaacaauauucgcaacaugguggacaaugagcaaacgaacgauaucuugggcaagggcgacuuuauaaaaucccuacugaaggauaauaccaacucacagcucuauaguuucuuuuucggggaaggacugagcacaaauaaagccgagaaggaaacucagcuuugggguauucgaggcgcaguacagcaaaucagaaacaaugugaaccacuacaagaaagacgcucugaagaccgucuucaacaucucuaauuuugagaacccuacaauuacugauccaaaacagcagaccaauuaugccgacacaaucuacaaggcuagguucauuaacgaguuggagaaaauaccggaagccuuugcacagcaacucaagaccgggggagccguguccuacuauacuaucgaaaaucugaagucauuacugacgacauuccaguuuagccuaugccggaguaccauucccuucgcuccuggcuuuaaaaagguuuucaacggugggaucaauuaccagaacgcgaaacaggaugagucuuuuuaugaacucaugcuggagcaauaccuucguaaggagaauuucgcagaagaguccuauaacgcccgcuacuuuauguugaaacugaucuauaauaaccucuuccugccaggauuuacuaccgacagaaaggcuuucgccgacagcgugggcuucguccagaugcagaauaagaaacaagcagaaaaggugaaccccaggaaaaaggaggccuacgcuuuugaggccguacggccuaugacagcagcggauucgauugcugacuacauggccuauguucagucugaacuuaugcaggagcagaauaaaaaggaagagaagguggcagaagagacccgaauaaacuucgagaaauuuguccugcaaguguucaucaagggcuuugauuccuucuugcgcgccaaagaauuugacuucguccagaugccacagccccagcucacugcuacagccucaaaccaacagaaggcagauaaacugaaucaguuagaggcuaguauuacggccgacuguaagcugaccccgcaguacgcgaaagccgaugacgcuacucacaucgcauuuuauguguucugcaagcuacucgaugccgcucaucugagcaaccuuagaaaugaauugauuaaguuuagggaguccguuaacgaguucaaauuucaccaucugcucgaaaucauagagaucugucuguuaucugccgacgugguaccuacagauuaccgggaccuguauagcucagaagcagauugccuugcgcgcuugagacccuucauugagcaaggggccgacaucaccaauuggagugaccucuucguccaguccgauaagcacagcccagugauucaugcuaacaucgaacugucuguuaaauacggaacaacuaagcuacuggagcagauaauuaauaaagacacccaauuuaagacgaccgaagccaacuucacagcauggaauacugcucagaagucaaucgagcagcucauuaaacagagggaggaucaccacgaacaaugggugaaggccaaaaacgcagacgauaaggagaaacaggaacguaagcgggagaagaguaauuuugcccagaaauucaucgagaagcauggugacgauuaucuggacauaugugauuacaucaacaccuacaauuggcuugacaacaaaaugcacuuuguccauuugaaucgacugcacggcuuaacaauugaacuccuggggagaauggcuggauucguggcgcuuuuugauagggacuuccaguuuuucgaugagcaacagaucgccgacgaauuuaagcugcacggcuucguaaacuugcauagcauugacaaaaagcucaacgaggugccuacuaagaaaaucaaggaaauauaugauauucgcaauaaaaucauccagauuaacgguaauaagaucaacgaguccguucgggcaaaucugauucaguucauaucuucgaaaagaaacuacuauaauaacgcuuuucuacacgucagcaaugacgagaucaaggaaaagcaaauguacgauauuaggaaccauaucgcccacuucaauuaucugaccaaagacgccgcugauuuuucccucauugaccugaucaacgagcuucgcgaauugcugcauuacgaucgaaagcucaaaaaugcagugucaaaggccuucauagacuuauuugauaaacacgggaugauccugaaacuuaaacugaacgcggaccacaagcuaaagguggagagucucgaacccaaaaagauuuaucaucugggcucuagcgcuaaagauaagccagaguaccaguacugcacgaaucaggucaugauggccuauuguaacaugugccgguccuugcuggagaugaaaaaguga

SEQ ID NO: 11280 - RNA, 3858 nt, Artificial Sequence
  Cas13a variant__Rhodobacter capsulatus__ETD76934.1__Cas13a
augcagaucggcaaggugcaagggagaaccauuagcgaguucggagaccccgccgguggccugaaaaggaagauauccacagaugggaaaaaccggaaggaacucccugcucaccuuucuucagacccaaaagcacugaucggacaguggauuaguggcaucgauaagauuuaccgcaagccggacagccgaaaauccgaugguaaggccauccauucucccacuccuucgaaaaugcaguuugacgcgcgugaugacuugggggaggcuuucuggaaguuagucucagaagccggacuggcacaggauagcgacuaugaucaauuuaaaagaaggcuacacccauacggcgacaaguuccagcccgccgauaguggcgcuaagcucaaauuugaggcagacccuccagaaccccaggccuuccaugggcggugguauggagcuauguccaagcgcgguaaugacgccaaagagcuggcggcagcccuuuacgagcacuuacauguugaugaaaagagaauagacggccagccuaaaaggaacccaaagacggauaaauuugcuccgggguuggugguagcccgggcacucggaaucgagucuagcgugcugccccgcggcauggcucgacuggccagaaauuggggugaagaggagauucaaaccuauuucgucguggacguugcggccuccgugaaggaagucgcaaaggcugccgugucagcugcccaggcauuugauccuccaaggcagguaagugggcggagccucucucccaaaguuggauucgccuuagcugagcaccuggaacgugugacaggcuccaagcgcugcucauuugacccugcggcaggcccaagcguccuugccuugcacgaugaggugaaaaagacuuacaaaagacugugugcuagggggaagaacgccgcacgggccuuccccgcugacaagaccgaacuacucgcccugaugcgacauacacacgagaaucgcgugagaaaccagauggucaggaugggacggguuagugaguaucgcggucaacaggcaggcgaucuugcgcagucucauuacuggaccuccgcugggcaaacugaaaucaaagagagcgaaauuuuugugagacuguggguaggagccuucgcauuggccggcaggucgaugaaggcuuggaucgacccgauggguaaaauagugaauacagagaagaacgaucgugaccucaccgccgcagucaauauucgacaggugaucucuaacaaagaaaugguugcugaggccauggcgcggagagggauuuacuucggcgagacgccugaacuggacagguuaggagccgagggcaaugaaggguuuguguucgcucugcuccgcuaucuucggggaugcagaaaccagacuuuucaccugggugcaagggccggcuucuugaaggagauccgcaaggaacuagagaaaacccgaugggggaaggcuaaagaggccgaacacgucgugcugacagauaagacuguagcagcgauccgggccauuauagacaaugaugcuaaagcccucggagcacgucugcuugcugaccuguccggcgccuuuguugcacauuacgccucaaaggagcacuucaguaccuuguauagcgaaaucgugaaggcugucaaagaugcgcccgagguguccucuggucucccaagacugaaguuacugcuaaaaagggccgacgggguccgcggcuacgugcauggacuccgggauacaagaaagcacgcauuugcuaccaaacugccucccccacccgccccuagggagcuugacgauccagccacgaaggcucgauauauugcauugcugcgccucuacgacggcccguuccgggccuaugcgagcgggaucacuggaacagcucuggccggucccgcagccagagcuaaagaagcagccaccgcgcuugcucagucaguuaacgugacuaaggccuacagugauguaauggagggcagguccagccgucugcgcccuccaaaugacggggaaacauugcgggaguaccucucugcacugaccggagaaacggccaccgaguuuagaguccaaauaggcuaugagucagauagugaaaacgcuaggaagcaggccgaguucauugaaaacuaccgacgggacauguuagcauuuauguucgaggacuauauccgcgcuaaagguuuugauuggauccugaagauugaacccggggccacagcgaugacuagagccccugugcuaccagagcccaucgacaccaggggccaguacgagcauuggcaggcagcucucuaucugguuaugcacuucgugccggccagcgaugucuccaaucuuuugcaccaacugcggaaaugggaagcucuccagggaaaguacgagcuggugcaggacggcgaugcaacagaccaggccgaugcccgaagagaagcucuggaccugguaaaacgcuucagggaugugcuuguuuuguuucucaagacuggggaggcgcguuucgaaggacgggcagccccuuuugaccugaagccauucagagcucuauuugccaaccccgcaaccuucgauaggcuguuuauggccacaccuaccacugcucgccccgcggaggacgauccagagggcgacggugccucugaaccugagcuccgagucgcaagaacgcugcgggggcuuaggcaaauugcucgcuauaaucauauggccguguugucggaccuguucgcaaaacacaaggugcgugaugaagaggucgccagauuagcugagauagaagacgagacacaggaaaagagccagaucguugccgcgcaggagcuccggaccgaucugcaugacaaggugaugaaaugucaccccaagacuauuuccccagaagagaggcaaucauacgcagccgcuaucaagaccaucgaggaacaccgcuuucuugugggacgaguauaccugggcgaucauuugagacuccaccggcugaugauggacgucauugguaggcuaauagauuaugccggcgcuuacgagcgcgacacagggaccuuccugaucaacgcaaguaaacagcucggagccggcgcugauugggccgugacuauugcaggggcggccaauacagacgcuagaacgcagaccaggaaggaucuggcccauuuuaacguucuugaccgggcagacggaacuccggauuugacagcucuggugaaucgugcccgcgaaaugauggcauaugaccgaaaaagaaagaacgccgucccuaggucuaucuuagauaugcucgcucggcugggccuuacccugaaauggcaaaugaaggaccaccuacuccaggaugcgacaauuacucaggccgcaaucaagcaucuggacaaagugcgcuugaccguuggugggcccgcugccgugacggaggccagauucagccaggauuaccugcaaaugguagcagcugucuuuaauggauccgugcagaacccaaagcccaggcggcgagacgauggcgacgccuggcacaaaccuccaaagcccgcgaccgcucagucacagccugaucaaaaaccgccaaauaaggcccccagcgcagguucuagauuaccuccaccccaggugggcgaagucuaugaggggguugugguaaaagugauagacacaggaucccucggcuuccuggccgucgaggggguggcuggaaacaucggccuucacauuagucgccugaggcggauccgugaagaugcaauuaucguugguagaagguaccgcuuccggguggagauauaugucccuccgaaaagcaauacuucuaaguugaacgccgcggaccucgugcgaauugacuga

SEQ ID NO: 11281 - RNA, 1578 nt, Artificial Sequence
  Cas13a variant__Corynebacterium ulcerans__WP_038617242.1__Cas13
augcccaaguacugccugaccgccagauucccucucggcguguaucuugggcacacaggagacgcuaacagggaugcauacccagacccggcccggcugcaugcggcuuugaugaaugccgcagcccaggguguccacgcugaggaagaucccaacgagcaucaauuacgcccuagccagcagucccugcaggcacuacaauggcucgaagcccacccacccacuggccuggcuaugccugagcagcaguggcuuucuccagacacgucacgaaugauguaucguaauguugggagugugaaaaucgauaagaccggaguaacaagagccacugaaaacagggcggugagcgacggcgucuccgugaauggugcauacggguauauuugggaugagaugcccguugacauagccgaggcuaucaccgcccuguugccugauguggcaugucucggagaggcuucuucgcuggucgugcuggaacagcaagaaauugaggccacacucaccuuagacccacaggcgacugccuuuucaacagagcggguacagguucgcaucgcacugccgggcagaacccagcaucuuagggaaguguuccacgcucgguacggcaaaaagcccccuagcaaaaaggccgauaaguuuuugaaagacgauccaauucacgaucccccuaucccaaaggaccaucuggggacggcucgcuaucuacgagucaacgccgcagacaaagagugcgugacucccuggaccaaggugauacuccuggaaguccacggaaaacaacuuggugccaaggagcagguuagagcugcgguggcacugcauagggccuugaucgcucggauucguacagacguaaguccggugaucacuggccgcuacgccgcaggggcccagagaccugcuaauaaccucgccauucaauacaucccccacaggcaccuggaagcauuaggacugaagaccuccgcguucgcucuccuugucccacaggaugccgacucuacaguguaugagcagcugaaucaggcauugaccggcccuuuuccccuacggagcggugggaaacugcucugucaacugaaguacaacggacauguuuuccgaggcgaugccuuuuggccagcuccccagccuggcacgauacgcaugugggagccacuuaauguguucauuccggaauccagaccccacaacaaacagcaggggguccuguggagguuggccgacgcaggacuccugucaguggcuuuuguauggcgggauaauuucccuacuaaggagacagguccagcccgcuauguugaauuaagagacgcggccuacaacgcugaugugaggaucuuucaugaccaccccgucagucguaauacccggcgauucgugcauagaacuaacaggagccugacaauucaaccuuggcgcggccuaguccaccucgggucucugcagcaggaucgggcaaucaucgcccuuggacaguccagacacuugggcggugggcugcucauuccaguggacauacccaggucagaguuugaaaccaugacgagcgagaugacccaugcuuga

SEQ ID NO: 11282 - RNA, 3675 nt, Artificial Sequence
  Cas13b variant__Bergeyella zoohelcum__WP_002664492.1__Cas13b
auggagaacaagaccagccugggcaauaacaucuacuauaaucccuucaaaccucaggacaaguccuacuuugccggguauuucaacgcugcaauggaaaauacagauucuguguuuagagagcucggaaaaaggcuuaaggguaaagaauacacuucagagaacuucuuugacgccauuuucaaggaaaauauaagucuggucgaguaugagcgguacguuaaguuguuaagcgauuauuuuccaauggcgcgccugcuagacaaaaaggaagugccgaucaaagagcgaaaggaaaacuucaaaaagaauuuuaagggcauuaucaaagcuguacgugaucucagaaacuucuacacgcacaaggagcauggggagguggaaauuaccgacgagaucuuuggaguccuggaugaaaugcuuaaauccacagugcugacuguuaagaaaaagaaagugaagaccgacaagacaaaagagauauugaagaaaucuaucgaaaagcaacucgauauucugugccagaaaaagcuggaguaccucagggacaccgcccggaagaucgaggaaaaacgcagaaaucagagggagcggggcgaaaaggaguuagucgcacccuucaaauauucggauaagcgcgacgaucugauugccgcuaucuacaacgacgcauuugacguguauauagauaaaaagaaggacucacuuaaagaaagcaguaaggccaaauacaauacuaaguccgauccucagcaagaggagggugacuugaaaauuccaaucucuaagaacgggguaguuuuccugcuaagccucuuccugacaaagcaggaaauucacgcuuuuaaauccaagaucgccggauucaaagcgaccgugaucgaugaggcaacggucucagaagccacugugagucauggcaagaauagcauuuguuuuauggcuacccacgagauauucucucaucuugccuauaaaaagcugaaacgaaaggugagaacagcagaaaucaacuacggcgaggcugagaacgccgaacaguuguccgucuaugcgaaggagacucucaugaugcagaugcuggacgaauuaucaaaaguucccgaugugguauaccaaaaucugagcgaggacgugcagaagaccuuuauugaggauuggaacgaauaccucaaagagaauaacggggacgucggaacaauggaagaggaacaggugauccacccuguuauaaggaagcgguaugaggauaaauucaauuacuuugccauucguuuccuugacgaguuugcacaguucccaacccugcgcuuucaagugcacuuggguaacuaucuacaugacaguagacccaaggaaaaucugaucucugauaggcggaucaaggagaaaauuacggucuucggccgacucuccgaacuggagcacaagaaagcucuuuuuaucaagaacacugaaacaaaugaggaccgcgagcauuacugggaaauuuucccuaacccaaauuaugauuucccgaaagagaacauaagcgugaaugacaaggauuuucccaucgccgggucgauucuggacagagaaaagcagccuguagcuggaaaaaucggcaucaagguuaaauugcucaaccagcaauacgugucugaggucgauaaggccgugaaagcacaccagcugaagcagaggaaggccuccaaaccaucaauucagaauauaaucgaagagauuguccccaucaacgagaguaacccuaaggaagcuauuguguucggugggcaaccaaccgcguauuuaagcaugaaugacauccacuccauacuguacgaguuuuucgauaaaugggaaaagaaaaaggagaaacuagagaagaagggagaaaaagagcuccggaaggaaaucggcaaagagcuggaaaagaaaauuguuggcaagauccaggcacagauucagcaaaucauagacaaggauacuaacgccaaaauucuuaagcccuaccaggacggaaauucuacagcuaucgauaaagagaaguugauuaaagaccugaagcaggagcagaacauccuccaaaagcugaaagacgaacagaccgugcgcgagaaggaauauaaugauuuuauagccuaccaggacaaaaacagagagaucaauaagguaagggaucguaaccauaaacaguaucuuaaggacaaucugaagcggaaauacccggaagccccugcacgaaaggaggucuuguauuacagagagaaagggaagguggcuguuuggcucgccaacgauauuaaaagguucaugcccacggacuuuaagaaugaauggaagggugagcaacacagccuguuacagaaaucacuggcauauuacgaacagugcaaggaggaacucaaaaaccuacugccagagaagguguuccaacaucuuccuuuuaaauugggcggguacuuccagcagaaguaucuguaccaguuuuauaccuguuaccucgauaaacgccuggaguauaucaguggauuaguccaacaggcggaaaauuucaaguccgagaacaagguguuuaaaaagguagaaaaugagugcuucaaauuccugaagaaacagaacuacacacacaaggagcuugacgcucgggugcagagcauuuugggcuaucccaucuuucucgaaagagguuucauggaugagaagccaacuauaauuaaagggaagaccuuuaaaggcaacgaagcccuguucgcagacugguuuagguacuacaaggaguaucaaaauuuccagacauuuuacgauacugaaaacuauccccuaguugagcuggagaaaaagcaggccgaccgcaagcgaaaaaccaagaucuaccagcagaaaaagaaugaugucuucacacuccugauggcuaaacauaucuuuaagucuguguucaagcaagacucaauugaccaguuuagucuugaagauuuguaucaaagccgggaggaacgucugggaaaccaggagagagccaggcagaccggcgaacgcaauacuaacuacaucuggaauaaaacgguggacuuaaagcucugugaugggaaaauuacagucgagaacguuaagcugaaaaaugugggagacuucauaaaguaugaguacgaucagcgggugcaagcauuccuuaaauacgaagagaacaucgaauggcaggcuuuucugauuaaggaguccaaggaagaggagaauuauccuuacguagucgaaagagagaucgaacaguaugagaaagugaggcgagaggaauugcucaaggagguucaccugauugaagaguacauccuagaaaaagugaaggacaaagagauacugaagaagggugauaaccagaauuucaaauauuacauccucaacggccugcuuaagcaauugaaaaaugaggacgucgaaucuuauaagguguuuaaccugaacaccgagccagaagauguuaauauuaaccaguuaaaacaggaggccacugaccucgaacagaaggcguucgugcugaccuacauccgcaauaaguuugcccacaaccaacuuccgaaaaaggaguucugggauuacugccaggagaaauaugggaagauugaaaaagagaagacauacgcugaauauuuugcagagguauucaagaaagaaaaggaggcccugaucaaauga

SEQ ID NO: 11283 - RNA, 3675 nt, Artificial Sequence
  Cas13b variant__Bergeyella zoohelcum__WP_002664492.1 modified__Cas13b(R116A,H121A,R1177A,H1182A)
auggagaacaagaccagccugggcaauaacaucuacuauaaucccuucaaaccucaggacaaguccuacuuugccggguauuucaacgcugcaauggaaaauacagauucuguguuuagagagcucggaaaaaggcuuaaggguaaagaauacacuucagagaacuucuuugacgccauuuucaaggaaaauauaagucuggucgaguaugagcgguacguuaaguuguuaagcgauuauuuuccaauggcgcgccugcuagacaaaaaggaagugccgaucaaagagcgaaaggaaaacuucaaaaagaauuuuaagggcauuaucaaagcuguacgugaucucgccaacuucuacacggcaaaggagcacggggagguggaaauuaccgacgagaucuuuggaguccuggaugaaaugcuuaaauccacagugcugacuguuaagaaaaagaaagugaagaccgacaagacaaaagagauauugaagaaaucuaucgaaaagcaacucgauauucugugccagaaaaagcuggaguaccucagagacaccgccaggaagaucgaggaaaaacggcgcaaucagagagagaggggcgaaaaggaguuagucgcucccuucaaauauucggauaagcgggacgaucugauugcagccaucuacaacgacgcuuuugacguguauauagauaaaaagaaggacucacuuaaagaaagcaguaaggccaaauacaauacuaaguccgauccucagcaagaggagggugacuugaaaauuccaaucucuaagaacgggguaguuuuccugcuaagccucuuccugacaaagcaggaaauucaugcguuuaaauccaagaucgcaggauucaaagccaccgugaucgaugaggcuacggucucagaagccacugugagucacggcaagaauagcauuuguuuuauggcaacccaugagauauucucucaccuugcuuauaaaaagcugaaacgcaaggugcgaacagccgaaaucaacuacggcgaggcggagaacgccgaacaguuguccgucuaugcaaaggagacucucaugaugcagaugcuggacgaauuaucaaaaguucccgaugugguauaccaaaaucugagcgaggacgugcagaagaccuuuauugaggauuggaacgaauaccucaaagagaauaacggggacgucggaacaauggaagaggaacaggugauccauccuguuauaagaaagagguaugaggauaaauucaauuacuuugcuauucgguuccuugacgaguuugcccaguucccaacccugcguuuucaagugcacuuggguaacuaucuacacgacagucgccccaaggaaaaucugaucucugauagaaggaucaaggagaaaauuacggucuucggccggcucuccgaacuggagcauaagaaagcucuuuuuaucaagaacacugaaacaaaugaggaccgagagcacuacugggaaauuuucccuaacccaaauuaugauuucccgaaagagaacauaagcgugaaugacaaggauuuucccaucgccgggucgauucuggaccgcgaaaagcagccuguagcaggaaaaaucggcaucaagguuaaauugcucaaccagcaauacgugucugaggucgauaaggccgugaaagcucaucagcugaagcagagaaaggcguccaaaccaucaauucagaauauaaucgaagagauuguccccaucaacgagaguaacccuaaggaagcaauuguguucggugggcaaccaaccgccuauuuaagcaugaaugacauccacuccauacuguacgaguuuuucgauaaaugggaaaagaaaaaggagaaacuagagaagaagggagaaaaagagcucaggaaggaaaucggcaaagagcuggaaaagaaaauuguuggcaagauccaggcucagauucagcaaaucauagacaaggauacuaacgccaaaauucuuaagcccuaccaggacggaaauucuacagcaaucgauaaagagaaguugauuaaagaccugaagcaggagcagaacauccuccaaaagcugaaagacgaacagaccgugcgggagaaggaauauaaugauuuuauagccuaccaggacaaaaaccgcgagaucaauaagguaagagauaggaaccacaaacaguaucuuaaggacaaucugaagcguaaauacccggaagcuccugcccggaaggaggucuuguauuaccgagagaaagggaagguggcaguuuggcucgcgaacgauauuaaaagauucaugcccacggacuuuaagaaugaauggaagggugagcaacauagccuguuacagaaaucacuggcuuauuacgaacagugcaaggaggaacucaaaaaccuacugccagagaagguguuccaacaccuuccuuuuaaauugggcggguacuuccagcagaaguaucuguaccaguuuuauaccuguuaccucgauaaaaggcuggaguauaucaguggauuaguccaacaggccgaaaauuucaaguccgagaacaagguguuuaaaaagguagaaaaugagugcuucaaauuccugaagaaacagaacuacacacauaaggagcuugacgcacgcgugcagagcauuuugggcuaucccaucuuucucgaacgggguuucauggaugagaagccaacuauaauuaaagggaagaccuuuaaaggcaacgaagcccuguucgcugacugguuuagauacuacaaggaguaucaaaauuuccagacauuuuacgauacugaaaacuauccccuaguugagcuggagaaaaagcaggccgacaggaagcgcaaaaccaagaucuaccagcagaaaaagaaugaugucuucacacuccugauggcaaaacacaucuuuaagucuguguucaagcaagacucaauugaccaguuuagucuugaagauuuguaucaaagccgagaggaacggcugggaaaccaggagcgugcuagacagaccggcgaaaggaauacuaacuacaucuggaauaaaacgguggacuuaaagcucugugaugggaaaauuacagucgagaacguuaagcugaaaaaugugggagacuucauaaaguaugaguacgaucagcgcgugcaagccuuccuuaaauacgaagagaacaucgaauggcaggcguuucugauuaaggaguccaaggaagaggagaauuauccuuacguagucgaacgggagaucgaacaguaugagaaagugagaagggaggaauugcucaaggagguucaucugauugaagaguacauccuagaaaaagugaaggacaaagagauacugaagaagggugauaaccagaauuucaaauauuacauccucaacggccugcuuaagcaauugaaaaaugaggacgucgaaucuuauaagguguuuaaccugaacaccgagccagaagauguuaauauuaaccaguuaaaacaggaggccacugaccucgaacagaaggcuuucgugcugaccuacaucgcaaauaaguuugccgcuaaccaacuuccgaaaaaggaguucugggauuacugccaggagaaauaugggaagauugaaaaagagaagacauacgccgaauauuuugcagagguauucaagaaagaaaaggaggcgcugaucaaauga

SEQ ID NO: 11284 - RNA, 3384 nt, Artificial Sequence
  Cas13b variant__Prevotella buccae__WP_004343973.1__Cas13b
augcagaagcaagacaaacuguucguggauagaaagaaaaacgccaucuuugcuuuccccaaguacauuaccauaauggagaauaaagaaaagccugagccaaucuauuacgaacucacagacaagcacuuuugggcagccuuccuuaaccuggcgaggcauaaugucuauacuacgauuaaccacaucaaucggcgcuuggagauugcugaauuaaaagaugacggcuacaugauggggaucaagggaagcuggaacgagcaggccaaaaagcuggauaaaaagguucgacuacgugaccucauaaugaagcauuuuccguuccuggaggcagccgcuuaugaaaugaccaauuccaaaucucccaacaauaaggagcagagagaaaaagagcagucagaggcacuuagucugaacaauuugaagaacgugcucuuuaucuuccuggaaaaacugcaaguacucaggaauuacuauagccacuacaaguacuccgaggaaucuccuaaaccaauuuuugagacaucguuacugaagaacauguauaagguguucgaugccaauguccggcuugugaaacgcgacuacaugcaucacgaaaacaucgauaugcagagagacuuuacucacuugaacaggaagaaacagguuggucggaccaagaauauuaucgauucacccaacuuccauuaucacuuugcugacaaagagggcaauaugacaauagccgggcugcuauucuucgugagccucuuucuggauaagaaggacgcgauuuggaugcagaaaaagcugaaaggauucaaggacggccgcaaccuucgagagcaaaugaccaaugaagucuuuugcagaaguaggaucuccuugccuaaacucaagcuggagaacgugcagacuaaggauuggaugcaguuagacaugcugaaugaacucguacgguguccaaaaucucuuuacgagcgucugcgcgaaaaggauagagagagcuucaaaguucccuuugacauuuucuccgaugacuauaacgcagaggaggagccuuuuaagaauacauuggugaggcaucaggaucgguucccauacuuuguccuacgauauuucgaccugaacgaaaucuuugagcaacuccgcuuccagaucgaucuggguaccuaccacuuuucaauuuacaauaaaagaauaggggacgaagaugaggugaggcaccuuacgcaucaccuguauggauucgcccggauccaggacuucgcuccgcaaaaccagcccgaggaauggcgcaaguuggugaaggaccucgaucauuuugagacaagucaggaaccuuacauuagcaaaaccgccccacacuaucaucuggagaaugagaagaucggcauaaaauucugcucugcacacaacaauuuauuucccucccugcagacagacaagacuuguaacggcagaucaaaauucaaccuagggacccaauuuacagcugaagccuuccucagcguccacgagcugcuuccuaugauguuuuacuauuugcugcucaccaaggauuacaguaggaaagaaucugcggacaagguugagggaauuauccguaaggaaaucuccaauauuuaugccaucuacgaugcauucgcuaacaaugagauuaacagcauagccgaccugacgcggcgacuucagaauacuaacauccugcagggucauuugccaaaacagaugauuucgauccucaagggcagacaaaaagauauggggaaggaggcugaaaggaaaaucggagagaugauugacgauacacagcgccggcuggacuuacugugcaagcagaccaaucagaagauaagaaucggcaaaaggaacgccggucuacucaagucugggaaaauugcagauuggcuggugaaugacaugaugcgcuuucaacccguacagaaggaucagaacaauaucccgauuaacaauuccaaagccaacucaacugaauaccgaaugcuucagcgggcuuuggcgcuguucggaagugagaauuuucgucucaaggcauauuucaaccaaaugaaccuggugggcaaugacaacccucaccccuuuuuagccgaaacacagugggagcaucagaccaauauccugagcuucuacagaaacuaucuugaggcuaggaagaaauacuugaagggccucaaaccacaaaauuggaagcaguaucagcacuuccugauacuaaaaguccagaagacgaaccgcaauacccuggugacaggguggaagaacuccuuuaaucucccucggggaaucuucacucaacccauuagagaaugguuugagaaacacaacaauucuaagaggaucuacgaccagauucugagcuucgaucgaguugguuuuguggccaaagcaaucccacuuuauuucgccgaagaguacaaggacaacguccagcccuuuuacgauuauccuuucaauauaggcaaccgcuugaaaccaaagaaacggcaguuucuggacaagaaggaaagaguggaguuauggcagaaaaauaaggaacucuucaaaaacuacccgucagaaaagaaaaagaccgaucuggcuuaucuugacuuucugaguuggaagaaauucgagagggaauugcgucucauuaagaaccaagauaucguaacauggcugauguucaaagagcuauuuaauauggccacuguugaggggcugaagauuggagaaauccaucuccgcgacauagauaccaacacagcaaaugaggaauccaacaauauccugaaccggauuaugcccaugaaacuuccugugaagaccuacgagacugacaauaagggcaacaucuugaaagaaagaccacuggcgacguucuauauugaggagacagaaaccaaggucuuaaaacaggguaauuuuaaggcucucgugaaagauaggcgacugaacgggcuuuucagcuuugccgagacuaccgaccugaaucuagaggaacaccccaucucuaagcucucagucgaucuggaauugauaaaguaccagacaacccggauuaguaucuucgagaugacucugggcuuagagaaaaagcucaucgacaaauauagcacacugccuacggacuccuuucgcaacaugcuugaaagauggcugcaauguaaggcaaauaggccagaguugaaaaacuacguuaauucucucauugccgugcggaacgcuuucucgcauaaucaguaccccauguaugaugccacccuguuugcagaagugaagaaguucacucuauuuccgagcguagacacuaaaaagaucgagcugaacauugcuccucagcuucucgaaauagucggaaaagccaucaaggagauugagaaauccgaaaacaagaauuga

SEQ ID NO: 11285 - RNA, 3273 nt, Artificial Sequence
  Cas13b variant__Prevotella sp.__WP_044065294__Cas13b
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaaccauuacaagaccuacgaggagaaacuuaaugaugggugcgaauuucugacaagcacugagcagcccuuguccggaaugaucaacaacuauuacaccguggcacuccguaauaugaacgaaagauauggcuacaagacagaggaccuggccuucauacaagauaagagguuuaaauucgucaaggacgcuuaugguaaaaagaaaucucaggugaauaccggguuuuuccugucgcuccaggauuacaacggagacacucagaagaaauuacaccugucaggcguaggcaucgcacuuuugauuugucuguuucuagauaagcaauauaucaauauuuuccucagccggcugccuaucuucaguuccuacaacgcccagucugaagaacgcagaauaauuaucaggagcuuugggauuaauuccaucaaacuuccaaaagaccggauccauucagagaagaguaacaaaagcguugcuauggauaugcugaaugaagugaagcgcugccccgacgaguuguucacaacccucucugccgaaaaacagucccgauuuagaauuauaucagacgaucacaacgagguccugaugaagaggagcagugaccgguucgugccuuuacugcuccaauacaucgauuauggaaaacuuuuugaccacauucguuuccaugugaauauggguaaacugcgcuacuugcuaaaggcggauaaaacguguaucgacggccagacuagagucaggguuauagaacagccacugaacggguuuggacggcucgaggaggcagaaaccaugcgaaagcaggagaauggcacauucgguaacucugggauucgcaucagagauuuugaaaauaugaaaagggacgaugccaaccccgcuaacuauccuuacaucguggacacuuauacccacuacauucuggagaauaacaagguagaaauguucaucaaugauaaggaggacuccgccccacuucugccggugauugaggacgaucgguaugucgugaaaacaauacccagcugccgcaugucgaccuuggaaaucccugcaauggcuuuucauauguuccucuuuggaucuaagaaaacggagaagcugauuguugacgugcacaacagauacaaaagguuauuccaagccaugcagaaggaagaggucacugcggagaauaucgccuccuucggcaucgcagaaucagaucugccacagaagauucuagaccucauaaguggcaacgcucacgggaaagauguggacgccuuuauccgucugacaguagaugacaugcuuaccgauacugagcggcgaauuaagagauucaaagacgaucgcaagagcaucagguccgcugacaauaaaaugggaaagcgggguuuuaaacagauuucuacaggcaaguuggccgauuuccuggcaaaggacaucguucucuuucaacccagcgugaacgacggggaaaauaaaauaaccggacugaacuacagaaucaugcagucagccauugcugucuaugauaguggcgacgauuacgaggcgaagcagcaguucaaacuuauguuugaaaaggcaaggcugaucgguaaagggacgaccgagccucauccauucuuguauaagguguuugcccgcuccauucccgcuaaugccgucgaguucuacgaacgauaucucaucgagcggaaguuuuaccugacaggcuuaagcaacgaaauaaagaagggaaaucguguggacguuccguucauuagaagggaucaaaacaaauggaagacuccugcaaugaaaacccugggccgcaucuauucugaggaccuacccguggaacucccacggcagauguuugauaaugagauuaagucacaccugaagagucuuccucagauggaggggaucgacuucaacaacgccaauguaacauacuugauagcugaauacaugaaaagaguccuggaugacgauuuccagacuuuuuaucaauggaacaggaauuaccgauauauggacaugcucaagggagaguacgaucgcaaagguagccugcagcauuguuucaccuccguggaggagcgggaaggcuuauggaaggagagagccucuaggacagagcguuaucgcaaacaggcaucgaacaagauccggagcaauagacaaaugaggaacgcguccucagaagagauugaaaccauccuggacaagcgacuuaguaauucucggaacgaguaccagaaaagcgagaagguuauucgcagauauagggugcaggacgcuuugcucuuucugcuagccaaaaagacucugacggaacucgcagauuucgacggggagcgguuuaaacugaaggaaaucaugcccgaugccgagaaaggaauacuuuccgaaauuaugccaaugucauucacauuugagaagggcgguaagaaauacaccaucacuagcgaggggaugaaguugaaaaauuacggcgacuucuuuguccuggcuucugauaagcgaaucggaaacuuacucgaacuggugggcuccgacauuguaaguaaagaggauaucauggaagaguucaauaaguaugaccagugcagacccgaaauuagcucuauaguguuuaaccuugagaagugggccuucgauaccuacccugagcuguccgcacgcguugacagggaagagaaagucgauuucaagucaaucuugaaaauucuccugaauaacaagaauaucaacaaagaacaaagugacauucuacguaagauccggaacgcuuuugaccacaauaacuauccagauaagggggugguggagauaaaagcccugccggaaaucgcgaugagcauuaagaaagccuucggagaguacgcuaucaugaaguga

SEQ ID NO: 11286 - RNA, 4152 nt, Artificial Sequence
  Cas13b variant__Artificial____PspCas13b-GS-HsADAR2DD(E488Q,del984-1090)
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaacgcauacaagaccuacgaggagaaacuuaaugaugggugcgaauuucugacaagcacugagcagcccuuguccggaaugaucaacaacuauuacaccguggcccuccguaauaugaacgaaagauauggcuacaagacagaggaccuggcuuucauacaagauaagagguuuaaauucgucaaggacgcauaugguaaaaagaaaucucaggugaauaccggguuuuuccugucgcuccaggauuacaacggagacacucagaagaaauuacaucugucaggcguaggcaucgcccuuuugauuugucuguuucuagauaagcaauauaucaauauuuuccucagccggcugccuaucuucaguuccuacaacgcucagucugaagaacgcagaauaauuaucaggagcuuugggauuaauuccaucaaacuuccaaaagaccggauccacucagagaagaguaacaaaagcguugccauggauaugcugaaugaagugaagcgcugccccgacgaguuguucacaacccucucugcggaaaaacagucccgauuuagaauuauaucagacgaucauaacgagguccugaugaagaggagcagugaccgguucgugccuuuacugcuccaauacaucgauuauggaaaacuuuuugaccacauucguuuccacgugaauauggguaaacugcgcuacuugcuaaaggcagauaaaacguguaucgacggccagacuagagucaggguuauagaacagccacugaacggguuuggacggcucgaggaggccgaaaccaugcgaaagcaggagaauggcacauucgguaacucugggauucgcaucagagauuuugaaaauaugaaaagggacgaugcuaaccccgccaacuauccuuacaucguggacacuuauacccauuacauucuggagaauaacaagguagaaauguucaucaaugauaaggaggacuccgcaccacuucugccggugauugaggacgaucgguaugucgugaaaacaauacccagcugccgcaugucgaccuuggaaaucccugcuauggccuuucacauguuccucuuuggaucuaagaaaacggagaagcugauuguugacgugcauaacagauacaaaagguuauuccaagcgaugcagaaggaagaggucacugccgagaauaucgcauccuucggcaucgcugaaucagaucugccacagaagauucuagaccucauaaguggcaacgcccacgggaaagauguggacgcuuuuauccgucugacaguagaugacaugcuuaccgauacugagcggcgaauuaagagauucaaagacgaucgcaagagcaucagguccgccgacaauaaaaugggaaagcgggguuuuaaacagauuucuacaggcaaguuggcagauuuccuggccaaggacaucguucucuuucaacccagcgugaacgacggggaaaauaaaauaaccggacugaacuacagaaucaugcagucagcuauugcggucuaugauaguggcgacgauuacgaggcaaagcagcaguucaaacuuauguuugaaaaggccaggcugaucgguaaagggacgaccgagccucacccauucuuguauaagguguuugcucgcuccauucccgccaaugcagucgaguucuacgaacgauaucucaucgagcggaaguuuuaccugacaggcuuaagcaacgaaauuaaaaagggaaaucguguggacguuccguucauuagaagggaucaaaacaaauggaagacuccugccaugaaaacccugggccgcaucuauucugaggaccuacccguggaacucccacggcagauguuugauaaugagauuaagucacaucugaagagucuuccucagauggaggggaucgacuucaacaacgcuaauguaacauacuugauagccgaauacaugaaaagaguccuggaugacgauuuccagacuuuuuaucaauggaacaggaauuaccgauauauggacaugcucaagggagaguacgaucgcaaagguagccugcagcacuguuucaccuccguggaggagcgggaaggcuuauggaaggagagagcaucuaggacagagcguuaucgcaaacaggcgucgaacaagauccggagcaauagacaaaugaggaacgcuuccucagaagagauugaaaccauccuggacaagcgacuuaguaauucucggaacgaguaccagaaaagcgagaagguuauucgcagauauagggugcaggacgccuugcucuuucugcuagcaaagaagacucugacggaacucgccgauuucgacggggagcgguuuaaacugaaggaaaucaugcccgaugcugagaaaggaauacuuuccgaaauuaugccaaugucauucacauuugagaagggcgguaagaaauacaccaucacuagcgaggggaugaaguugaaaaauuacggcgacuucuuuguccuggccucugauaagcgaaucggaaacuuacucgaacuggugggcuccgacauuguaaguaaagaggaugggagccuucagcugcccccuuuggaaagacucacccugggaucucaacuacaucugccacaggugcucgcagacgcuguuucccgccugguccuugguaaguucggcgauuugacagacaauuuuucaaguccgcacgccaggcguaaggugcuggcggggguggucaugaccacuggaacagauguuaaagacgccaaggugaucagcgugucgacgggcaccaaaugcauuaacggugaguauauguccgaccggggguuagcucucaaugauugucaugcagaaauaaucucuagaaggagccugcuucgcuuccuguacacucagcuagagcucuaucugaacaauaaggacgaucagaaacgaucaauuuuccaaaagagugagagaggcggauuucgguugaaggaaaacguacaguuccaccuguacaucuccacaucucccugcggcgacgccaggauuuuuagcccucacgagccaaucuuagaggaacccgcugaucgccauccuaaccguaaagccagagggcagcuccggaccaagauagaauccggacagggcacaaucccagucaggucaaaugcaagcauucaaacuugggacggugugcugcagggggagcgccuucugaccaugaguuguucugauaaaaucgcgcgauggaacguugugggaauacagggcuccuugcucagcaucuucgucgagcccauauauuuuucgucaauuauccuggguucucuauaccacggcgaccaucugaguagagccauguaucaacggaucuccaauauugaagaucuuccgccucucuacacgcugaacaagccauugcugagcgggauaucuaaugcugaggccaggcagcccggaaaagcaccuaacuucagcgugaauuggaccguuggcgacuccgcuaucgaagugauuaacgccacaacugggaaggaugaguuaggacgcgcaucaagacucugcaagcacgcccuguacuguagguggaugcggguacacggcaaaguccccagucaucuucugcguagcaagaucaccaaaccaaauguguaucacgagucuaaguuggcugcgaaagaauaccaggccgcaaaggcucgccucuuuacagccuucauuaaggccggucugggggcuuggguggagaaaccuacugaacaggaccaauuuucccuaaccuga

SEQ ID NO: 11287 - RNA, 4152 nt, Artificial Sequence
  Cas13b variant__Artificial____PspCas13b-GS-HsADAR2DD(E488Q,T375G,del984- 1090)
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaacgcauacaagaccuacgaggagaaacuuaaugaugggugcgaauuucugacaagcacugagcagcccuuguccggaaugaucaacaacuauuacaccguggcccuccguaauaugaacgaaagauauggcuacaagacagaggaccuggcuuucauacaagauaagagguuuaaauucgucaaggacgcauaugguaaaaagaaaucucaggugaauaccggguuuuuccugucgcuccaggauuacaacggagacacucagaagaaauuacaucugucaggcguaggcaucgcccuuuugauuugucuguuucuagauaagcaauauaucaauauuuuccucagccggcugccuaucuucaguuccuacaacgcucagucugaagaacgcagaauaauuaucaggagcuuugggauuaauuccaucaaacuuccaaaagaccggauccacucagagaagaguaacaaaagcguugccauggauaugcugaaugaagugaagcgcugccccgacgaguuguucacaacccucucugcggaaaaacagucccgauuuagaauuauaucagacgaucauaacgagguccugaugaagaggagcagugaccgguucgugccuuuacugcuccaauacaucgauuauggaaaacuuuuugaccacauucguuuccacgugaauauggguaaacugcgcuacuugcuaaaggcagauaaaacguguaucgacggccagacuagagucaggguuauagaacagccacugaacggguuuggacggcucgaggaggccgaaaccaugcgaaagcaggagaauggcacauucgguaacucugggauucgcaucagagauuuugaaaauaugaaaagggacgaugcuaaccccgccaacuauccuuacaucguggacacuuauacccauuacauucuggagaauaacaagguagaaauguucaucaaugauaaggaggacuccgcaccacuucugccggugauugaggacgaucgguaugucgugaaaacaauacccagcugccgcaugucgaccuuggaaaucccugcuauggccuuucacauguuccucuuuggaucuaagaaaacggagaagcugauuguugacgugcauaacagauacaaaagguuauuccaagcgaugcagaaggaagaggucacugccgagaauaucgcauccuucggcaucgcugaaucagaucugccacagaagauucuagaccucauaaguggcaacgcccacgggaaagauguggacgcuuuuauccgucugacaguagaugacaugcuuaccgauacugagcggcgaauuaagagauucaaagacgauaggaaaagcauccgcuccgccgacaauaaaaugggaaagcgggguuuuaaacagauuucuacaggcaaguuggcagauuuccuggccaaggacaucguucucuuucaacccagcgugaacgacggggaaaauaaaauaaccggacugaacuacagaaucaugcagucagcuauugcggucuaugauaguggcgacgauuacgaggcaaagcagcaguucaaacuuauguuugaaaaggccaggcugaucgguaaagggacgaccgagccucacccauucuuguauaagguguuugcucgcuccauucccgccaaugcagucgaguucuacgaacgauaucucaucgagcggaaguuuuaccugacaggcuuaagcaacgaaauaaagaagggaaaucguguggacguuccguucauuagaagggaucaaaacaaauggaagacuccugccaugaaaacccugggccgcaucuauucugaggaccuacccguggaacucccacggcagauguuugauaaugagauuaagucacaucugaagagucuuccucagauggaggggaucgacuucaacaacgcuaauguaacauacuugauagccgaauacaugaaaagaguccuggaugacgauuuccagacuuuuuaucaauggaacaggaauuaccgauauauggacaugcucaagggagaguacgaucgcaaagguagccugcagcacuguuucaccuccguggaggagcgggaaggcuuauggaaggagagagcaucuaggacagagcguuaucgcaaacaggcgucgaacaagauccggagcaauagacaaaugaggaacgcuuccucagaagagauugaaaccauccuggacaagcgacuuaguaauucucggaacgaguaccagaaaagcgagaagguuauucgcagauauagggugcaggacgccuugcucuuucugcuagcaaagaagacucugacggaacucgccgauuucgacggggagcgguuuaaacugaaggaaaucaugcccgaugcugagaaaggaauacuuuccgaaauuaugccaaugucauucacauuugagaagggcgguaagaaauacaccaucacuagcgaggggaugaaguugaaaaauuacggcgacuucuuuguccuggccucugauaagcgaaucggaaacuuacucgaacuggugggcuccgacauuguaaguaaagaggaugggagccuucagcugcccccuuuggaaagacucacccugggaucucaacuacaucugccacaggugcucgcagacgcuguuucccgccugguccuugguaaguucggcgauuugacagacaauuuuucaaguccgcacgccaggcguaaggugcuggcggggguggucaugaccacuggaacagauguuaaagacgccaaggugaucagcgugucgacgggcgguaaaugcauuaacggggaguauauguccgaccggggcuuagcucucaaugauugucaugcagaaauaaucucuagaaggagccugcuucgcuuccuguacacccagcuagagcucuaucugaacaauaaggacgaucagaaacgaucaauuuuccaaaagagugagagaggaggcuuucgguugaaggaaaacguacaguuccaccuguacaucuccacuucucccugcggggacgccaggauuuuuagcccucacgagccaaucuuagaggaacccgcugaucgccauccuaaccguaaagccagaggacagcuccggacaaagauagaauccggccaggguaccaucccagucaggucaaaugcaagcauucaaacaugggacggggugcugcagggagagcgccuucugacuaugaguuguucugauaaaaucgcgcgauggaacguugugggcauucaggguuccuugcucagcaucuucgucgagcccauauauuuuucgucaauuauccugggcucucuauaccacggggaccaucugaguagagccauguaucaacggaucuccaauauugaagaucuuccgccucucuacacccugaacaagccauugcugagcggaauaucuaaugcugaggccaggcagcccggcaaagcaccuaacuucagcgugaauuggacgguuggggacuccgcuaucgaagugauuaacgccaccacaggaaaggaugaguuaggccgcgcaucaagacucugcaagcacgcccuguacuguagguggaugcggguacacgguaaaguccccagucaucuucugcguagcaagaucacuaaaccaaauguguaucacgagucuaaguuggcugcgaaagaauaccaggccgcaaaggcucgccucuuuaccgccuucauuaaggccgggcugggagcuuggguggagaaaccuacagaacaggaccaauuuucccuaacuuga

SEQ ID NO: 11288 - RNA, 2862 nt, Artificial Sequence
  Cas13b variant__Alistipes sp.__WP_047447901.1__Cas13b
augagcaacgagaucggcgccuucagagaacaccaguuugcuuacgcacccgggaaugagaagcaagaagaggccaccuucgcgacauauuuuaaccuggcucucuccaauguggaaggaaugauguucggugaggucgagucuaacccugacaaaauugaaaagucacuugauacucugccaccggccauauugaggcagaucgcaaguuuuauuugguuaagcaaagaggaccaucccgauaaggccuacuccacggaagagguuaaagugaucguaaccgaccuggugcggcgccuaugcuucuaucgaaauuacuuuucucacuguuucuaucucgauacacaguacuuuuauucggacgagcuggucgauacuaccgcuauuggcgaaaagcugccuuacaacuuccaucacuuuaucacaaaucgucuguucagauacucauugccagagauaacccucuuuagguggaacgaaggggagcggaaguaugaaauccugcgcgacggacugauuuucuucugcugucucuuuuuaaaaagaggccaggcagagagguuccugaaugagcuucgguuuuucaagcgcacugaugaagagggucgaaucaaaagaacaauuuuuaccaaguacugcacgagggaaagccauaaacacaucgggauagaggaacaagacuucuugauuuuucaggauaucauuggagaccugaaccgggugcccaagguuugugauggcguggucgaccuaaguaaggagaaugagcguuauaucaaaaaccgcgaaacuuccaaugagucugacgaaaacaaggccagauacaggcuccugauccgggagaaagauaaguucccuuauuaccuuaugcgauauauuguggacuuuggcguacugccaugcauaaccuucaaacagaaugauuacagcacaaaggaagggcgcggacaguuucacuaccaagacgcugccguugcgcaggaggagagauguuauaacuucguggucaggaacgguaauguguacuauuccuacaugccccaggcacagaacgugguccggaucucagaauugcaaggcacuauuaguguugaggaacuccgcaauaugguguaugccagcaucaacgggaaagauguaaauaagucuguggagcaguaccuguaucauuuacaccuucucuacgagaagauacuuaccauuuccggacagacaaucaaagaaggcagagucgacguggaggauuacaggccucuguuggacaagcuacugcuccguccagcuucaaacggugaagaacugcggcgagaacuuagaaaacuguugccgaagaggguuugcgaucuccugagcaaucgcuuugacuguagugagggggugucugccgucgagaaacgguuaaaggcaauccugcuaagacaugaacaacuccugcuuucccagaaccccgcuuugcacauugauaagaucaaaagcgugauugacuaucuguaccucuucuucucggacgaugagaaguuuaggcagcagccuaccgaaaaagcccaccgcggacugaaggacgaggaguuccaaauguaucauuaccuuguaggcgauuaugacucucacccacuggcguuguggaaagagcucgaggccuccggccgacugaagcccgaaaugcggaaguuaacgucagcaacaagucugcaugggcuauacaugcucugccugaaaggaacuguugaguggugucguaagcagcuuaugagcauagguaaaggcaccgcuaagguggaagccaucgcugauagagucggguugaaacuguaugacaagcucaaggaguacacuccugaacagcuggagagggaggugaaauuagucgugaugcacggauacgccgcagccgcuacaccaaagcccaaagcgcaggcagccauuccguccaagcugaccgaacuucgcuuuuauucuuucuugggcaaacgggagaugagcuuugcugccuucaucagacaagauaagaaagcacagaagcucuggcugaggaauuuuuacacgguugaaaacaucaagacccuacagaaacgacaggccgcugccgacgcagcgugcaagaaacuguauaaucucgugggugagguagagcgcguccauacaaacgauaaggugcugguucuuguggcucaacgguacagagaaagguugcugaaugucgggucaaaaugcgccgugacuuuagacaacccugagcgucagcagaagcucgcagauguauaugaagugcagaaugccuggcugaguauucgcuucgacgaucuugacuuuacccugacacacguuaacuuguccaaccuccggaaggcuuacaaucugauacccagaaaacacauccuagccuucaaggaguaucuggacaacagggucaaacaaaagcucugugaagagugccgaaaugugcggcgcaaagaggaucuguguacuugcuguagcccaagauacucuaaccuuaccucaugguugaaggaaaaucauagugagagcuccauugaaagggaggcagcuacaaugaugcuguuagacguggaacggaagcuccugucuuuucuucuggaugagcgaagaaaagccaucauugaguacggcaaguucaucccuuuuucggcgcuagucaaagaaugccgccucgccgacgcuggacuguguggcauaaggaacgauguuuugcacgacaaugugaucagcuaugcagaugccauugggaagcuguccgcuuacuuccccaaagaggccucagaagcaguggaguauauccgucggaccaaggaaguaagagagcagaggcgcgaggaauuaauggcgaacaguucucaguga

SEQ ID NO: 11289 - RNA, 3348 nt, Artificial Sequence
  Cas13b variant__Bacteroides pyogenes__ERI81700.1__Cas13b
auggagagcaucaagaacucccagaaaucuaccggcaagacacugcaaaaagaucccccuuacuucgggcucuaucuuaauauggcccuguugaacgugagaaaggucgaaaaucacauuaggaaaugguuaggagacguugcucugcuaccagagaagucagguuuucauagucuccugacuacggacaaccuuagcuccgcaaaguggacccgguucuacuauaaaucucgcaaguuucugccguucuuggaaauguuugauucggacaaaaagucauacgagaaucgacgugaaacaacugagugccucgauaccauagacagacagaaaaucagcagucugcugaaggagguguauggcaagcuccaggauauuaggaacgccuucucccacuaccauaucgacgaucagucuguaaaacacacagcguuaauuaucagcuccgaaaugcaucgguuuauagagaaugcuuauucauucgcccugcaaaagacccgcgcaagauuuacugggguguucgucgaaacagacuuucuucaggccgaggagaaaggagauaacaagaaauucuuugcuaucggcgguaaugaagggauuaaguugaaagacaacgcacugaucuuccuaauuugucucuuccuggauagggaggaagccuuuaaguuccuuagucgggcuaccggauuuaagagcacgaaagagaagggcuuccuggccgugcgcgaaacuuuuugcgcguuguguugccgacagccccacgagagacuccugucuguuaauccuagggaggcauuacugauggacaugcucaacgaacuuaaucgguguccagacauccuguucgagauguuggaugaaaaagaccagaaguccuuucuaccccugcucggcgaggaagaacaagcccacauacuggagaacucacuuaaugaugaacugugcgaggcuauugacgauccuuucgaaaugaucgccagcuugaguaaacgugugcgcuacaagaacagauuuccauaccucaugcugagguauauugaggaaaagaacuuacugcccuucauccgguuucgaaucgaccuagggugucucgagcuggcaucuuacccuaaaaagaugggagaggaaaauaacuaugagcgcuccgucaccgaucaugcuauggccuucgguagacuuacagacuuucacaaugaagaugcgguguugcagcagauuacuaaaggcauaaccgacgagguaagguucagccuguacgccccacgguaugcaaucuacaacaauaagauuggguucguucgcacaggaggcucggauaaaaucucuuuuccgacccucaagaagaaagguggggagggacauugcguggcuuauacgcugcagaacacuaaguccuucggcuuuauaucaauuuacgaccuuagaaaaauccuguugcucaguuuccuggacaaggauaaagccaagaauaucgucagcggcuuacuggaacaaugugagaagcacuggaaagaccuauccgaaaaccucuuugaugcuauuaggacagagcugcagaaggaguuccccgugccucuuauccguuacaccuugccacggucuaaagggggaaagcuggugagcucaaaacucgccgacaagcaggagaaauaugagagugaauuugagcgaagaaaggaaaagcugacugagauuuuauccgaaaaagauuucgaccugagccaaauacccaggcgcaugaucgaugaguggcuuaaugucuugccuacaucucgggagaagaaacucaaggguuacguugaaacccugaaacuagacugcagagagaggcugcgcguguuugaaaagcgagagaagggcgaacacccaguacccccgcggauuggggagauggcaacggaucucgccaaagacaucauccguauggugauugaucagggagucaagcagagaauaaccucagcuuauuacagugagauccagaggugucuggcgcaauaugcaggcgacgauaaccgccggcaucuugacagcauuaucagagaauugaggcugaaagacacaaagaauggucacccuuucuuagggaaagugcuccgacccggccugggacauacugagaaacuuuaccagcgcuauuuugaagagaagaaagaguggcuggaagccaccuucuacccagcugccuccccuaagcggguucccagauuugugaacccacccacaggcaaacagaaggaguugccucucauuaucaggaaucugaugaaagaacguccagaguggcgcgauuggaagcagcggaagaacucucacccgauagaccuacccucgcaacuguucgaaaaugagaucugcagacuccugaaagauaagauugggaaagagccuagcggaaaacuuaaauggaacgaaauguucaaguuguacugggacaaagaguuuccaaacgguaugcagagguucuaucgaugcaagcggcgcgucgaaguguuugauaagguaguugaguacgaauauuccgaggagggcgggaauuacaaaaaguauuacgaagcacugaucgacgagguggucagacagaaaauuucaaguucuaaggaaaagagcaaguuacagguggaggaucucacucuguccgucaggcggguguucaagcgagccaucaacgaaaaagaguaucaacuuagacugcuaugugaggacgaucgccuccuguuuauggcuguuagggacuuguacgauuggaaggaagcccagcuggacuuagauaaaauagacaauaugcucggagagcccgugucaguaagccaggucauucagcuggaaggcggucaaccugacgcagugaucaaggcggagugcaaacuuaaggauguuucuaagcugaugcguuacuguuaugacgggcgggugaaaggcuugaugccauacuucgcuaaccaugaggccacccaggaacaggucgagauggaacucagacacuaugaggaucacaggcgccgaguguuuaauuggguauucgcacuggaaaaguccgugcuaaagaacgagaagcugagacgguuuuacgaggaaagucaaggaggcugcgagcauaggcgcuguauugacgcccuucguaaagcuagccucguuucugaagaggaauaugaguuccugguccacaucagaaauaaguccgcccauaaccaguuucccgauuuggagauagggaagcugccgccuaaugugacaucaggauucugcgaauguaucuggaguaaauacaaggcaauuaucugccggauuaucccauucauagaccccgagaggcgcuuuuucgguaaauuacucgaacagaaguga

SEQ ID NO: 11290 - RNA, 3348 nt, Artificial Sequence
  Cas13b variant__Bacteroides pyogenes__WP_034542281.1__Cas13b
auggagagcaucaagaacucccagaaaucuaccggcaagacacugcaaaaagaucccccuuacuucgggcucuaucuuaauauggcccuguugaacgugagaaaggucgaaaaucacauuaggaaaugguuaggagacguugcucugcuaccagagaagucagguuuucauagucuccugacuacggacaaccuuagcuccgcaaaguggacccgguucuacuauaaaucucgcaaguuucugccguucuuggaaauguuugauucggacaaaaagucauacgagaaucgacgugaaacagccgagugccucgauacuauagacagacagaaaaucagcagucugcugaaggagguguauggcaagcuccaggauauuaggaacgcguucucccacuaccauaucgacgaucagucuguaaaacacaccgcuuuaauuaucagcuccgaaaugcaucgguuuauagagaaugccuauucauucgcacugcaaaagacacgcgccagauuuaccgggguguucgucgaaacugacuuucuucaggcugaggagaaaggagauaacaagaaauucuuugcaaucggcgguaaugaagggauuaaguugaaagacaacgcccugaucuuccuaauuugucucuuccuggauagggaggaagcauuuaaguuccuuagucgggccacaggauuuaagagcaccaaagagaagggcuuccuggcggugcgcgaaacguuuugcgcauuguguugccgacagccccacgagagacuccugucuguuaauccuagggaggccuuacugauggacaugcucaacgaacuuaaucgguguccagacauccuguucgagauguuggaugaaaaagaccagaaguccuuucuaccccugcucggcgaggaagaacaagcucacauacuggagaacucacuuaaugaugaacugugcgaggccauugacgauccuuucgaaaugaucgcuagcuugaguaaacgugugcgcuacaagaacagauuuccauaccucaugcugagguauauugaggaaaagaacuuacugcccuucauccgguuucgaaucgaccuagggugucucgagcuggcuucuuacccuaaaaagaugggagaggaaaauaacuaugagcgcuccgucacugaucaugccauggcguucgguagacuuaccgacuuucacaaugaagaugccguguugcagcagauuacaaaaggcauaacugacgagguaagguucagccuguacgcaccacgguaugcuaucuacaacaauaagauuggguucguucgcaccucgggaucugauaaaaucuccuuuccgacacucaagaagaaaggcggugaggggcauugcguggccuauacccugcagaacacgaagucauucggauuuauaaguauuuacgaccuuagaaaaauccuguugcucagcuuccuggacaaggauaaagcuaagaauaucgucuccggcuuacuggaacaaugugagaagcacuggaaagaccuaucugaaaaccucuuugaugccauuaggacugagcugcagaaggaguuccccgugccucuuauccguuacacauugccacggagcaaaggcgggaagcuggugucaaguaaacucgcagacaagcaggagaaauaugaguccgaauuugagcgaagaaaggaaaagcugaccgagauuuuaagcgaaaaagauuucgaccugucucaaauacccaggcgcaugaucgaugaguggcuuaaugucuugccuacuucacgggagaagaaacucaagggauacguugaaacacugaaacuagacugcagagagaggcugcgcguguuugaaaagcgagagaagggugaacacccacuucccccgcggauuggcgagauggccaccgaucuggcuaaagacaucauccguaugguaauugaucagggggugaagcagagaauaacgagugcguauuacagcgagauccagaggugucuugcacaauaugccggagacgauaaccgccggcauuuggacuccauuaucagagaacugagguuaaaagacaccaagaauggccacccuuuccucgguaaaguccugcgacccgggcuuggccauacagagaagcuguaccagcgcuauuuugaagagaagaaagagugguuggaagcuacuuucuacccagccgcaucuccuaagcgggugcccagauuuguuaacccacccaccggaaaacagaaggagcucccucugauuaucaggaaucuaaugaaagaacguccagaguggcgcgauuggaagcagcggaagaacucgcacccgauagaccugcccagccaacucuucgaaaaugagaucugcagacugcuuaaagauaagauuggcaaagagccuuccgggaaguugaaauggaacgaaauguucaagcuguacugggacaaagaguuuccaaacggaaugcagagguucuaucgaugcaagcggcgcguggaagucuuugauaaggugguagaguacgaauauucagaggaggguggcaauuacaaaaaguauuacgaagccuuaaucgacgagguugugagacagaaaauuaguucuagcaaggaaaaauccaagcuccaggucgaggaucugacacuuucagugaggcgggucuucaagcgagcuaucaacgaaaaagaguaucaacugagacuacucugugaggacgaucgccuguuguuuauggccgugagggaccuguacgauuggaaggaagcacaguuagaccucgauaaaauagacaauaugcugggggagcccguuagcgugucucagguaauucagcuugaaggaggccaaccugacgcggucaucaaggcugagugcaaacugaaggauguguccaaguugaugcguuacuguuaugacggucggguuaaagggcucaugccauacuucgccaaccaugaggcaacucaggaacagguggagauggaacugagacacuaugaggaucacaggcgccgagucuuuaauuggguguucgcccuagaaaagaguguacugaaaaacgagaagcucagacgguuuuacgaggaaagccaaggcggaugcgagcauaggcgcuguauugacgcucuccguaaagccucucugguguccgaagaggaauaugaguucuugguucacaucagaaauaagucagcacauaaccaguuucccgaucuggagauaggcaaguuaccgccuaaugucaccaguggguucugcgaauguaucuggagcaaauacaaggcuauuaucugccggauuaucccauucauagaccccgagaggcgcuuuuucggaaaacuccuggaacagaaguga

SEQ ID NO: 11291 - RNA, 3675 nt, Artificial Sequence; identical to SEQ ID NO: 11282
  Cas13b variant__Bergeyella zoohelcum__WP_002664492.1__Cas13b

SEQ ID NO: 11292 - RNA, 3600 nt, Artificial Sequence
  Cas13b variant__Capnocytophaga canimorsus__WP_013997271.1__Cas13b
augaagaacauccagagacugggcaaagggaaugaguucagccccuuuaagaaagaagacaaguucuacuuuggagguuuccucaaccuugccaauaacaauauugaggacuuuuucaaagaaauaaucaccagguuuggcauugugaucacagaugagaacaagaagccuaaagaaacuuucggggagaagauucugaaugagaucuuuaaaaaggauauauccaucgucgacuaugaaaaauggguuaacauuuucgcugauuacuuuccauucacgaaguauuugucuuuauaccuggaggaaaugcaauuuaagaaucgggugaucugcuuccgcgacguaaugaaagagcuacucaagaccguggaggcacugcgaaacuucuauacacacuacgaucaugaaccgauuaaaaucgaggaccgugucuuuuauuuccuugauaaggugcuguuggacguuucacucacugugaaaaauaaguaccugaaaaccgauaagacaaaggaauuucugaaccagcacauaggagaggaacucaaagaguuauguaagcagagaaaagacuaccuggucggcaaggguaaaaggauugauaaggagagugaaaucauuaaugggaucuauaacaaugccuucaaggacuuuaucugcaaacgggagaagcaggacgauaaagaaaaccauaacagcguggagaagauucuuuguaauaaagaaccccaaaacaagaagcagaaauccucugcgaccguaugggaguugugcucgaagucaagcaguaaauacacugagaaguccuucccuaaucgcgaaaacgacaaacacugucuggagguuccaauaucucagaagggaaucguguuucuacucagcuucuuucugaauaagggcgaaauuuaugcucuuacauccaacaucaaaggcuucaaggccaaaauaaccaaggaggaacccgucacguacgauaaaaauucaauuagauauauggcaacucauaggauguuuaguuuccuggccuacaagggguugaaacggaagauccgcaccagcgagaucaacuauaaugaggacggacaggcuucuuccacauacgaaaaggagacucucaugcugcaaauguuagaugaacugaacaaagugccugacguggucuaccagaaucucucagaggauguucagaagaccuuuauugaggacuggaacgaauaucuuaaagagaauaacggugaugugggcacaauggaagaggaacagguaauccacccagugauucgaaagagauacgaggacaaauucaauuauuucgcaauaagguuucuggaugaguucgcccaauuucccaccuugcgguuccagguccaccuagggaacuaccugugcgacaagcguacgaagcagaucugugacacuacaaccgaacgcgaggugaaaaagaaaauuacuguuuuuggaagacucagcgaacuggagaacaagaaagcuaucuuccuuaaugaaagggaggagaucaagggcugggaaguguuuccuaacccaaguuaugauuucccgaaggagaauauuucugucaacuacaaagacuuucccauaguggguuccauccuggaucgggaaaagcaaccuguaagcaauaaaauugggauccgaguuaagauugccgacgaguugcagcgcgaaaucgauaaagcgauaaaggagaagaaacucagaaacccaaagaauaggaaagcaaaccaggacgagaagcagaaagaacggcuggugaaugagaucgucucgacaaacucuaaugaacaaggagagcccguggucuucauuggccagccuaccgccuauuuauccaugaacgauauccauucagugcuguacgaguuucuaauuaauaagaucaguggcgaagcucucgagacgaaaauaguugaaaagauugagacccagaucaagcagauuaucgggaaagacgccacaacuaagauacugaaaccauacaccaacgcaaauagcaacuccaucaaccgcgaaaaacuuuugagagaucuggagcaagagcagcagauucucaagacacugcuugaagaacagcaacagagggaaaaggacaagaaagauaagaaaucuaagcguaaacacgagcuguaucccagcgaaaagggaaagguggcuguaugguuggccaaugacaucaaacgguucaugccgaaggcguuuaaagagcaguggcgagguuaccaucacucacuccugcagaaguauuuagccuacuaugagcaaaguaaagaggagcugaagaaccuacucccuaaggaagucuucaaacacuuccccuuuaagcugaaaggcuacuuccagcagcaauaucuuaaucaguuuuacacugauuacuugaagagaaggcuguccuaugugaacgagcuccuguuaaauauucagaacuucaaaaaugacaaggacgcacugaaggcuaccgaaaaagagugcuuuaaguucuuucgcaaacagaacuacaucauaaauccaauuaacauccaaauccagagcauucuuguuuauccuaucuucuugaagcggggguuucucgaugagaaacccacaaugauugacagagaaaaguucaaagagaauaaggauaccgaacuggccgacugguuuaugcauuacaagaacuauaaagaggauaauuaccagaaguucuaugcuuacccacuagagaaaguggaagagaaggaaaaauucaagaggaacaagcagauaaauaaacaaaagaaaaacgacgucuacacucugaugaugguggaguauaucauucagaagaucuuuggagauaaauucguagaagagaacccccucgugcugaagggcauuuuucagucuaaggccgagcgccagcaaaauaacacgcacgcagccacaacccaggaacgaaaucuuaacgguaucuugaaucagccuaaagacauaaagauccaagggaaaauuacuguuaagggcgucaaacugaaggauaucggaaacuuccggaaguacgagauugaccagcgugugaauaccuuuuuagauuaugaaccaagaaaagaguggauggcuuaccucccgaacgacuggaaggaaaaagagaagcagggccagcugcccccuaauaacgugaucgauaggcaaauaucaaaauaugagacaguccgcaguaagauucuucugaaagacguucaggaauuggagaagaucaucagcgacgaaauuaaggaggaacaucggcacgaucucaaacaggggaaguacuauaauuucaaauacuacauacugaacggacuacugagacagcucaagaaugagaacguggagaauuauaaaguguuuaagcugaacaccaauccagaaaagguaaacaucacucaacuuaaacaggaggcgacagacuuggaacagaaggcauucguccugacguacauuaggaacaaauuugcccauaaucaguuacccaagaaagaguucugggauuauugucaagagaaguacgguaagaucgaaaaagagaagaccuaugcugaauacuuugccgagguguucaaacgagaaaaggaggcacucauuaaauga

SEQ ID NO: 11293 - RNA, 3657 nt, Artificial Sequence
  Cas13b variant__Capnocytophaga cynodegmi__WP_041989581.1__Cas13b
auggagaacaagaccagccugggcaauaacaucuacuauaaucccuucaaaccucaggacaaguccuacuuugccggguaucucaacgcugcaauggaaaauauugauucuguguucagagagcuuggaaaaaggcugaaggguaaagaauacacaucagagaacuuuuucgacgccauauuuaaggaaaauaucaguuuggucgaguaugagcgguacguuaaguuacugagcgauuauuucccaauggcgcgccuacucgacaaaaaggaagugccgauuaaagagcgaaaggaaaacuuuaaaaagaauuuccguggcaucauuaaggcuguaagagaucugaggaacuuuuacacucacaaagagcauggggagguggaaaucacggacgagauauucggaguccuugaugaaaugcugaaguccaccguguugacaguuaaaaagaaaaagaucaaaacugacaagaccaaggagauucucaaaaagucuaucgaaaaacaacuggauauucugugccagaagaaacucgaguacuuaaaggacacagcccggaagaucgaggaaaaacgcagaaaucagagggagcggggcgaaaagaaacuggugccccgcuuugaguauucggaucgaagagacgaucuuauagcagccauuuacaacgacgcuuucgacgucuauaucgauaagaaaaaggacucauugaaggaaagcaguaaaaccaaguacaauacugaguccuauccucagcaagaggaaggugaucugaaaauuccaaucucuaagaacggggugguauuucuacucagccuguuccuuuccaaacaggagguucacgcauucaagucaaagaucgccggauuuaaagcuacagugauugacgaagccaccgucagucauaggaagaauagcauauguuucauggcgacgcacgagaucuuuucucaucuggcauacaaaaaguugaaacggaaggugcguacugccgaaauuaacuauuccgaggcugagaacgccgaacagcucucaaucuacgcaaaagagacccugaugaugcagauguuagaugaacugagcaaggugcccgacgucguuuaccaaaaucucagugaggaugugcagaagacauucauagaggacuggaacgaauaucuuaaagagaauaacggcgauguaggcacuauggaagaggaacaggugauucacccugucauccgcaagagauacgaggacaaauuuaauuauuucgcuaucagguuucuggaugaguucgcccaguuuccaaccuugcgguuccaagugcaccuagggaacuaccugcaugacucucgacccaaggaacaccucauuuccgaccgcagaaucaaagagaagauuacaguuuuuggaaggcugagcgaacuugagcauaagaaagcgcuguucauaaagaauaccgaaacgaacgaggaucggaaacacuauugggagguguuuccuaauccaaacuacgacuucccgaaggaaaauaucucggucaacgauaaagacuuccccauugccgguucuaucuuggaucgcgagaagcagccuacugcaggcaagaucgggauuaaagugaaucuccugaaccagaaguauauauccgaaguagacaaagcuguuaaggcccaccaauuaaaacagagaaauaacaagccaucaauccagaacauuaucgaggaaauugugcccaucaauggaaguaacccuaaggagauaaucgucuuuggcggucagccaacagcuuaccugagcaugaaugauauucauuccauccuauacgaguucuuugacaaaugggaaaagaaaaaggagaaacucgaaaagaaaggggagaaggagcugaggaaggaaauuggaaaagagcuugaagagaagaucgugggcaaaauacaaacccagauucagcagaucauugauaaggacaucaacgccaaaauauugaagcccuaucaagaugacgauucuacugcaaucgacaaggaaaaacugauuaaggaccucaaacaggagcagaagauccugcagaaacuuaagaaugagcaaacagcccgugaaaaggaguaccaggaaugcauugcuuaucaggaggaaagccggaaaaucaagcgaucagauaaaaguagacagaaguaccugaggaaccaauugaaacgcaaguauccggaggucccuacccggaaggagauacucuacuaucaggaaaaaggcaagguggcgguuuggcuggcaaaugacauuaaaagauucaugcccacggauuuuaagaacgaguggaaaggggaacagcacuccuuacugcaaaagagccuagccuacuacgagcaguguaaggaagaacucaaaaaucugcuuccacagcagaagguguucaaacauuugccuuuugagcugggaggucacuuccaacagaaguaucucuaccaguuuuauaccagguaccuggacaaacgcuuagaacauaucucuggccugguacagcaagcugagaacuucaagaaugaaaacaaagucuuuaagaagguggagaaugagugcuucaaauuucuuaagaaacagaacuauacacacaagggguuggaugcccaggcacagucaguucucggauaccccaucuuccuggaacgaggcuucauggacgagaaaccaacuauuaucaaggguaagaccuuuaaagggaaugaaagucuauucacagauugguuucgguauuacaaggaguaccaaaacuuccagacuuuuuaugacaccgaaaacuacccccugguggagcucgagaaaaagcaggccgaucguaaaagagaaacaaagauuuaucaacagaagaaaaaugacgucuucacccugcuuauggcuaagcacauauuuaaaagcguguucaagcaggauuccaucgacagguuuucuuuggaggaucuguaccagucgcgcgaggagcgguuagaaaaccaagagaaagccaagcagacuggcgagagaaauacgaacuauauuuggaauaagacaguagaccucaaccugugugacggaaaagugaccguugaaaaugucaaacuuaagaacgugggcaauuucaucaaguacgaguaugaucagagggugcagacuuuucugaaauacgaagagaacauuaaguggcaagcauucuugaucaaagaaagcaaggaggaggaaaauuacccuuauauagucgagcgagaaaucgagcaguacgagaagguucgccgggaggaacuccugaaagaagugcaucuaauugaggaauauauccuggagaaggugaaagacaaggagauucucaaaaagggggauaaccagaauuucaaguacuauauccugaacggacuuuugaaacagcugaagaaugaagacguagaguccuacaaagucuuuaacuuaaacaccaagccagaagaugugaauauaaaccaacucaaacaggaggcgacagaccuggaacagaaggcuuucguucuuaccuauauuagaaauaaguuugcccacaaccagcugccgaaaaaggaguucugggauuacugccaagagaaauacgguaagaucgaaaaagagaagacuuaugcagaauacuuugccgagguguucaagagggaaaaagaggcucuaaugaaguga

SEQ ID NO: 11294 - RNA, 3438 nt, Artificial Sequence
  Cas13b variant__Chryseobacterium sp.__WP_047431796.1__Cas13b
auggagacccagacaaucggccacgggauugccuacgaccauagcaagauacaagauaaacacuucuuuggagguuuccugaaccucgcugaaaauaacaucaaggcagugcuuaaagccuuuuccgagaaguucaaugucggcaacguugacgugaaacaguuugcggauguaucucugaaggacaauuugcccgauaacgacuuccagaagagagugucauuuuuaaaaauguauuucccugucguggauuuuauuaauaucccaaacaauagggcuaaguuccggagugaccugacuacgcuauuuaaaagcguugaucagcuccgcaacuucuacacccauuauuaccacaagccgcuggacuuugaugccucccuuuucauucuguuggacgauaucuucgcacgaacagccaaagaagugcgugaccaaaagaugaaggacgauaaaacuagacagcuccugucuaagucgcugucagaggaacuccagaaaggguaugaguuacagcuggagaggcuuaaggaauugaaucggcugggaaagaaggucaacauacaugaccaacuaggcaucaaaaauggugugcucaacaaugcuuuuaaccaccugauuuacaaggauggggagagcuucaagaccaaacuuacauauaguuccgcacugaccucuuuugaaagcgccgagaacggaaucgagauuucccagucaggccucuuguuccuguuaaguauguuucugaagcgcaaagaaaucgaggaccucaagaauagaaacaaaggcuucaaggcuaagguaguuauagaugaagacgggaaagugaauggacuuaaguuuauggccacucacugggucuucagcuaccugugcuuuaaagguuugaagucuaaacuauccacagaguuccaugaagagacccugcucauucagaucauugaugagcugucaaaggugcccgacgaacuuuacugugcguuugauaaggagacgagggacaaauucaucgaagauaucaacgaguaugugaaggaaggccaccaggacuuuagccuggaggacgcaaaagucauucauccuguuauacggaagcgcuacgagaauaaauucaacuauuucgccauccgauuuuuggaugaguucgugaaguuuccaagucucagauuccaaguacacguggggaauuacguccacgacaggcggauuaagaacaucgauggaacuaccuuugaaacagaacgugugguuaaagaccgcauaaagguguucggcagacugucugagauuuccagcuauaaagcucaguacuuaucgucugucuccgauaagcaugacgaaacugguugggagaucuuucccaauccuucauauguguucaucaacaauaacauuccaauccacauuaguguagauaccagcuuuaaaaaggagauagccgacuucaaaaagcugaggcgggcacagguucccgaugaacuaaagauccgaggggcugagaaaaagcgcaaauuugaaauuacacaaaugaucggauccaagucugugcucaaucaggaggagccuaucgcccugcuuagcuugaacgaaauuccagcgcugcucuacgagauacugaucaauggcaaagaaccggccgagauugaaagaaucauuaaggacaaacuuaacgagaggcaggaugucaucaaaaacuacaaucccgagaacuggcugccugcaucacagauaagucggcgcuugagauccaauaagggcgaaaggaucauuaacaccgacaaacuccugcaauuagugacgaaggagcugcuagucacugaacagaaacucaagaucauuagcgauaaucgugaggcucugaagcagaaaaaggaagggaaauauauccggaaguucauauuuacaaacucugagcuuggacgagaggccauuugguuggcugacgacaucaaaagauucaugccagccgaugugaggaaggaauggaaggguuaccagcauucacaacugcagcagagucucgcauucuauaauagccgccccaaagaggcccuggcuauuuuagaauccucuuggaaccugaaggacgagaaaaucauauggaaugaauggauccuuaagucguuuacccagaacaaauucuuugaugcguucuacaaugaguauuugaagggccggaaaaaguacuuugcauuccucagcgagcacauuguucaauauacuuccaacgccaagaaucugcagaaauuuaucaagcagcagaugccuaaagaccuauucgaaaagagacauuacauuaucgaggaucugcaaacagagaaaaacaagauacucucaaagccauuuauuuuccccagggggaucuuugacaaaaagccgaccuucaucaaaggagugaagguagaagauaguccugagucuuucgcuaauugguaccaguauggcuaccagaaagaccaccaauuucagaaguucuaugauuggaagcgcgacuacagcgaugucuuucuggaacaccuugguaaacccuucauuaacaacggggaccgacggacguugggcauggaggaacugaaggagcguaucauuauaaaacaggauuuaaagaucaaaaagauuaagauccaggaccucuuucugagacuuauugccgaaaaucuguuccaaaaaguguuuaaguauuccgcaaaauugccacucucagacuucuaccugacccaggaggagaggauggaaaaggagaacauggccgcucuacagaauguucgcgaagagggagauaaaagcccuaacaucauaaaggacaauuuuaucuggucuaagaugauucccuauaaaaagggccagaucauugaaaacgccgugaaacugaaggauaucgggaaacucaauguccugucccuugacgauaaggugcaaacauugcugaguuacgacgaugcaaaaccauggagcaagauagcguuagagaacgaguucucuauuggagaaaauuccuacgagguaauccggagagaaaagcucuuuaaagagauccagcaguucgaaucagagauucuguuuaggagugguugggacggcauaaaccaucccgcucagcuugaggauaaucgaaacccuaaguucaaaauguauaucgugaaugggauucugcgcaagagcgccggacuauacucgcaaggcgaagacaucugguucgaguauaacgcagauuuuaauaaccucgacgccgacguucuggaaacuaaauccgaguugguccagcuggcuuucuuagugaccgccauucggaacaaguuugcacacaaucagcucccagcuaaggaguucuacuuuuauaucagagccaaauacgguuucgcggaugaaccgucuguggcccuggucuaucuuaacuuuacaaaguacgcuauaaaugaguucaaaaagguuaugaucuga

SEQ ID NO: 11295 - RNA, 3453 nt, Artificial Sequence
  Cas13b variant__Flavobacterium branchiophilum__WP_014084666.1__Cas13b
auggagaaccugaauaagauccucgacaaagaaaacgagauuugcauaagcaagaucuucaauaccaaaggcauugccgcucccaucacagaaaaggcacuugauaacauuaaauccaagcagaagaaugaccugaacaaagaggccagauugcacuacuuuucuaucgggcauucauucaagcaaauagauacuaaaaagguguuugacuaugucuuaaucgaggaacugaaagaugagaagccucuaaaguucauuacgcuccagaaagacuuuuucaccaaggaauuuaguaucaaacugcagaaacuuauuaauagcaucaggaacauaaauaaccacuacguucauaauuucaacgauauuaaucugaacaaaaucgacuccaauguguuucacuucuugaaggagucuuuugaacucgcgauuaucgagaaauauuacaagguaaacaagaaauauccacuggauaacgagaucgugcuguuccucaaggaauuauuuauuaaagacgagaauacagcucugcuuaacuacuucacuaauuugucgaaggaugaagccauagaguauauccugaccuucacaauuaccgaaaacaaaaucuggaauauaaacaaugagcauaacauucuaaauaucgagaagggaaaguaccucacuuuugaagcaaugcuguuccuuaucacaauuuuucuguacaaaaacgaggccaaucacuugcucccgaagcuguaugacuucaaaaacaauaagucaaaacaggaauuauuuaccuucuuuagcaagaaguucacgagucaagauaucgacgcugaggaaggucaccugauuaaauuucgggacaugauacaguaccucaaccauuaucccacugcauggaauaacgaucuuaagcuggaguccgagaacaaaaauaagaucaugaccacaaaauugauugacucuaucaucgaguucgaacuaaacagcaauuacccuuccuuugccacugauauucaguucaagaaggaagcuaaagccuuucuguucgcgucaaacaagaaacgcaaucagaccaguuucagcaacaagucuuauaaugaggaaauacgacacaacccacauaucaaacaauaccgugacgagauugcauccgcccucacacccaucucauuuaaugucaaggaggauaaauucaagauuuuugugaagaaacacguucuggaagaguauuucccuaacagcaucggcuacgaaaaguuucuugaguacaaugacuucaccgagaaagaaaaggaggauuuugggcugaaauuguauaguaacccaaagacgaauaagcucauagaaagaaucgacaaccacaaacuggugaagucucauggaaggaaucaggaucgguucauggacuuuuccaugcgcuucuuagcugagaacaacuacuuuggcaaagaugccuucuuuaaguguuauaaauucuacgacacucaggaacaggacgaguuccugcaaagcaaugagaacaaugaugacgucaaguuucacaaggguaaagugacaaccuauauuaaguacgaggaacaucuaaagaacuauucguacugggauugccccuucguagaagagaauaacucuauguccguuaagaucucaauugggagugaagagaaaauccucaagauacagagaaaucugaugauuuacuuucuugagaacgcauuguauaaugaaaacguggagaaucagggauacaagcuggucaacaauuauuacagggaacucaaaaaggacguggaggaaagcaucgcuucccuggaucuuauuaaaucuaacccugacuucaagagcaaauauaagaaaauccugccaaagcgguugcuccacaauuacgccccggcgaagcaagauaaagcccccgagaacgcauuugagacucuguuaaagaaagcugacuuccgcgaggaacaguauaagaaacugcuaaagaaggccgaacaugagaaaaacaaggaggauuuugugaaacgaaauaagggcaaacaguucaagcuccacuuuauaagaaaggcuugucagaugauguacuucaaagaaaaguacaacacacugaaagagggcaaugccgcauuugaaaagaaagacccugucaucgagaagaggaagaacaaagaacacgaguucgggcaucacaagaaucuuaacauuacccgggaggaguucaaugauuauugcaaauggauguuugccuucaacggaaaugacucauacaagaaauauuugcgugaucuguuuagugaaaagcauuucuuugacaaccaagaauacaagaaucucuucgaguccagcguuaaccuggaggcuuuuuaugcgaaaacgaaggaauuauucaaaaaguggaucgagaccaauaaaccaacaaacaaugaaaaccgcuacacucuggagaauuauaagaaccuuauuuugcagaaacagguguuuaucaacguauaccacuucucuaaguaccucauagacaagaaucugcuaaacucagaaaauaacgugauucaguauaaaagucuggagaaugucgaauaccucaucagcgauuuuuauuuccaauccaagcugucuaucgaccaguacaaaaccugugguaaacuuuuuaacaaauugaagucgaauaagcuggaggauugcuuacucuaugagauugcauacaacuauaucgacaaaaagaaugugcacaaaauugauauacagaagauccugacaagcaaaauuauccuuacuauuaacgacgccaauacccccuacaagaucuccguuccuuucaacaagcuggaaagauacacagagaugauagcuaucaaaaaucagaacaauuugaaggccagguuccucauugaucugccacuauaucugucaaagaacaagaucaaaaagggcaaggacagugcaggguacgaaauuaucauuaaaaacgaucucgagauagaggacaucaauaccaucaacaauaagauuauaaacgauucugugaaauuuacugaaguccugauggagcuugaaaaguauuucaucuugaaagacaaguguauucugagcaaaaauuacaucgauaacuccgagauucccucauuaaagcaauuuagcaagguguggaucaaagaaaaugagaacgagauaaucaauuaucggaacauugccugccauuuccaccucccgcugcuugaaacguuugacaaucugcuacucaacguagagcagaaguucaucaaagaggaacugcagaauguuucuacaauuaacgacuuguccaagccucaggaauaccugaucuuacucuuuauaaaauucaagcauaauaacuuuuaucugaaccuuuucaauaagaacgagaguaaaaccauuaagaaugauaaagaggugaagaaaaaccgaguccugcaaaaguuuaucaaucaggugaucuugaagaaaaaguga

SEQ ID NO: 11296 - RNA, 3642 nt, Artificial Sequence
  Cas13b variant__Flavobacterium columnare__WP_060381855.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacaaggaucaacuuuaaucauaacaauaacgaacuugcuucagucuucaaggauuauuuuaauaaagagaagaguguugcaaaacgggaacacgcccugaacuuguuaagcaauuacuuccccgugcuggagcgcauucagaagcauacuaaccacaauuuugagcagacgcgagaaauauucgagcuacuccuggacaccaucaaaaagcugcgugauuauuacacacaucacuaucacaagccuauuacuaucaacccaaaaguauacgacuuucuugaugacaccuugcucgaugugcugauuacaaucaagaaaaagaaagucaagaacgacaccuccagagaacugcucaaagagaaguucaggccggaguuaacucaacugaagaaucagaaacgggaagaacuuauaaagaaagguaagaaauugcuggaagagaaccuagaaaaugcgguguuuaaccauugccuccgccccuuccuggaggagaauaagacagaugacaagcagaacaaaaccguuucucuuagaaaguacaggaaaucgaagccuaaugaagagacgucaaucacucugacccagagcggcuugguguuccucauuuccuuuuuccugcaccggaaagaauuucaagucuucacauccggguuagagggauuuaaggcuaaggugaacacuaucaaagaagaggagauuucucugaauaagaacaauaucguauauaugauaacccauuggagcuacuccuauuacaacuucaaaggccucaagcaccgcauuaaaacagaucaggguguuucaacccuugaacagaauaacacgacucacagucugacaaauaccaacacuaaggaggccuugcuaacacagaucguggacuaucugagcaaggucccaaacgaaauuuacgagacccucucugaaaaacaacagaaggaguuugaggaagacaucaaugaguauaugcgagaaaaccccgagaaugaggauuccacguucucaagcaucgugagucauaaagugauuagaaagagguacgaaaacaaauuuaauuacuucgcaaugcgguuucuggacgaguaugccgaacuuccuacccugcguuucauggucaacuuuggggauuacauaaaggaccgccagaaaaagaucuuggagucuauucaauucgauuccgaaagaaucauaaagaaagagauucaccucuucgagaagcugggauuaguuacagaauauaaaaagaauguguaccugaaagagacuagcaacaucgaccuaucgagguuuccacucuuccccucuccuuccuauguaauggcuaauaacaauaucccauuuuacauugauucacggaguaacaaucuggacgaauaucuuaaccagaagaagaaagcacagagccagaaucgaaagcgcaacuugaccuucgagaaauacaacaaggaacaauccaaagaugccaucauugcuaugcugcagaaggagauaggcgugaaggaccuccagcagagaucuacaaucggccugcuuagcuguaaugagcugccgucaauguuguacgaagucauugugaaagauaucaagggggccgagcucgaaaacaaaaucgcgcaaaagauuagggagcaguaucagaguauacgggacuuuacucuggacaguccccagaaagauaauaucccuaccacauuaaccaagacuauuagcacggacacaucuguuaccuucgaaaaccaaccaaucgauauuccccgccugaagaaugcacuacagaaagagcucacucugacccaggagaaacuuuugaacgugaaacagcaugaaaucgaggucgacaauuacaacagaaauaagaacacauauaaauuuaagaaucaaccuaaagauaagguggacgauaacaagcugcagaggaaauacguauucuaucguaaugaaauaggacaggaggccaacuggcucgcuucagaccugauccacuuuaugaagaauaaaaguuuauggaaggguuacaugcauaacgagcugcagagcuuccuugccuuuuucgaagauaaaaagaacgacugcauugcauugcucgagaccguuuuuaaucugaaggaagauuguauccuaacuaaagaccugaagaaccucuuccugaaacacggcaauuucauugauuuuuauaaggaguaccuuaaauugaaggaagacuuccugaacacagaguccacguuuuuagagaauggguucaucggacucccacccaagauacugaaaaaggaacuuucuaaacggcugaacuacauuuuuaucguguuccaaaagcgacaguuuauuaucaaagaguuggaagagaagaagaauaaccucuaugcugacgccauaaaucugucgagaggcaucuucgaugaaaaaccgaccaugauuccuuuuaagaaacccaacccagacgaguucgcgagcugguuugucgccuccuaccaguauaauaacuaccaaucauucuaugagcuaacuccugauaagaucgaaaaugacaaaaagaagaaauacaagaaccugagggcaauuaauaaagugaagauccaggauuauuaccucaaacugauggucgacacacuuuaccaggauuuguucaaccagccccuggacaagaguuuaucugauuuuuaugugagcaaaaccgaccgcgagaagauaaaggcugaugccaaggcuuaccaaaagcggaaugacuccuuccucuggaacaaaguuauucaccugucacuucagaacaauagaaucacagccaacccaaagcugaaagauaucgguaaguauaagagggcacuacaggacgagaaaauugccacucuccugaccuacgacgaucgcacguggaccuaugcuuugcagaagcccgagaaagaaaaugagaacgacuacaaggagcugcauuauacagcguuaaauauggaacuccaagaguacgaaaaagugcgaagcaagaagcugcuuaaacagguacaggagcuggagaagcaaaucuuggauaaauuuuacgacuucucuaacaaugcaacucacccugaagaucucgagauugaagacaagaaagggaagcggcauccaaacuuuaagcuguauauaaccaaagcccuacugaagaaugaguccgaaaucauuaaccuugagaauaucgauauugagauccucauaaaauacuaugacuacaacacagaaaagcugaaagagaagaucaaaaauauggaugaagacgagaaggcuaagauugucaacacuaaagaaaauuauaacaagaucaccaacguguugauuaaaaaggcccugguuuuaaucauaauucguaauaaaauggcacacaaccaguacccgcccaaguucaucuaugaucucgccacgagauuugugccuaagaaagaggaggaauacuucgcuugcuacuuuaauagggucuucgagacaaucaccacugaacugugggagaacaagaaaaaggccaaagaaauuguguga

SEQ ID NO: 11297 - RNA, 3540 nt, Artificial Sequence
  Cas13b variant__Flavobacterium columnare__WP_014165541.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacaaggaucaacuuuaaucauaacaauaacgaacuugcuucagucuucaaggauuauuuuaauaaagagaagaguguugcaaaacgggaacacgcccugaacuuguuaagcaauuacuuccccgugcuggagcgcauucagaagcauacuaaccacaauuuugagcagacgcgagaaauauucgagcuacuccuggacaccaucaaaaagcuacgugauuauuacacacaucacuaucacaagccuauuacuaucaacccaaaaauuuacgacuuucuggaugacaccuugcucgauguacugaucacaauaaagaaaaagaaagugaagaacgacaccuccagagaacugcucaaagagaaguuaaggccggagcugacucaacuuaagaaucagaaacgggaagaguugaucaagaaagguaagaaacugcuagaagagaaccucgaaaaugcggucuucaaccauugccugcgccccuuucuugaggagaauaagacagaugacaagcagaacaaaaccgugucucugagaaaguacaggaaaucgaagccuaaugaagagacgucaauuacuuugacccagagcggccucguuuuccugaugaguuucuuuuuacaccggaaagaguuccaaguguuuacauccgggcuggaaggauucaaggcuaaggucaacacuaucaaagaagaggagauuucucucaauaagaacaauaucguguauaugauaacccauuggagcuacuccuauuacaacuuuaaaggccuuaagcaccgcauuaaaacagaucaggguguaucaacccuggaacagaauaacacgacucacaguuugacaaauaccaacacuaaggaggcccuacugacacagaucguugacuaucucagcaaggugccaaacgaaauuuacgagacccugucugaaaaacaacagaaggaguucgaggaagacaucaaugaguauaugcgagaaaaccccgagaaugaggauuccacguuuucaagcaucgucagucauaaagugauuagaaagagguacgaaaacaaauucaauuacuuugcaaugcgguuccuugacgaguaugccgaacugccuaccuugcguuuuauggugaacuucggggauuacauaaaggaccgccagaaaaagauccucgagucuauucaauuugauuccgaaagaaucauaaagaaagagauucaccuguucgagaaguuaagccuggucacagaauauaaaaagaauguuuaccuaaaagagacuucgaacaucgaccucucuagguucccacuguuucccaauccuuccuaugugauggcuaacaauaacaucccauucuacauugauucacggaguaauaaccuugacgaauauuugaaucagaagaagaaagcacagagccagaacaagaaacgaaaccugaccuuugagaaguacaauaaagaacaauccaaggaugccaucauugcuaugcuccagaaggagauaggaguaaaagaccugcagcagcgcucuacaaucggccuucugagcuguaacgaguugccgucaaugcucuacgaagugauugucaaggauaucaaaggcgccgagcuggaaaauaagaucgcgcaaaagauuagagagcaguaucagaguauaagggacuucacuuuagacagcccccagaaggauaacaucccuaccacacugauuaagaccaucaauacugacuccucugugacguuugaaaaccaaccaauugauaucccccggcuuaaaaaugcaauacagaaggagcucacacugacccaggagaaacuuuugaacguuaaggaacaugagaucgaaguggacaauuacaaccgcaauaaaaacacuuauaaguucaaaaaucagccuaagaacaaggucgaugacaaaaagcugcaaagaaaauacguguuuuauaggaaugagauucgucaggaggccaacuggcucgcuucagaucugauccacuucaugaagaacaaaaguuuauggaagggguacaugcauaaugaacugcagagcuuucuugccuucuuugaggacaagaaaaacgauugcauugcauugcucgaaaccguauucaaucugaaggaggacuguauccuaacaaaaggacugaagaaccucuuucugaaacacgguaauuucauagauuucuauaaggaauaccuuaaguugaaagaggacuuucugaacaccgaguccacuuucuuagaaaauggccucauugggcugccacccaagauccuuaaaaaggagcugucuaaacgguuuaaguacauuuucaucguuuuucaaaagcgacaguucauaaucaaagaauuggaggaaaagaaaaacaaucucuaugcugaugccauuaaccugucgagaggaaucuuugacgagaagccgacaaugauuccuuucaaaaagcccaauccagacgaguuugcgagcugguucguggccuccuaccaguauaacaauuaccagucauuuuaugaacuaacgccugauaucgucgagagggacaagaaaaagaaauacaagaaccugcgcgcaauaaauaaagugaagauucaagauuauuaccucaaacugauggucgacacccuuuaccaggauuuguucaaccagccccuggacaagaguuuaucugauuucuaugugagcaaggcugaacgggagaaaaucaaggccgacgcuaaagccuaccagaagagaaaugauuccucacucuggaacaaaguuauccaccugagccuucaaaacaauaggauuacugcaaacccaaagcugaaggacaucggcaaauauaagcgcgcccuacaggaugagaaaauugcuacacuccugaccuacgacgaucgaacauggacuuaugcguugcagaagcccgaaaaagagaaugaaaacgacuacaaggagcugcauuauaccgcauuaaauauggaacuccaggaguacgagaaggugcggucuaaagaacugcuuaagcaaguacaggagcuggaaaaacagauauuggaggaauacacggacuuucucuccacccaaauccacccugccgauuucgagcgugaggguaacccaaauuuuaagaaauaucuggcucauaguauucuagaaaacgaggacgaucuggacaaacuuccggaaaaggucgaggccaugagagaacucgaugagacaaucacuaaucccauuaucaaaaaggcaauagugcugaucauuaucaggaacaaaauggcccacaaucaguacccuccaaaguucauuuaugacuuggcuaaccgcuuuguucccaaaaaggaggaagaguacuucgccaccuauuuuaaucggguguucgaaacaaucacuaaagagcugugggaaaacaaggagaagaaagauaagacccaggucuga

SEQ ID NO: 11298 - RNA, 3642 nt, Artificial Sequence
  Cas13b variant__Flavobacterium columnare__WP_063744070.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacaaggaucaacuuuaaucauaacaauaacgaacuugcuucagucuucaaggauuauuuuaauaaagagaagaguguugcaaaacgggaacacgcccugaacuuguuaagcaauuacuuccccgugcuggagcgcauucagaagcauacuaaccacaauuuugagcagacgcgagaaauauucgagcuacuccuggacaccaucaaaaagcuacgugauuauuacacacaucacuaucacaagccuauuacuaucaacccaaaaauuuacgacuuucuggaugacaccuugcucgauguacugaucacaauaaagaaaaagaaagugaagaacgacaccuccagagaacugcucaaagagaaguuaaggccggagcugacucaacuuaagaaucagaaacgggaagaguugaucaagaaagguaagaaacugcuagaagagaaccucgaaaaugcggucuucaaccauugccugcgccccuuucuugaggagaauaagacagaugacaagcagaacaaaaccgugucucugagaaaguacaggaaaucgaagccuaaugaagagacgucaauuacuuugacccagagcggccucguuuuccugaugaguuucuuuuuacaccggaaagaguuccaaguguuuacauccgggcuggaaggauucaaggcuaaggucaacacuaucaaagaagagaagauuucucucaauaaaaacaauaucguguauaugauaacccauuggagcuacuccuauuacaacuuuaagggccuuaaacaccgcauuaagacagaucaggguguaucaacccuggagcagaauaacacgacucacaguuugacaaauaccaacacuaaggaagcccuacugacacagaucguugacuaucucagcaaagugccaaacgagauuuacgaaacccugucugagaagcaacagaaagaguucgaagaggacaucaaugaauauaugcgagagaaccccgaaaaugaggauuccacguuuucaagcaucgucagucauaaggugauuagaaaaagguacgagaacaaguucaauuacuuugcaaugcgguuccuugacgaauaugccgagcugccuaccuugcguuuuauggugaacuucggggauuacauaaaagaccgccagaagaagauccucgaaucuauucaauuugauuccgagagaaucauaaagaaggaaauucaccuguucgagaaauuaggacuggucacagaguauaagaaaaauguuuaccuaaaggaaacuagcaacaucgaccucucgagguucccacuguuucccucuccuuccuaugugauggcuaauaacaauaucccauucuacauugauucacggaguaacaaucuugacgaguauuugaaccagaagaaaaaggcacagagccagaaucgaaaacgcaaccugaccuuugaaaaguacaacaaagagcaauccaaggaugccaucauugcuaugcuccagaaggaaauaggcguaaaagaccugcagcagagaucuacaaucggccuucugagcuguaaugaguugccgucaaugcucuacgaggugauugucaaggauaucaaaggggccgaacuggagaacaagaucgcgcagaaaauuagggaacaauaucagaguauacgggacuucacuuuaaauagcccccagaaggacaacaucccuaccacacugauuaagaccaucagcacugauacgucugugacauuugagaaucaaccaauugacaucccccgccuuaaaaacgcaauacagaaggaacucgcccugacccaggagaaacuuuugaauguuaagcagcaugagaucgaagugaacaauuacaacagaaauaaaaacacuuauaaguucaaaaaucaaccuaaggauaaggucgacgauaacaaacugcagaggaaguacguguuuuaucguaaugagauuggacaggaagcuaacuggcucgccucagaccugauccacuucaugaaaaacaagaguuuauggaaagguuacaugcauaaugagcugcaauccuuucuugcauucuuugaggauaagaagaacgacugcauugcuuugcucgaaaccguauucaaucugaaagaggauuguauccuaacaaaggaccugaaaaaccucuuucugaagcacggcaauuucauagauuucuauaaagaauaccuuaaguugaaggaggacuuucugaacaccgaauccacuuucuuagagaauggguuuauuggacucccacccaaaauccugaagaaagagcuuucuaagcggcugaacuacauuuucaucguuuuucagaaacgacaguucauaaucaaggaauuggaggaaaagaaaaauaaccucuaugccgaugcgauuaaucugucgagaggcaucuuugacgagaagccgacaaugauuccuuucaaaaagcccaacccagacgaauuugccagcugguucguggcauccuaccaguauaauaacuaccaaucauuuuaugagcuaacgccugauaaaaucgagaaugacaagaagaaaaaguacaaaaaccugagggcuauaaauaaggucaaaauucaggauuauuaccucaagcugaugguggacacccuuuaccaggauuuguucaaccagccccuggacaaaaguuuaucugauuucuaugucagcaagacugaccgcgaaaagaucaaagccgaugcuaaggccuaccaaaaacggaacgacuccuuucucuggaauaaggugauccaccugucacuucagaacaauagaauuacagcaaacccaaaacugaaggauaucgguaaguauaaaagggcccuacaggacgagaagauugcuacccuccugacauacgaugaccgcacuuggaccuaugcguugcagaaacccgaaaaggagaaugaaaacgacuacaaagagcugcauuauacggcauuaaauauggagcuccaagaauacgagaagguucgaagcaagaaacugcuuaaacaggugcaggaacuggagaaacaaauauuggauaaguucuacgacuuuucuaacaaugccacccacccugaggaucucgaaaucgaggacaaaaaggggaagcggcauccaaacuucaaacuguauauuacaaaggcucuacugaaaaaugaauccgagaucauuaaccuugaaaauaucgauauagagauccucauuaaguacuaugacuacaacacugagaaacugaaggagaaaaucaagaauauggaugaagacgaaaaggccaaaauuguaaacaccaaggagaacuauaauaaaaucacaaacgucuugauaaagaaagcacugguguuaauuaucauccguaauaagauggcccacaaccaguacccgcccaaguuuauuuaugaucucgcuacuagauucguuccuaaaaaggaagaggaguacuuugccugcuacuucaauaggguguuugaaaccauaacgacagagcugugggaaaacaaaaagaaagcaaaggagaucgucuga

SEQ ID NO: 11299 - RNA, 3645 nt, Artificial Sequence
  Cas13b variant__Flavobacterium columnare__WP_065213424.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacaaggaucaacuuuaaucauaacaauaacgaacuugcuucagucuucaaggauuauuuuaauaaagagaagaguguugcaaaacgggaacacgcccugaacuuguuaagcaauuacuuccccgugcuggagcgcauucagaagcauacuaaccacaauuuugagcagacgcgagaaauauucgagcuacuccuggacaccaucaaaaagcuacgugauuauuacacacaucacuaucacaagccuauuacuaucaacccaaaaauuuacgacuuucuggaugacaccuugcucgauguacugaucacaauaaagaaaaagaaagugaagaacgacaccuccagagaacugcucaaagagaaguuaaggccggagcugacucaacuuaagaaucagaaacgggaagaguugaucaagaaagguaagaaacugcuagaagagaaccucgaaaaugcggucuucaaccauugccugauucccuuucuugaggagaauaagacagaugacaagcagaacaaaaccgugucucugcgcaaguacagaaaaucgaagccuaaugaagagacgucaaucacuuugacccagagcggccucguuuuccugaugaguuucuuuuuacacaggaaagaguuccaaguguuuacauccgggcuggaacgguucaaggcuaaggucaacacuauuaaagaagaggagaucucucucaauaagaacaauauaguguauaugauuacccauuggagcuacuccuauuacaacuuuaaaggacuuaagcaccgcaucaaaacagaucagggcguaucaacccuggaacagaauaacacgacucacaguuugacaaauaccaacacuaaggaggcccuacugacacagauuguugacuaucucagcaaggugccaaacgaaaucuacgagacccugucugaaaaacaacagaaggaguucgaggaagacaucaaugaguauaugcgagaaaaccccgagaaugaggauuccacguuuucaagcauugucagucauaaagugauaagaaagagguacgaaaacaaauucaauuacuuugcaaugcgguuccuugacgaguaugccgaacugccuaccuugcguuuuauggugaacuucggugauuacaucaaggaccgccagaaaaagauucucgagucuauccaauuugauuccgaaagaauaauuaagaaagagauccaccuguucgagaaguuaagccuggucacagaauauaaaaagaauguuuaccuaaaagagacuucgaacaucgaccucucuagguucccacuguuucccaauccuuccuaugugauggcuaacaauaacauuccauucuacaucgauucacggaguaauaaccuugacgaauauuugaaucagaagaagaaagcacagagccagaacaagaaacgaaaccugaccuuugagaaguacaauaaagaacaauccaaggaugccauuauagcuaugcuccagaaggagaucgggguaaaagaccugcagcagcgcucuacaauuggacuucugagcuguaacgaguugccgucaaugcucuacgaagugaucgucaaggauaucaaaggcgccgagcuggaaaauaagauugcgcagaaaauaagagagcaauaucagaguaucagggacuucacuuuagacagcccccagaaggauaacauuccuaccacacugaucaagaccauuaauacugacuccucugugacguuugaaaaccaaccaaucgauauaccccggcuuaaaaaugcacuccagaaggagcugacacuuacccaggagaaauugcugaacguuaaggaacaugagaucgaaguggacaauuacaaccgcaauaaaaacacuuauaaguucaaaaaucagccuaagaacaaggucgaugacaaaaagcuccaaagaaaauacguguuuuauaggaaugagauucgucaggaggccaacuggcuggcuucagauuuaauccacuucaugaagaacaaaagucuguggaagggcuacaugcauaaugaacuucagagcuuuuuggccuucuuugaggacaagaaaaacgauugcauugcacuccuggaaaccguauucaaucuaaaggaggacuguauccugacaaaagggcucaagaaccuguuucuuaaacacggaaauuucauagauuucuauaaggaauacuugaagcugaaagaggacuuuuuauccaccgagucuacuuuccucgaaaacgguuuuauuggccugccacccaagauccuuaaaaaggagcugucgaaacgguugaaguacauuuucaucguuuuucaaaagcgacaguucauaaucaaagaacucgaggaaaagaaaaauaaccuguaugcugaugccauuaaucuaagcagagggaucuuugacgagaagccgacaaugauuccuuucaaaaagcccaacccagacgaguuugcguccugguucguggccucauaccaguauaauaacuaccagaguuuuuaugaacugacgccugauaucgucgagagggacaagaaaaagaaauacaagaaucuccgcgcaauaaacaaagugaagauucaagauuauuaccugaaacuuauggucgacaccuuguaccaggaucuguucaaucagcccuuagacaagucucucagcgauuucuauguguccaaggcugaacgggagaaaaucaaggccgacgcuaaagccuaccagaagcugaacgauucaagccuuuggaauaaaguuauccaccugucucuacaaaacaacagaauuacugcaaauccaaagcucaaggacaucggaaaauauaagagggcccugcaggaugagaaaauugcuacauugcugaccuacgacgcgcgcacauggacuuaugcauuacagaagcccgaaaaagagaacgaaaaugauuacaaggagcuccauuauaccgcccugaacauggaacuucaggaguacgagaaggugcgauccaaagaacuguugaagcaaguacaggagcucgagaaaaagauacuggacaaauuuuacgacuucaguaauaacgcuagccacccugaagaucuagaaaucgaggacaagaagggcaaacggcauccaaauuuuaagcuguauauuacgaaagcccuucucaagaacgagucugaaaucauuaaucuggagaacaucgauauagaaaucuugcugaaauacuaugacuacaauaccgaggaauuaaaggagaaaauuaagaacauggaugaggacgaaaaggcaaaaaucauuaauacaaaggagaacuauaauaaaaucacuaacguccucauaaagaaagcccuggugcuuauuaucauccguaacaagauggcucacaaucaguacccgcccaaguucauuuaugaucuggccaacagauuuguuccuaaaaaggaagaggaauacuucgcaaccuacuuuaauaggguguucgagacaauaacuaaagaguugugggaaaacaaggagaaaaaggacaagacccaagucuga

SEQ ID NO: 11300 - RNA, 3468 nt, Artificial Sequence
  Cas13b variant__Flavobacterium sp.__WP_045968377.1__Cas13b
auggacaacaauaucaccguggagaagacagaacugggccucgggauuacuuacaaccacgauaaagucgaggacaagcauuauuucggagguuucuucaaucuugcccagaacaauauagaucugguugcucaagaauuuaaaaagagauuguuaauccagggcaaagacagcauuaacaucuucgcaaauuacuuuuccgaucagugcucuauuacgaaccuggagagggggaucaagauacuagccgaauauuuccccgugguaucauacaucgaccucgaugagaagaauaaaaguaagagcauucgggagcaccugauccuucuguuggaaaccauuaacaaucuccgcaacuauuacacacauuauuaccacaaaaagaucauaauugacggaucccuguuuccucugcucgauacuaucuuacugaaagugguccuugagauuaagaagaaaaaguugaaagaagacaagaccaaacagcugcuaaagaaaggccucgagaaggagaugacaauccuguucaaucuuaugaaggcggaacaaaaagagaagaaaaucaaggguuggaacauugaugaaaauauaaaaggggcugugcugaaccgagccuuuucucauuugcucuacaacgacgagcugucggauuaucguaagucaaaguacaauaccgaagacgagacuuuaaaagacacacugaccgagagcggaauccucuuccuucugagcuuuuucuugaacaagaaagaacaggagcagcuaaaggcaaauauuaaaggcuauaagggcaagaucgccuccauaccagaugaagagauuacgcugaaaaacaauucucucagaaacauggcuacucacuggaccuacagccaccugacauauaaggggcuuaaacauaggaucaagacugaccacgaaaaagagacccuguugguuaauaugguggauuaccucuccaaggucccgcaugagaucuaucagaaccugucagaacaaaauaagaguuuauuucuggaggacauuaacgaauacaugcgggauaaugaggaaaaccacgacagcucugaggcaucccgcgugauccaccccguaauuagaaaaagguacgagaauaaguucgccuauuucgcuauacgguuucuagaugaauuugccgaguuuccuacacuccgcuucaugguuaacgugggaaauuacauccaugacaaccgaaagaaggauauugguggcaccucacugaucacgaacagaacuaucaaacagcagauuaaugucuuugggaaccuuacagaaauacacaagaaaaagaaugacuauuucgagaaggaggaaaacaaagagaagaccuuggaaugggagcuguuuccaaaucccagcuaccauuuccagaaagaaaacaucccuauuuuuaucgaucucgagaagaguaaagagacuaaugaccuggcgaaggaauaugcaaaggagaaaaagaaaauuuucggaucuuccaggaagaaacaacagaacacagccaagaagaaucgggaaaccaucauaaaccuuguguuugacaaauacaagacgagcgaucguaaaaccgugacauucgagcagccaacugcucuguugucguuuaaugaacucaacucuuuccuguaugccuucuuagucgagaauaagaccggcaaagagcuggaaaagaucauuaucgagaagauugcaaaccaauaccagauccucaaaaauuguuccucaacaguugacaagacuaacgauaacauacccaaaaguauuaagaaaaucgugaauaccacaaccgacagcuuuuacuucgaagguaagaaaauugauaucgagaagcuagaaaaggacauaacuaucgagauugagaaaacgaacgaaaagcuggagacaaucaaagaaaaugaggaguccgcucagaacuauaagcgcaaugaaagaaacacccagaaaaggaaacuuuaccggaaguauguauuuuucacuaaugagauugggaucgaagccaccuggauaacaaacgauauuuugcgauuucuggacaauaaagagaacuggaagggauaccaacacucugaacuccagaaauucaucagccaguaugauaauuacaagaaagaggcgcugggcuuacuggagucagaauggaaccuugagagugacgccuuuuucggccagaauuugaagcgcauguuucaauccaacagcaccuucgaaacuuuuuauaagaaauaccucgauaauagaaagaacacacuggagacguaccuaucugcaaucgaaaaccugaaaaccaugacugacgugaggccuaagguccucaaaaagaaguggacagagcuguuccgguuuuucgauaaaaagauuuaucuuuugucaaccaucgagacaaaaauuaaugaacugauaacuaagccaaucaacuuaagucgcgggauuuucgaggaaaaaccgaccuuuaucaauggaaagaaccccaauaaggagaacaaucagcaucucuucgcuaacugguuuauuuacgccaaaaagcagacgauccugcaggacuucuauaaucuuccucuggaacaaccaaaagcuauaaccaacuugaagaaacacaaguacaaacucgagagaagcaucaauaaccugaagauugaggacaucuauauuaagcagaugguggauuuucuauaccagaaacuguucgaacaguccuuuaucgguucucuccaagaccuguauacaucgaaggagaaaagggaaauagagaagggcaaagccaagaaugagcagacucccgaugaaaguuucauuuggaagaaacagguugagaucaacacccacaaugggcguaucauugcaaagacaaaaauaaaggacaucggaaaauuuaagaaccuuuugacugauaauaagauugcccaucugaucuccuacgacgaucggauuugggacuucucauuaaacaacgauggcgacaucaccaaaaagcucuacaguauaaauacggaacuggagucuuaugaaacaauccgaagagagaaacuucugaagcaaauucagcaguuugagcaguuccuacucgaacaagagaccgaauacagcgcugagaggaaacacccugaaaaguucgagaaggauugcaacccaaauuuuaaaaaguauaucauugagggugugcugaacaaaaucauacccaaucaugaaauugaggaaaucgagaucuugaaguccaaagaagacgucuucaagauuaacuuuucagauauccugauauuaaauaacgacaauauuaaaaagggguaccuccugaucaugauucgcaacaaguucgcgcacaaucagcuuaucgacaaaaaccuguuuaauuucagcuugcagcucuauucuaagaacgagaaugagaacuuuuccgaauaccugaacaaagugugucagaauauaauucaagaguucaaggaaaaacuaaaguga

SEQ ID NO: 11301 - RNA, 3480 nt, Artificial Sequence
  Cas13b variant__Myroides odoratimimus__EHO06562.1__Cas13b
augaaggacauccugaccacagauacuacggagaaacagaacagauucuacagccacaagauugccgacaaauauuucuucggcggguacuuuaaucucgcuuccaacaauauauaugaaguguucgaggaagucaacaagaggaauaccuuuggaaaacuugcaaagcgggauaacgguaaucugaagaacuacaucauucauguuuucaaagacgaguugucuaucucagauuuugaaaagcgcguggccauuuucgcgaguuauuuucccaucuuagagacaguagacaaaaagagcauaaaagagcgaaaucguacuaucgaucugacccuaucccaaagaauuaggcaguuccgggaaaugcucaucucucuggugacagcugucgaccagcuucgcaacuuuuacacccacuaucaucacucggauauugugaucgagaauaagguucuggacuucuugaacagcucauuugugaguacugcccuccaugucaaggauaaauaccugaagacagacaaaaccaaggaauuucugaaagagacgauagcagccgagcucgauauuuuaaucgaggcuuacaagaaaaagcagauugaaaagaaaaauacuagauucaaggcaaacaaaagggaagacauccugaaugccaucuauaacgaggcuuuuugguccuucauuaacgacaaggauaaagacaaggauaaggaaaccgugguagccaaaggcgcggacgcauacuuugagaagaaucaccacaaaucuaacgauccugacuucgcccuuaauauaagcgagaaggggaucguuuauuugcuguccuuuuuccuaacaaacaaagaaauggauucacucaaggcuaaucugacuggauuuaagggcaaaguggaccgggagagugguaacagcauuaaguacauggccacccaacgcaucuauucuuuccauacauaccgagggcuuaaacagaagauaagaaccuccgaagagggagucaaagaaacgcuguugaugcagaugauugaugagcucucaaaggugccaaauguggucuaucagcaccugagcacuacacaacagaacaguuuuaucgaggacuggaaugaauacuacaaggauuaugaggacgacguugaaaccgaugacuuaucuagggugauccauccgguaauucggaaacguuacgaggaucgcuucaacuauuuugcaaucagauuccuggacgaauuuuucgauuuccccacucucagguuucaggugcaccuuggcgacuacguccacgaucggcgaacaaagcagcugggcaaaguggaguccgaccgcauuauaaaggagaaaguuaccguguucgcuagauugaaggauaucaauagcgccaaagcgucguauuuucauucucuagaggaacaagacaaggaggaacuggauaacaaguggacccucuucccuaauccauccuacgacuuucccaaagagcacacgcugcagcaucagggggaacaaaagaacgccggaaaaauugguaucuaugucaaacuuagggauacacaguacaaagagaaggcagcucuggaagaggcccggaagucauugaauccuaaagaacgcagugcuacuaaggccagcaaauacgacaucauuacccagauaaucgaggcaaacgacaacgugaaguccgagaaaccacucguauucacaggccagcccauugccuaucugucuaugaaugauauccacagcauguuauuuucacugcuaacugacaacgcugaacucaagaagaccccugaggaaguugaggcgaaacugauugaucaaaucgggaagcagauaaaugaaauccuuaguaaagacacagauaccaagauuuugaaaaaguacaaggacaacgaucugaaagagacugacacggauaagaucacaagagaccucgcaagggauaaagaggaaauugagaagcugauccuugaacagaaacagcgugccgacgauuauaauuacaccuccagcacuaaguucaacauagacaaaucucggaagcgaaagcaucuguuguuuaaugcugagaaaggaaagauuggcguguggcucgccaacgacaucaaaagauucauguuuaaggaaucaaaaaguaaguggaaggguuaucaacacaccgagcugcagaaauuauucgcauacuuugauacaagcaaguccgaccuggagcuaauucucucuaauauggucauggugaaagauuauccaaucgaacugauagaccuugucaagaaaucgaggaccuugguggauuuccugaacaaguaccucgaggcccgccuggaauacaucgagaauguuauuacucgggugaagaacagcaucgggacaccgcaguucaaaacgguaagaaaggagugcuuuaccuucuuaaagaaguccaauuauacugucgugucacuggacaaacagguugaaaggauucuuaguaugcccuuguuuaucgagcgcggauucauggaugacaagccuacaaugcucgaaggcaagucuuacaaacaacacaaggagaaauuugcugauugguucgugcauuauaaggaaaacagcaauuaccagaacuuuuaugacaccgaggucuacgagauaacaacugaagauaaacgagagaaggccaaggugaccaaaaagauuaaacagcagcaaaagaacgacguauucacgcugaugauggugaauuauaugcuagaagagguucugaaacucuccucaaacgaccggcugagccuuaaugaauuguaccagaccaaggaggagcguaucgucaacaaacagguggcaaaggauacacaagaaagaaauaagaacuacaucuggaauaaaguggucgaccugcaguuaugugauggccucguucacauugacaacgugaagcugaaagauaucgggaauuuuaggaaguaugagaacgacucucgcgugaaagaguuccuuacuuaccaguccgauauuguauggagugcguaucugagcaaugaagucgacucuaacaaguuguacgugauagaacggcagcucgauaauuaugaguccaucagaucaaaggagcugcuaaaagaaguucaagagauugaaugcaguguguacaaccaggucgcuaauaaggagagccugaaacagucgggaaacgagaacuuuaagcaguaugugcuccaaggucugcuuccaaucggcauggacguuagggaaauguugauucuguccaccgaugugaaauucaagaaggaggaaaucauacaguuagggcaggccggagagguagaacaggaccucuacucucugaucuacauucgaaauaaauucgcacauaaccaacuucccaucaaggaguuuuucgauuuuugugagaauaacuaucgcagcauuucagacaaugaauacuaugccgaguacuauauggaaaucuuccggaguauaaaagagaaguacgcuaacuga

SEQ ID NO: 11302 - RNA, 3474 nt, Artificial Sequence
  Cas13b variant__Myroides odoratimimus__WP_006261414.1__Cas13b
augaaggacauccugaccacagauacuacggagaaacagaacagauucuacagccacaagauugccgacaaauacuuuuucggcggguauuuuaaucucgcuuccaacaauauauaugaaguguucgaggaagucaacaagaggaauaccuuuggaaaacuugcaaagcgggauaacgguaaucugaagaacuacaucauucauguuuucaaagacgaguugucuaucucagauuuugaaaagcgcguggccauuuucgcgaguuauuuucccaucuuagagacaguagacaaaaagagcauaaaagagcgaaaucguacuaucgaucugacccuaucccaaagaauuaggcaguuccgggaaaugcucaucucucuggugacagcugucgaccagcuucgcaacuuuuacacccacuaucaucacucggagauugugaucgaaaauaagguucuggauuucuugaacucaagccucgugaguacugcccugcaugucaaggacaaauaccugaagacagauaaaaccaaggaguuucucaaagagacgauagcagccgaauuagacauucugaucgaggcuuacaagaaaaagcagauugaaaagaaaaauacuagauucaaggcaaacaaaagggaggauauccuuaaugccaucuauaacgaggcuuucugguccuuuauuaacgacaaggacaaagauaaggaaaccgugguagccaagggcgcggacgcauacuucgagaaaaaucaccacaagucuaacgauccugacuuugccuugaauauaagcgaaaaagggaucguuuaucugcuauccuucuuucucacaaacaaggagauggauucacugaaagcuaaucuuacuggauucaagggcaagguggaccgggaaagugguaacagcauuaaauacauggccacccaacgcaucuauucuuuucauacauaccgagggcugaagcagaaaauaagaaccuccgaggaaggagucaaggagacguugcucaugcagaugauugaugagcugucaaaagugccaaauguggucuaucagcacuuaagcacuacacaacagaacaguuucaucgaagacuggaaugaguacuacaaggauuaugaagacgauguugagaccgacgaccugucuagggugauccauccgguaauucggaagcguuacgaagaucgcuuuaacuauuucgcaaucagauuucucgacgaguucuuugauuuccccacucuuagguuccaggugcaccugggcgacuacguccacgaucggcgaacaaaacaguugggcaagguggaguccgaccgcauuauaaaagaaaagguuaccguguuugcuagacuaaaagauaucaauagcgccaaggcgaacuauuuccauucgcuggaggaacaagacaaagaggagcucgauaauaaguggacgcuguuuccuaacccaucuuacgacuuccccaaggaacacacccuucagcaucagggggagcaaaagaaugccggaaagauugguaucuaugucaaacugagggauacacaguacaaggaaaaagcagcuuuggaggaagcccggaagucccucaacccuaaggagcgcucagcuacuaaagccaguaaguacgacaucauuacccagauaaucgaggcaaacgauaaugugaaaagcgaaaagccacugguauuuacaggccagcccauugccuauuuauccaugaacgacauccacucuaugcuguucagccuacucacugacaaugcugagcugaaaaagaccccugaagagguugaagcgaaguugauugaucaaaucgggaaacagauaaacgagaucuugucaaaggacacagauaccaaaauucugaagaaauacaaggacaaugaucucaaggagacugacacggauaaaaucacaagagaccuggcaagggauaaggaagagauugaaaaacuuauccuggagcagaagcagcgugccgacgauuauaacuacaccaguuccacuaaauuuaauauagacaagagccggaaacgaaagcaucuucucuucaacgcugaaaagggaaaaauuggcguguggcuggccaaugauaucaagagauuuaugaccgaggaguucaaaucuaaguggaaagguuaucaacacacagaauuacagaagcuguuugcauacuaugacaccucaaagagugaccuagaucucauucugagcgacauggucauggugaaagauuacccaaucgagcuuauagccuuggucaagaaauccaggacucugguggacuuccucaacaaguaccuggaagcucgcuuaggguauauggagaauguuaucacacgggugaaaaacucuauuggaacgccgcaguuuaagaccguaagaaaggagugcuucacuuuccugaaaaagucgaauuacacagucgugagccuugauaaacagguugaaaggaucuuguccaugccccucuuuauugagcgcggcuucauggacgauaagccuaccaugcuggaaggcaaaucauaucaacagcacaaggagaaguuugccgacugguucgugcauuacaaagaaaacaguaauuaucagaacuuuuacgauacagaggucuaugagaucacuaccgaagacaagcgagagaaagcaaaggugacgaaaaagauaaagcagcaacagaaaaacgauguauucacccuaaugauggugaauuacaugcuggaagagguucucaagcugucuagcaacgaccggcuuuccuugaaugaacuguaccagacaaaagaggagcguauugucaacaagcaaguggcgaaagacacucaggaaagaaauaagaacuauaucuggaauaaaguggucgauuuacagcucugugaggggcugguuaggaucgacaaggugaaacuuaaagauauuggaaacuuucgcaaguacgaaaaugacucacgggugaaagaguuccugaccuaucagagcgauaucguauggucugcuuacuuguccaacgaagucgacaguaauaagcucuaugugauugagagacaacuggauaacuacgagagcauaaggucuaaagaacuacugaaggagguucaggaaaucgagugcuccguguauaaucaggucgccaacaaggagucacucaaacagagugguaaugaaaacuuuaagcaauacgugcugcagggccuuguuccaauugggauggacgugcgagagauguugauccugagcacagauguaaaauucauuaaggaagagaucauacaguuaggacaggcaggcgaagucgagcaagaccucuacucgcugaucuauauucgcaacaaauuugcccacaaucagcuucccaucaaggaguucuucgauuuuugugaaaacaauuaccgguccauuucugacaacgaguauuacgcugaauauuacauggagaucuucagaagcauaaaggaaaaauauacuucauga

SEQ ID NO: 11303 - RNA, 3474 nt, Artificial Sequence
  Cas13b variant__Myroides odoratimimus__EKB06014.1__Cas13b
augaaggacauccugaccacagauacuacggagaaacagaacagauucuacagccacaagauugccgacaaauacuuuuucggcggguauuuuaaucucgcuuccaacaauauauaugaaguguucgaggaagucaacaagaggaauaccuuuggaaaacuugcaaagcgggauaacgguaaucugaagaacuacaucauucauguuuucaaagacgaguugucuaucucagauuuugaaaagcgcguggccauuuucgcgaguuauuuucccaucuuagagacaguagacaaaaagagcauaaaagagcgaaaucguacuaucgaucugacccuaucccaaagaauuaggcaguuccgggaaaugcucaucucucuggugacagcugucgaccagcuucgcaacuuuuacacccacuaucaucacucggagauugugaucgaaaauaagguucuggauuucuugaacucaagccucgugaguacugcccugcaugucaaggacaaauaccugaagacagauaaaaccaaggaguuucucaaagagacgauagcagccgaauuagacauucugaucgaggcuuacaagaaaaagcagauugaaaagaaaaauacuagauucaaggcaaacaaaagggaggauauccuuaaugccaucuauaacgaggcuuucugguccuuuauuaacgacaaggacaaagauaaggagaccgugguagccaagggcgcggacgcauacuucgagaaaaaucaccacaagucuaacgauccugacuuugccuugaauauaagcgaaaaagggaucguuuaucugcuauccuucuuucucacaaacaaggagauggauucacugaaagcuaaucuuacuggauucaagggcaagguggaccgggaaagugguaacagcauuaaauacauggccacccaacgcaucuauucuuuucauacauaccgagggcugaagcagaaaauaagaaccuccgaggaaggagucaaggagacguugcucaugcagaugauugaugagcugucaaaagugccaaauguggucuaucagcacuuaagcacuacacaacagaacaguuucaucgaagacuggaaugaguacuacaaggauuaugaagacgauguugagaccgacgaccugucuagggugauccauccgguaauucggaagcguuacgaagaucgcuuuaacuauuucgcaaucagauuucucgacgaguucuuugauuuccccacucuuagguuccaggugcaccugggcgacuacguccacgaucggcgaacaaaacaguugggcaagguggaguccgaccgcauuauaaaagaaaagguuaccguguuugcuagacuaaaagauaucaauagcgccaaggcgucguauuuccauucucuggaggaacaagacaaagaggagcucgauaacaaguggacgcuguuuccuaauccauccuacgacuuccccaaggaacacacccuucagcaucagggggagcaaaagaacgccggaaagauugguaucuaugucaaacugagggauacacaguacaaggaaaaagcagcuuuggaggaagcccggaagucacucaauccuaaggagcgcagugcuacuaaagccagcaaguacgacaucauuacccagauaaucgaggcaaacgauaacgugaaauccgaaaagccacugguauuuacaggccagcccauugccuauuuaucuaugaaugacauccacagcaugcuguucucacuacucacugacaacgcugagcugaaaaagaccccugaagagguugaagcgaaguugauugaucaaaucgggaaacagauaaaugagaucuugaguaaggacacagauaccaaaauucugaagaaauacaaggacaacgaucucaaggagacugacacggauaaaaucacaagagaccuggcaagggauaaggaagagauugaaaaacuuauccuggagcagaagcagcgugccgacgauuauaauuacaccuccagcacuaaauuuaacauagacaagucucggaaacgaaagcaucuucucuucaaugcugaaaagggaaaaauuggcguguggcuggccaacgauaucaagagauuuauguucaaagagucaaagaguaaauggaaggguuaucaacacaccgaguuacagaagcuguuugcauacuucgacacaagcaaauccgaccuagaacucauucugucugauauggucauggugaaggacuauccaaucgagcuuauagauuuggucaggaaaucgcgcacccugguggacuuucucaauaaguaccuggaagcccgguuaggguacaucgagaacguuauuacuagagugaaaaauagcaucggaacaccgcaguucaagacgguaaggaaggagugcuucgcuuuucugaaagaauccaacuauaccgucgccucacuugauaagcagauugagcgcaucuugaguaugccccucuucauagaacgaggcuuuauggacucuaaaccuacuaugcuggagggcaagagcuaccaacagcacaaagaagauuucgcagacugguuugugcauuauaaggaaaauuccaacuaccagaauuucuaugauacagagguuuacgaaauuaucaccgaggacaagcgggaacaggcgaaagugacaaagaaaaucaagcaacagcagaaaaacgaugucuuuacucuaaugauggugaacuauaugcuggaggaaguacucaagcugccaucaaaugaccgucuuagcuugaacgagcuguaccaaaccaaggaggaaagaauugugaauaaacagguugcuaaggacacgcaggagaggaacaaaaauuacaucuggaacaaggucguggauuuacagcucugugaagggcuggugcgcauugacaaagucaaacuuaaagauauaggaaauuuccggaaguaugagaacgacucuagaguuaaggaauuucugaccuaccaauccgauaucguguggagugguuauuugagcaaugagguggacucuaacaaacucuacguaauugagaggcagcuggauaauuaugaauccauccgaucaaaggagcuacugaaagaaguccaggagauugagugcaucguguacaaccagguugccaauaaggaaagucucaaacaaagcggcaacgagaauuucaagcaguaugugcugcaggggcuuuugccccgcggaacagacguccgggaaaugcugauauuaucgacugaugugaaguuuaaaaaggaggaaaucaugcagcucggccaaguuagagagguggagcaggaccuguacucccuuauuuacaucaggaacaaauucgcacacaaccagcugccuauuaaggaguucuuugauuucugugaaaauaacuaucguccaaucucugacaaugaauacuaugccgaguacuauauggaaauauuucgcagcauuaaagagaaguacgcuucauga

SEQ ID NO: 11304 - RNA, 3480 nt, Artificial Sequence
  Cas13b variant__Myroides odoratimimus__WP_058700060.1__Cas13b
augaaggacauccugaccacagauacuacggagaaacagaacagauucuacagccacaagauugccgacaaauauuucuucggcggguacuuuaaucucgcuuccaacaauauauaugaaguguucgaggaagucaacaagaggaauaccuuuggaaaacuugcaaagcgggauaacgguaaucugaagaacuacaucauucauguuuucaaagacgaguugucuaucucagauuuugaaaagcgcguggccauuuucgcgaguuauuuucccaucuuagagacaguagacaaaaagagcauaaaagagcgaaaucguacuaucgaucugacccuaucccaaagaauuaggcaguuccgggaaaugcucaucucucuggugacagcugucgaccagcuucgcaacuuuuacacccacuaucaucacucggauauugugaucgagaauaagguucuggacuucuugaacagcucauuugugaguacugcccuccaugucaaggauaaauaccugaagacagacaaaaccaaggaauuucugaaagagacgauagcagccgagcucgauauuuuaaucgaggcuuacaagaaaaagcagauugagaagaaaaauacuagauucaaggcaaacaaaagggaagacauccugaaugccaucuauaacgaggcuuuuugguccuucauuaacgacaaggauaaagacaaggauaaggaaaccgugguagccaaaggcgcggacgcauacuuugagaagaaucaccacaaaucuaacgauccugacuucgcccuuaauauaagcgagaaggggaucguuuauuugcuguccuuuuuccuaacaaacaaagaaauggauucacucaaggcuaaucugacuggauuuaagggcaaaguggaccgggagagugguaacagcauuaaguacauggccacccaacgcaucuauucuuuccauacauaccgagggcuuaaacagaagauaagaaccuccgaagagggagucaaagaaacgcuguugaugcagaugauugaugagcucucaaaggugccaaauguggucuaucagcaccugagcacuacacaacagaacaguuuuaucgaggacuggaaugaauacuacaaggauuaugaggacgacguugaaaccgaugacuuaucuagggugacucauccgguaauccggaaacguuacgaggaucgcuucaacuauuuugcaauuagauuccuggacgaauuuuucgauuuccccacacucagguuucaggugcaccuuggcgacuacguccacgaucggcgaaccaagcagcugggcaaaguggaguccgaccgcaucauuaaggagaaaguuacgguguucgcuagauugaaggauauaaauagcgccaaagcgucguauuuucauucucuagaagaacaagacaaggaggaacuggauaacaaguggacccucuucccuaauccauccuacgacuuucccaaagagcacacacugcagcaucagggggaacaaaagaacgccggaaaaaucgguauuuaugucaaacuuagggauacucaguacaaagagaaggcagcucuggaagaggcccggaagucauugaauccuaaagaacgcagugcuaccaaggccagcaaauacgacaucaucacacagauuauagaggcaaacgacaacgugaaguccgagaaaccacucguauucacuggccagcccaucgccuaucugucuaugaaugauauucacagcauguuauuuucacugcuaaccgacaacgcugaacucaagaagacaccugaggaaguugaggcgaaacugaucgaucaaauugggaagcagaucaaugaaauacuuaguaaagacaccgauacuaagaucuugaaaaaguacaaggacaacgaucugaaagagacggacacagauaagauuaccagagaccucgcaagggauaaagaggaaaucgagaagcugauucuugaacagaaacagcgugccgacgauuauaauuacacuuccagcaccaaguucaacaucgacaaaucucggaagcgaaagcaucuguuguuuaaugcugagaaaggaaagauaggcguguggcucgccaacgacauuaaaagauucauguuuaaggaaucaaaaaguaaguggaaggguuaucaacacaucgagcugcagaaauuauucgcauacuuugauacaagcaaguccgaccuggagcuaauucucucuaauauggucauggugaaagauuauccaaucgaacugauagaccuugucaagaaaucgaggaccuugguggauuuccugaacaaguaccucgaggcccgccuggaauacaucgagaauguuauuacucgggugaagaacagcaucgggacaccgcaguucaaaacgguaagaaaggagugcuuuaccuucuuaaagaaguccaauuauacugucgugucacuggacaaacagguugaaaggauucuuaguaugcccuuguuuaucgagcgcggauucauggaugacaagccuacaaugcucgaaggcaagucuuacaaacaacacaaggagaaauuugcugauugguucgugcauuauaaggaaaacagcaauuaccagaacuuuuaugacaccgaggucuacgagauaacaacugaagauaaacgagagaaggccaaggugaccaaaaagauuaaacagcagcaaaagaacgacguauucacgcugaugauggugaauuauaugcuagaagagguucugaaacucuccucaaacgaccggcugagccuuaaugaauuguaccagaccaaggaggagcguaucgucaacaaacagguggcaaaggauacacaagaaagaaauaagaacuacaucuggaauaaaguggucgaccugcaguuaugugauggccucguucacauugacaacgugaagcugaaagauaucgggaauuuuaggaaguaugagaacgacucucgcgugaaagaguuccuuacuuaccaguccgauauuguauggagugcguaucugagcaaugaagucgacucuaacaaguuguacgugauagaacggcagcucgauaauuaugaguccaucagaucaaaggagcugcuaaaagaaguucaagagauugaaugcaguguguacaaccaggucgcuaauaaggagagccugaaacagucgggaaacgagaacuuuaagcaguaugugcuccaaggucugcuuccaaucggcauggacguuagggaaauguugauucuguccaccgaugugaaauucaagaaggaggaaaucauacaguuagggcaggccggagagguagaacaggaccucuacucucugaucuacauucgaaauaaauucgcacauaaccaacuucccaucaaggaguuuuucgauuuuugugagaauaacuaucgcagcauuucagacaaugaauacuaugccgaguacuauauggaaaucuuccggaguauaaaagagaaguacgcuaacuga

SEQ ID NO: 11305 - RNA, 3465 nt, Artificial Sequence
  Cas13b variant__Paludibacter propionicigenes__WP_013446107.1__Cas13b
augaagaccagcgccaacaauaucuacuucaacggcauuaauuccuuuaaaaagauauucgacucuaaaggggcuaucgcacccauugccgagaagucaugcagaaacuuugauaucaaagcgcagaaugacgugaacaaggaacaaaggauucacuauuucgcugucggacauacauuuaagcagcuggauacugagaaucucuucgaauacguucuugacgagaaccugcgggccaaacgcccuacgcgauuuaucaguuugcagcaguucgauaaggaauuuauagagaauaucaaacguuuaauuagcgacaucagaaacauuaauucccacuauauccauagguucgauccacugaagauagacgcagugccgaccaacauuaucgauuuucuaaaagagucuuucgaacucgccguaauucaaaucuaccugaaggagaaggguaucaauuaucuucaguuuucggaaaacccccacgcugaccagaaacugguggcauucuugcaugauaaguuccucccucuggacgagaaaaagacaucaaugcugcagaaugagacuccacaacucaaagaauacaaggaguaucggaaauacuuuaagaccuuaagcaagcaggccgcuauugaucagcugcuuuucgccgaaaaagagacagacuacauauggaacuuguuugacagucaccccguccugaccaucuccgcgggcaaguaucuaucuuucuacagcugucucuuucugcuuuccauguuccuguauaaaucagaagcaaaccaguugauuaguaagaucaaaggguuuaagaagaauacuacagaggaggaaaaauccaagcgcgagauauucaccuuuuucucuaaaagauuuaacuccauggauauugacucagaagagaaucaacucgugaaguucagggaucugaucuuauaccugaaccacuauccuguugccuggaauaaagaccucgaacuugauagcaguaacccagcuaugacggacaagcugaagucuaaaaucauugaguuggagaucaaucgguccuuuccccuauacgaaggaaacgagcgcuucgccacuuucgcaaaguaucagauuuggggcaaaaagcaucuggguaaaagcauagaaaaggaguacaucaaugcuucguuuaccgaugaagagauuacagccuacacuuaugagaccgacacaugcccugaacucaaggaugcgcacaaaaagcuggccgaccuuaaagcagcuaaggggcuguucggaaaacgaaaggagaaaaacgaaucugauaucaagaagaccgagacguccaucagagaguugcagcaugaaccaaauccgauuaaagacaagcucauacaaaggaucgagaaaaaccuguuaacugugucauacggccggaaucaggaccguuuuauggauuucagugcccgcuuucuggcugaaauuaacuauuucggccaggacgccagcuuuaagauguaccacuucuaugcaacagaugagcagaauagcgaacuagagaaauacgagcuccccaaggacaagaaaaaguaugauucucugaaauuucaccaagggaaacuuguccauuucaucagcuacaaagaacacuugaagagauacgagucaugggacgaugccuuugugauugaaaacaacgcuauccagcugaagcucaguuucgacggaguagagaauaccguuacuauacagagggcgcugcuuaucuaucuguuggaagaugcacuccggaacauucagaauaacacagccgagaaugcugguaaacaacuguuacaggaguacuauucccauaacaaggccgaccugagcgcauuuaaacagauccuaacccagcaagauucuauugaaccucagcagaagacggaguucaaaaagcuccugccacgacgccuuuugaauaacuacucacccgccaucaaucaucugcagaccccucacaguagccucccacugauauuagaaaaggcucugcuugccgagaaaagauauuguuccuugguggucaaggcaaaagcggaaggcaacuacgacgauuucauuaagaggaauaaagggaagcaauuuaaacuccaguucauccggaaggcuuggaaccugauguauuuucgcaauucuuaccuacagaacgugcaagccgcaggacaccacaagucguuccauauugagagagacgaguuuaaugacuucagcagguacauguuugccuucgaagaacugucccaguauaaauacuaucucaacgaaauguuugagaagaaaggcuucuuugagaacaaugaguucaagauccuguuccagucagguacaagucuugagaacuuguacgaaaagacuaagcagaaguuugagauauggcuggcuucuaauaccgccaaaacaaacaagcccgauaauuaucacuuaaacaauuacgaacaacaguucagcaaccagcucuuuuucaucaaucugucccauuuuauuaacuaucuuaaaucaacugggaagcugcagaccgacgcaaauggacaaaucauuuacgaggcuuugaacaaugugcaguaccucaucccggaguauuacuauacagauaaaccugaacguagcgagucuaaguccggcaacaagcuguacaauaaacuaaaggccaccaaacuggaagacgcgcuccuguaugagauggccaugugcuaccuuaaggcugauaaacagauagcagacaaggccaagcaccccauuacuaaauugcugacgagugaugucgaguucaacaucacaaacaaggaaggcauccaguuauaucaccuccugguuccauuuaaaaagauugacgcuuucaucgggcuuaaaaugcauaaggagcaacaggauaagaaacacccuaccagcuuucuggccaauauugugaacuaccuagaacucguaaagaaugacaaagauauacggaagacuuacgaggcauucucuaccaaccccgugaaacgaacacugaccuaugacgauuuggcgaagaucgacggacaucugauuuccaaaucaaucaaguuuacuaaugucacauuagaacucgagagauacuucauuuuuaaggaaagucugaucgugaaaaaggguaacaauauagacuucaaauauaucaagggccuuaggaacuacuauaauaacgagaaaaagaagaaugaggggauucgcaacaaagccuuccacuuuggaaucccagauagcaagucguacgaccagcugauucgggaugcugaaguuauguucaucgccaaugaggugaaacccacgcaugcaaccaaguauacugacuugaacaaacaacuccacacagucugugauaagcugauggaaaccgugcacaaugacuacuuuuccaaggagggcgaugguaaaaagaaaagagaggcugccgggcagaaguacuucgaaaacauaauuucugcaaaauga

SEQ ID NO: 11306 - RNA, 3396 nt, Artificial Sequence
  Cas13b variant__Phaeodactylibacter xiamenensis__WP_044218239.1__Cas13b
augaccaacacacccaagagaaggacucugcaccggcauccuagcuacuucggcgccuuucucaauaucgcucgccacaacgcauucaugauuauggagcaucuuuccacgaaauaugacauggaagauaagaauacccuggacgaggcccaguugccaaacgcgaaauuauuugggugccugaagaaacgauacggaaagccggaugugacagaaggugucucucgugaccuaagaagguauuuccccuuucucaauuacccucuguuccuucaccuggagaagcaacagaacgcugaacaggccgcaacuuaugauauaaauccagaggacaucgaguuuaccuugaaaggcuucuuucggcuccugaaccagaugcgcaauaacuacucacauuauauuaguaauacagauuacgggaaguucgacaaacugcccguucaagauaucuacgaagccgcuauuuuuagacucuuagacaggggaaagcacaccaaacgguucgauguguuugagagcaagcacacucgccaucuggaauccaacaauucugaguaucgaccuagaucgcuugcaaacucaccagaccacgagaauacaguagccuucgugaccuguuuguuccuggaaaggaaguacgcuuuucccuuccuaagccggcucgauugcuuucguaguacgaacgacgccgcggagggcgacccucugauccgcaaagcaucccaugaauguuauacuauguucugcuguagacuuccacagccgaagcuggagucuagcgauauauugcucgacauggucaacgaacuggguaggugccccuccgccuuauacaaucugcucucagaggaggaucaggcucgguuucacaucaaacgagaagagauuaccggguucgaagaggacccugaugaggaacuugagcaggaaaucgugcugaagcgccacagugacagauuuccauauuucgccuugagguacuuugaugacacagaggcauuccaaacucuacgguuugauguuuaucugggacgcuggagaaccaaacccguguacaagaaaaggauuuacggccaggaacgugaccggguccucacacagagcauccgaaccuucacgagacugucuaggcuucugccuauauaugagaacgugaagcaugaugcuguacgccagaaugaagaggacggcaaguugguuaacccagacgugacuucccaauuucacaaaucauggauucagaucgagagcgaugaccgggccuuccucagugauagaauugaacauuucucuccccacuacaauuuuggggaccaggucaucggacugaaguucaucaacccggauagguaugcggccauucaaaauguguuuccuaaauuacccggugaggaaaagaaagacaaggaugcaaagcuggugaacgagacagcugacgccauaaucuccacccaugagauucgcagccuauuccucuaccacuaucugucgaaaaagccaaucucugcuggcgaugaacgacgguuuauacaggucgacacugagacauucauuaaacaguacaucgauaccaucaaacuuuucuucgaagacauuaaauccggggaguugcagccuaucgccgaucccccaaauuaucaaaagaacgaaccccugccuuacguucguggagacaaggagaaaacgcaggaggaaagagcacaguacagggagcgccagaaggaaauuaaagagcggagaaaggaacucaauacccugcuucaaaacagguauggccugucaauacaguacaucccaagucgauugcgcgaguaucuccuggguuacaaaaaggugccguaugagaaguuagcccugcagaaacuacgggcucagagaaaggaaguaaagaagaggauuaaagacaucgagaagaugcguacaccccgcgugggggaacaagcgacuuggcucgcagaggauaucgucuuucugaccccuccaaaaaugcacacacccgaacggaagacuaccaagcauccucagaaacuuaauaacgaccaguucagaauuaugcagagcuccuuggccuacuuuucugugaauaagaaagcuauaaagaaauucuuucaaaaggagacaggaaucggccugagcaacagggagaccucacacccauuccucuaucgaauugauguuggccggugucgcgggauccuggacuucuacacuggauacuuaaaguauaaaauggauuggcuggacgaugccauuaagaaaguggacaacagaaagcaugguaaaaaggaagcaaagaaauacgagaaguaucuucccaguuccauccagcacaaaacgccguuggaacucgauuacacaaggcugccugucuaucuaccacggggccuguuuaagaaagccauagugaaggcucucgccgcacacgcggacuuccagguagagcccgaggaagauaauguuaucuuuugccuggaccaacuuuuggauggggacacccaggacuucuacaacuggcagcgauauuacagaagcgcucugacugagaaggaaaccgauaaucaguuagugcucgcccauccuuacgcagagcaaauucugggaacaaucaaaacccuugaaggcaagcagaaaaacaauaagcuggguaacaaagccaagcagaaaauuaaggacgaguugaucgaucucaagcgcgcuaaaaggcgucugcuagaccgggagcaguaucugagagccguccaagcagaagauagggcucucuggcugaugauacaggagcgccagaagcagaaagccgaacacgaggaaauugcguuugaccaacuugauuugaagaauaucacuaaaauucugacagagucuaucgacgcccgauuaagaauacccgauacgaagguggacaucaccgauaagcucccacugcggagguacggggaccuucgccgugucgcuaaagacagacggcuggugaaccuagcaucauauuaccauguugccggccucagugagauuccuuaugaucuggugaagaaagaauuggaggaauacgacaggcgccgaguagcuuucuuugagcacgucuaucaguucgaaaaggagguguacgauagauacgccgcagagcugcggaaugaaaaccccaaaggagagagcacuuauuuuucccauugggaauacguugcgguggccgucaagcacucugcugacacacacuucaaugaguuauuuaaggagaaagugaugcagcucaggaacaaguuccaucacaaugaauuuccauauuuugauuggcugcuuccggagguagaaaaagccucggcagcucuguacgccgaccgcguguucgauguugcagagggcuauuaccaaaagaugagaaaauugaugaggcaguga

SEQ ID NO: 11307 - RNA, 3408 nt, Artificial Sequence
  Cas13b variant__Porohyromonas gingivalis__WP_012458151.1__Cas13b
augaacaccgugcccgccagcgagaauaagggccagucccguacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcuguguuuuucaagccagacgacuuuguuuuggccaaaaaucggaaggagcagcugauuagugucgcagaugguaaagagugccuaacagugagcggguucgccuuuuucaucugucucuuccuggaccgcgaacaggcuucuggaaugcuuucccgaauaagaggcuuuaagaggaccgaugagaacugggcacgggccguacacgaaacuuucugcgaccuguguauccgucauccccacgaucgcuuggagucaagcaauacaaaggaagcucuccuguuagacaugcugaacgagcucaauagaugcccuaggauucuuuaugauaugcugccagaggaggagcgggcccaguuuuugcccgcgcuagacgaaaacaguaugaauaaccugucugaaaauucccucgaugaagagagccgacugcuuugggacggcucgucugauugggcagaggcccugaccaaacgcaucagacaucaagacagguucccuuacuugaugcuccgguuuauugaagagauggaccuguuaaaggggauccgcuucagaguugaucugggagaaauagagcuagacuccuacaguaaaaagguggguaggaacggcgaauaugaucguacgauuacugaccacgcucucgccuuugggaaacugucagauuuccagaacgaggaggaagucagccggaugaucuccggagaggcaucuuacccagugcgauuuagccuuuucgcuccgagauaugccauuuacgacaauaagaucggcuauugucacaccucagaucccguguacccuaaaaguaagacaggugaaaagagggcguuguccaacccacagagcaugggguuuaucucuguccaugaccugcgcaaacuccugcuuauggagcuguugugcgagggaucauucagucggaugcagagcgauuuucucagaaaggccaauaggauucuggacgaaacugcagagggcaaauuacaauucuccgcucuguuccccgaaaugcgccaccgauuuauaccuccacagaaccccaagucuaaagaucggcgugagaaggccgaaaccacacuagagaaguauaaacaggagaucaagggcagaaaagacaagcucaauucgcaacugcuuagcgcuuucgauauggaccagaggcaguugccgucccgccugcucgacgaauggaugaacauucggccugccucacauaguguuaaacugagaaccuacgugaagcaguuaaaugaggauuguaggcugcgacuucgcaaguuucggaaagacggggauggaaaggcaagagccauccccuugguaggugaaauggcuacguuccucucucaagacauagugaggaugauuaucagcgaggaaacuaaaaagcugaucacauccgcguacuauaacgagaugcagcguucacuagcacaguacgccggcgaggaaaaucgccggcaguuuagagcuauugucgccgagcugaggcuccuggauccaagcucugggcacccuuuccuuuccgcaaccauggaaacugcccaucgauauacagagggauuuuacaaaugcuauuuggaaaagaagcgggaguggcuggcuaaaaucuucuaccgccccgagcaagacgaaaacaccaagagaaggauuaguguguuuuucguuccagauggcgaggcccggaaauuacucccccugcuuauacgaagacgcaugaaggaacagaaugaccugcaggauuggaucaggaacaaacaggcacacccuauugacuugccaagccaccucuuugauucuaaggugauggagcugcuaaaagucaaggacgguaagaaaaaguggaaugaggcguucaaagauuggugguccacgaaguauccggacgggaugcaacccuuuuacggccugcgucgggaacucaacauccauggaaaaucagugaguuacaucccuagcgacggcaagaaguucgcugauuguuauacccaccugauggagaaaacaguaagagacaagaaaagggaacuucgcacugccgggaagccaguucccccugauuuggcagccgacauuaaacgaucguuccauagagcugugaaugagcgggaauuuaugcugagguuaguccaggaggaugaccgccucaugcugauggccauaaacaagaugaugaccgaucgugaggaagacauccuuccaggacugaagaacauugauuccauccuagacgaggaaaaucaguucucucucgcagugcacgcuaaaguccuggagaaggaaggugagggcggggauaacagcuugucacuggugcccgccacaauugagaucaaaaguaagagaaaagacugguccaaguacauacgguauagguacgaccgccgaguuccgggauuaaugucucacuuuccugaacauaaggcgacucucgaugaggugaaaacccugcuuggcgaauaugacagaugccggaucaagauuuucgauugggccuuugcucuggagggugcaaucaugagcgacagggauuugaaaccauaccuccacgaauccucaagccgcgaggggaagaguggcgagcauucuacacugguaaaaaugcuagucgaaaagaaaggaugccugacccccgacgagucccaguaucuuauucucaucagaaauaaggccgcucacaaccaauucccuugugccgcagaaaugccccugauauacagggaugugagcgcgaagguuggcucgauugaggggucaucugccaaagacuugccagagggaaguucccugguggauagcuuauggaagaaauacgaaaugaucauucggaagauccucccuauacuggaccccgagaauagauuuuucgguaaacuucugaacaauaugucucagccaaucaacgauuuguga

SEQ ID NO: 11308 - RNA, 3408 nt, Artificial Sequence
  Cas13b variant__Porohyromonas gingivalis__ERJ81987.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacagagcaugggguucaucucugugcaugaccuccgcaaacugcuucugauggaguugcucugcgagggaucauuuagucggaugcagagcggcuuccugagaaaggccaacaggauuuuagaugaaacugcagagggcaaacugcaauuuuccgcucuauuccccgaaaugcgccaccgauucauaccuccacagaaucccaagucuaaagaccggcgugagaaggccgaaaccacacucgagaaguauaaacaggagaucaaggggagaaaagauaagcugaacucgcaacuuuugagcgcuuuugacaugaaucagaggcagcugccgucccgccuccuggaugaauggaugaacauucggccugccucacauagugucaaauuaagaaccuacguuaagcagcugaaugaggacuguaggcuucgauugcgcaaguuccggaaagacggagaugguaaggcaagagccaucccccucgugggcgaaauggcuacguuucugucucaagacauaguaaggaugauuaucagcgaggaaacuaaaaagcuaaucacauccgcguacuauaacgagaugcagcguucacuggcacaguacgccggggaggaaaaucgccggcaguucagagcuauuguggccgagcuccaucugcuugauccaagcucuggacacccuuucuuguccgcaaccauggaaacugcccacagguauacagaggacuucuacaaaugcuaucuggaaaagaagcgagagugguuagcuaaaaccuuuuaccggcccgagcaagaugaaaacacgaagcgcagaaucagugucuucuuugugccagacggcgaggccaggaaacuccugccccuucugauucggcgaagaaugaaggaacagaaugauuugcaggacuggauacgcaacaaacaggcacacccuaucgaucucccaagccaucuguucgacucuaagauuauggagcuacugaaaguuaaggaugguaagaaaaaguggaaugaggcguuuaaagacuggugguccaccaaguauccggaugggaugcaacccuucuacggccucaggcgugaacugaacauccacggaaaaucagugaguuacaucccuagcgacggcaagaaguuugcugacuguuauacacaucuuauggagaaaacuguccaggauaagaaacgggaauugagaaccgccgggaagccagugcccccugaccuggcagccgauauuaaaaggucguuccaccgcgcuguaaacgagcgagaauuuauguuaagacucguucaggaggacgaucggcugaugcuuauggccauaaauaagaugaugacagacagggaggaagauauccugccaggacuaaagaacauugacuccauccucgaugaggaaaaucaguuuucucuggcagugcacgcuaaagucuuggagaaggaaggugagggcggggacaacagccugucauuagugcccgccacuauugagaucaaaaguaagcgcaaagauugguccaaguacauacguuauagauacgaccggagggucccgggacucaugucucauuucccugaacacaaggcgacccuggacgaggugaaaacacuucugggcgaauaugaucgcugccgaaucaagauuuuugacugggccuucgcuuuggagggugcaaucaugagcgauagagaccucaaaccauaccugcaugaauccucaagccgggaggggaagaguggcgagcacucuacccuaguuaaaaugcugguggaaaagaaaggaugccuuacucccgaugagucccaauaucucauucugaucaggaauaaggccgcucauaaccaguuuccuugugccgcagaaaugcccuugauauaccgcgacguaagcgcgaaggucggcucgauugaggggucaucugccaaagaucugccagagggaaguuccuuaguggacagccucuggaagaaauacgaaaugaucauuagaaagauccugccuauacuugaucacgagaauagguucuuugguaaacuguugaacaauaugucucagcccaucaacgaccucuga

SEQ ID NO: 11309 - RNA, 3408 nt, Artificial Sequence
  Cas13b variant__Porohyromonas gingivalis__ERJ65637.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacgcagcaugggguucaucucugugcaugaccuccggaaacugcuucugauggaguugcucugcgagggaucauuuaguagaaugcagagcgauuuccugaggaaggccaaccgcauuuuagacgaaacugcagagggcaaacugcaguuuuccgcucuauuccccgaaaugcgacaccgguucauaccuccacaaaaucccaagucuaaagaucguagagagaaggccgaaaccacacucgagaaguauaaacaggagaucaagggcaggaaagacaagcugaacucgcagcuuuugagcgcuuuugauauggaccaacgccagcugccgucccggcuccuggacgaauggaugaauauuagaccugccucacauagugucaaauuaaggaccuacguuaagcagcugaacgaggauugucgacuucgcuugcagaaguuccggaaagacggggauggaaaggcaagagccaucccccucgugggugaaauggcuacguuucugucucaagacauaguaaggaugauuaucagcgaggaaacuaaaaagcuaaucacauccgcguacuauaaugagaugcagcguucacuggcacaguacgccggcgaggaaaaccgccaccaguuccgggcuauuguggccgagcucagacugcuugauccaagcucugggcauccuuucuuguccgcaaccauggaaacugcccacagguauacagaggacuucuacaaaugcuaucuggaaaagaagcgagagugguuagcuaaaaccuuuuaccggcccgagcaagaugaaaauacgaagcgcagaaucagugucuucuuugugccagacggagaggccaggaaacuccugccccuucugauucggcgaagaaugaaggaacagaacgauuugcaggacuggauacgcaauaaacaggcacacccuaucgaucucccaagccaucuguucgacucuaagauuauggagcuacugaaaguuaaggauggcaagaaaaaguggaacgaggcguuuaaagacuggugguccaccaaguauccggacgguaugcaacccuucuacgggcucaggcgugaacugaauauccacggcaaaucagugaguuacaucccuagcgauggaaagaaguuugcugacuguuauacacaucuuauggagaaaacuguccaggauaagaaacgggaauugagaaccgccggcaagccagugcccccugaccuggcagccgauauuaaaaggucguuccaccgcgcuguaaacgagcgagaauuuauguuaagacucguucaggaggacgaucggcugaugcuuauggccauaaacaagaugaugacagacagggaggaagauauccugccagggcuaaagaauauugacuccauccucgaugaggaaaaccaguuuucucuggcagugcacgcuaaagucuuggagaaggaaggagaggguggcgacaauagccugucauuagugcccgccacuauugagaucaaaaguaagcgcaaagacugguccaaguacauacguuauagauacgaucggagggucccggggcucaugucucauuucccugaacacaaggcgacccuggacgaggugaaaacacuucugggagaauaugaucgcugccgaaucaagauuuuugacugggccuucgcuuuggagggcgcaaucaugagcgauagagaccucaaaccauaccugcaugaauccucaagccgggaggguaagaguggggagcacucuacccuaguuaaaaugcugguggaaaagaaaggcugccuuacucccgaugagucccaauaucucauucugaucaggaacaaggccgcucauaaucaguuuccuugugccgcagaaaugcccuugauauaccgcgacguaagcgcgaaggucggaucgauugagggcucaucugccaaagaucugccagaggggaguuccuuaguggacagccucuggaagaaauacgaaaugaucauuagaaagauccugccuauacuugaucccgagaacagguucuuuggaaaacuguugaauaacaugucucagccaaucaaugaccucuga

SEQ ID NO: 11310 - RNA, 3408 nt, Artificial Sequence
  Cas13b variant__Porohyromonas gingivalis__WP_021665475.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccaacgagaauugggcacgggccgugcacgaaacuuuuugcgacuuguguauccgucauccccacgaucgccucgagucaagcaacacaaaggaagcucuguuacuggacaugcucaaugagcuuaacagaugcccuaggauucuguaugauauguugccagaggaagaacgggcccaguuccuacccgcgcuggacgaaaauaguaugaacaaucucucugagaacucccugaacgaagagagccgacuucugugggauggcucgucugacugggcagaggccuugaccaaacgcaucagacaucaagauagguuuccuuaccucaugcugcgguucauugaagagauggacuuacugaaggggauccgcuuuagaguagaccuaggagaaauagagcucgauuccuacaguaaaaagguugguaggaauggcgaauaugaccguacgauuacugaucacgcucuggccuucgggaaacuuucagacuuucagaacgaggaggaagugagccggaugaucuccggagaggcaucuuacccaguccgauucagcuuguuugcuccgagauaugccauuuacgauaauaagaucggcuauugucacaccucagaccccguguacccuaaaaguaagacaggugaaaagagggcgcuguccaacccacagagcaugggguucaucucugugcaugaucuccgcaaacugcuucugauggaguugcucugcgagggaucauuuagucggaugcagagcggcuuccugagaaaggccaauaggauuuuagacgaaacugcagagggcaaacugcaauuuuccgcucuauuccccgaaaugcgccaccgauucauaccuccacagaaccccaagucuaaagaucggcgugagaaggccgaaaccacacucgagaaguauaaacaggagaucaaggggagaaaagacaagcugaacucgcaacuuuugagcgcuuuugauaugaaucagaggcagcugccgucccgccuccuggacgaauggaugaauauucggccugccucacauagugucaaauuaagaaccuacguuaagcagcugaacgaggauuguaggcuucgauugcgcaaguuccggaaagacggagacgguaaggcaagagccaucccccucgugggcgaaauggcuacguuucugucucaagauauaguaaggaugauuaucagcgaggaaacuaaaaagcuaaucacauccgcguacuauaaugagaugcagcguucacuggcacaguacgccggggaggaaaaccgccggcaguucagagcuauuguggccgagcuccacuugcuugacccaagcucuggacauccuuuucuguccgcaaccauggaaacugcccacagguauacagaggauuucuacaaaugcuaucuggaaaagaagcgagagugguuagcuaaaaccuuuuaccggcccgagcaagacgaaaauacgaagcgcagaaucagugucuucuuugugccagauggcgaggccaggaaacuccugccccuucugauucggcgaagaaugaaggaacagaacgacuugcaggauuggauacgcaauaaacaggcacacccuaucgaccucccaagccaucuguucgauucuaagauuauggagcuacugaaaguuaaggacgguaagaaaaaguggaacgaggcguuuaaagauuggugguccaccaaguauccggacgggaugcaacccuucuacggccucaggcgugaacugaacauccacggaaaaucagugaguuacaucccuagcgauggcaagaaguuugcugacuguuauacacaucuuauggagaaaacuguccaggacaagaaacgggaauugagaaccgccgggaagccagugcccccugaucuggcagccgacauuaaaaggucguuccaccgcgcuguaaaugagcgagaguucauguuaagacucguucaggaggaugaccggcugaugcuuauggccauaaacaagaugaugacagauagggaggaagacauccugccaggacuaaagaauauugauuccauccucgacaaagagaaccaguuuucucuggcagugcacgcuaaggucuuggaaaaagagggugaaggcggggauaauagccugucauuagugcccgccacuauugagaucaagaguaaacgcaaggacugguccaaguacauacguuauagauacgaucggagggucccgggacucaugucucauuucccugagcacaaagcgacccuggacgaagugaagacacuucugggcgaguaugaccgcugccgaaucaaaauuuuugauugggccuucgcuuuggaaggugcaaucaugagcgacagagaucucaagccauaccugcaugaguccucaagccgggaagggaaaaguggcgagcacucuacccuaguuaagaugcugguggagaaaaagggaugccuuacucccgacgaaucccaauaucucauucugaucaggaacaaggccgcucauaaucaguuuccuugugccgcagagaugcccuugauauaccgcgauguaagcgcgaaagucggcucgauugaagggucaucugccaaggaccugccagagggaaguuccuuaguggauagccucuggaaaaaguacgagaugaucauuagaaaaauccugccuauacuugaccacgaaaacagguucuuugguaagcuguugaauaacaugucucagcccaucaaugaucucuga

SEQ ID NO: 11311 - RNA, 3408 nt, Artificial Sequence
  Cas13b variant__Porohyromonas gingivalis__WP_061156637.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacagagcaugggguucaucucugugcaugaccuccgcaaacugcuucugauggaguugcucugcgagggaucauuuagucggaugcagagcggcuuccugagaaaggccaacaggauuuuagaugaaacugcagagggcaaacugcaauuuuccgcucuauuccccgaaaugcgccaccgauucauaccuccacagaaucccaagucuaaagaccggcgugagaaggccgaaaccacacucgagaaguauaaacaggagaucaaggggagaaaagauaagcugaacucgcaacuuuugagcgcuuuugacaugaaucagaggcagcugccgucccgccuccuggaugaauggaugaacauucggccugccucacauagugucaaauuaagaaccuacguuaagcagcugaaugaggacuguaggcuucgauugcgcaaguuccggaaagacggagaugguaaggcaagagccaucccccucgugggcgaaauggcuacguuucugucucaagacauaguaaggaugauuaucagcgaggaaacuaaaaagcuaaucacauccgcguacuauaacgagaugcagcguucacuggcacaguacgccggggaggaaaaucgccggcaguucagagcuauuguggccgagcuccaucugcuugauccaagcucuggacacccuuucuuguccgcaaccauggaaacugcccacagguauacagaggacuucuacaaaugcuaucuggaaaagaagcgagagugguuagcuaaaaccuuuuaccggcccgagcaagaugaaaacacgaagcgcagaaucagugucuucuuugugccagacggcgaggccaggaaacuccugccccuucugauucggcgaagaaugaaggaacagaaugauuugcaggacuggauacgcaacaaacaggcacacccuaucgaucucccaagccaucuguucgacucuaagauuauggagcuacugaaaguuaaggaugguaagaaaaaguggaaugaggcguuuaaagacuggugguccaccaaguauccggaugggaugcaacccuucuacggccucaggcgugaacugaacauccacggaaaaucagugaguuacaucccuagcgacggcaagaaguuugcugacuguuauacacaucuuauggagaaaacuguccaggauaagaaacgggaauugagaaccgccgggaagccagugcccccugaccuggcagccgauauuaaaaggucguuccaccgcgcuguaaacgagcgagaauuuauguuaagacucguucaggaggacgaucggcugaugcuuauggccauaaauaagaugaugacagacagggaggaagauauccugccaggacuaaagaacauugacuccauccucgauaaagagaaucaguuuucucuggcagugcacgcuaaggucuuggaaaaagagggugaaggcggggacaacagccugucauuagugcccgccacuauugagaucaagaguaaacgcaaggauugguccaaguacauacguuauagauacgaccggagggucccgggacucaugucucauuucccugagcacaaagcgacccuggacgaagugaagacacuucugggcgaguaugaucgcugccgaaucaaaauuuuugacugggccuucgcuuuggaaggugcaaucaugagcgauagagaccucaagccauaccugcaugaguccucaagccgggaagggaaaaguggcgagcacucuacccuaguuaagaugcugguggagaaaaagggaugccuuacucccgaugaaucccaauaucucauucugaucaggaauaaggccgcucauaaccaguuuccuugugccgcagagaugcccuugauauaccgcgacguaagcgcgaaagucggcucgauugaagggucaucugccaaggaucugccagagggaaguuccuuaguggacagccucuggaaaaaguacgagaugaucauuagaaaaauccugccuauacuugaucccgaaaauagguucuuugguaagcuguugaacaauaugucucagccaaucaacgaccucuga

SEQ ID NO: 11312 - RNA, 3408 nt, Artificial Sequence
  Cas13b variant__Porohyromonas gingivalis__WP_023846767.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacgcagcaugggguucaucucugugcaugaccuccggaaacugcuucugauggaguugcucugcgagggaucauuuaguagaaugcagagcgauuuccugaggaaggccaaccgcauuuuagacgaaacugcagagggcaaacugcaguuuuccgcucuauuccccgaaaugcgacaccgguucauaccuccacaaaaucccaagucuaaagaucguagagagaaggccgaaaccacacucgagaaguauaaacaggagaucaagggcaggaaagacaagcugaacucgcagcuuuugagcgcuuuugauaugaaucaacgccagcugccgucccggcuccuggacgaauggaugaacauuagaccugccucacauagugucaaauuaaggaccuacguuaagcagcugaaugaggacugucgacuucgcuugcggaaguucagaaaagauggggacggaaaggcaagggccaucccccucgugggugaaauggcuacguuucugucucaggauauaguacguaugauuaucagcgaggaaacuaaaaagcuaaucacauccgcguacuauaacgagaugcaacgcucacuggcacaguacgccggcgaggaaaaucggagacaguucagggcuauuguggccgagcuccaucugcuugacccaagcucugggcacccuuucuuguccgcaaccauggaaacugcccaccgauauacagaggauuucuacaaaugcuaucuggaaaagaagcgggagugguuagcuaaaaccuuuuaccgccccgagcaggacgaaaacacgaagagaaggaucagugucuucuuugugccagauggagaggcccggaaacuccugccccuucugauucgaagacgcaugaaggaacaaaaugacuugcaggauuggauaaggaacaaacaggcacacccuaucgaccucccaagccaucuguucgauucuaagauuauggagcuacugaaaguuaaggacggcaagaaaaaguggaaugaggcguuuaaagauuggugguccaccaaguauccggacgguaugcagcccuucuacgggcuccgucgggaacugaacauccacggcaaaucagugaguuacaucccuagcgacggaaagaaguuugcugauuguuauacacaucuuauggagaaaacuguccaagacaagaaaagagaauugaggaccgccggcaagccagugcccccugaucuggcagccgacauuaaacgcucguuccaccgagcuguaaacgagagagaauuuauguuacggcucguucaggaggaugacaggcugaugcuuauggccauaaauaagaugaugacagaucgcgaggaagacauccugccagggcuaaagaacauugauuccauccucgacgaggaaaaucaguuuucucuggcagugcacgcuaaagucuuggagaaggaaggagaggguggcgauaacagccugucauuagugcccgccacuauugagaucaaaaguaagcguaaagacugguccaaguacauaagauaucgguacgacaggcgcgucccggggcucaugucucauuucccugaacacaaggcgacccuggaugaggugaaaacacuucugggagaauaugaccgaugcagaaucaagauuuuugauugggccuucgcuuuggagggcgcaaucaugagcgaccgggaucucaaaccauaccugcaugaauccucaagcagggaggguaagaguggggagcacucuacccuaguuaaaaugcugguggaaaagaaaggcugccuuacucccgacgagucccaguaucucauucugauccgcaauaaggccgcucauaaccaauuuccuugugccgcagaaaugcccuugauauacagagauguaagcgcgaaggucggaucgauugagggcucaucugccaaagaccugccagaggggaguuccuuaguggauagccucuggaagaaauacgaaaugaucauuaggaagauccugccuauacuugaccccgagaaucgguucuuuggaaaacuguugaacaauaugucucagccaaucaacgaucucuga

SEQ ID NO: 11313 - RNA, 3408 nt, Artificial Sequence
  Cas13b variant__Porohyromonas gingivalis__ERJ87335.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacgcagcaugggguucaucucugugcaugaccuccggaaacugcuucugauggaguugcucugcgagggaucauuuaguagaaugcagagcgauuuccugaggaaggccaaccgcauuuuagacgaaacugcagagggcaaacugcaguuuuccgcucuauuccccgaaaugcgacaccgguucauaccuccacaaaaucccaagucuaaagaucguagagagaaggccgaaaccacacucgagaaguauaaacaggagaucaagggcaggaaagacaagcugaacucgcagcuuuugagcgcuuuugauauggaccaacgccagcugccgucccggcuccuggacgaauggaugaauauuagaccugccucacauagugucaaauuaaggaccuacguuaagcagcugaacgaggauugucgacuucgcuugcagaaguuccggaaagacggggauggaaaggcaagagccaucccccucgugggugaaauggcuacguuucugucucaagacauaguaaggaugauuaucagcgaggaaacuaaaaagcuaaucacauccgcguacuauaaugagaugcagcguucacuggcacaguacgccggcgaggaaaaccgccaccaguuccgggcuauuguggccgagcucagacugcuugauccaagcucugggcauccuuucuuguccgcaaccauggaaacugcccacagguauacagaggacuucuacaaaugcuaucuggaaaagaagcgagagugguuagcuaaaaccuuuuaccggcccgagcaagaugaaaauacgaagcgcagaaucagugucuucuuugugccagacggagaggccaggaaacuccugccccuucugauucggcgaagaaugaaggaacagaacgauuugcaggacuggauacgcaauaaacaggcacacccuaucgaucucccaagccaucuguucgacucuaagguuauggagcuacugaaagugaaggauggcaagaaaaaguggaacgaggcguuuaaagacuggugguccaccaaguauccggacgguaugcaacccuucuacgggcucaggcgugaacugaauauucacggcaaaucagucaguuacaucccuagcgauggaaagaaguuugcugacuguuauacacaucuuauggagaaaacugugcgggauaagaaaagagaauugaggaccgccggcaagccaguacccccugaccuggcagccuacaucaaacgcucguuccaccgagcuguuaacgagagagaauuuauguuacggcucgugcaggaggaugacaggcugaugcuuauggccauuaacaagauaaugacagaucgcgaggaagacauccugccagggcuaaagaauauugauuccauccucgacaaagagaaccaguuuucucuggcaguccacgcuaagguguuggaaaaagagggagaagguggcgauaauagccugucauuaguccccgccacuauugagaucaagaguaaacguaaggacugguccaaguauauaagauaccgguaugacaggcgcgugccggggcucaugucucauuucccugagcacaaagcgacccuggaugaaguuaagacacuucugggagaguacgaccgaugcagaaucaaaauuuuugauugggccuucgcuuuggaaggcgcaaucaugagcgaccgggaucucaagccauaucugcaugaguccucaagcagggaagguaaaaguggggagcacucuacccuagugaagaugcugguagagaaaaagggcugccuuacucccgacgaaucccaguaccucauucugauccgcaacaaggccgcucauaaucaauuuccuugugccgcagagauacccuugauuuacagagaugucagcgcgaaagugggaucgaucgaaggcucaucugccaaggaccugccagaggggaguuccuuaguugauagccucuggaaaaaguaugagaugauuaucaggaaaauacugccuauccuugaccccgaaaaccgguucuuuggaaagcuguugaauaacaugucucagccaauuaaugaucucuga

SEQ ID NO: 11314 - RNA, 3408 nt, Artificial Sequence
  Cas13b variant__Porohyromonas gingivalis__WP_005873511.1__Cas13b
augaacaccgugcccgccagcgagaauaagggccaguccagaacagucgaagacgauccucaauacuucgggcuguaucucaaccuugcuagggagaaucugaucgaaguugagucucacgugcggauuaaauuuggaaagaaaaaguugaacgaagagucauuaaaacagagucugcuaugcgaccaucuccugagcguagaucgcuggacuaagguguacggucacucccgacguuaucuuccauuccugcauuacuuugacccggauucucagauagagaaggaccacgauucgaaaacgggcgucgaccccgauucagcacagagauugaucagggaacucuauagccugcuggacuuccuccggaaugauuuuagucauaaccgcuuagacgggaccacauucgagcaccuggaaguguccccugauauuucuagcuuuaucacuggaaccuacucccuugccuguggcagagcgcaaucaagguucgcugacuuuuucaagccagacgauuuuguuuuggccaaaaaucggaaggagcagcugauuaguguggcagacgguaaagagugccuaacagucagcgggcucgccuucuuuaucugucuguuccuugaucgcgaacaggcuucuggaaugcugucccgaauaagaggcuucaagaggaccgacgagaacugggcacgggccgugcacgaaacuuuuugcgauuuguguauccgucauccccacgaccgccucgagucaagcaauacaaaggaagcucuguuacuggauaugcucaacgagcuuaauagaugcccuaggauucuguaugacauguugccagaggaggagcgggcccaguuccuacccgcgcuggaugaaaacaguaugaauaaccucucugaaaauucccugaacgaagagagccgacuucugugggacggcucgucugauugggcagaggccuugaccaaacgcaucagacaucaagacagguuuccuuaccucaugcugcgguucauugaagagauggacuuacugaaggggauccgcuuuagaguagaucuaggagaaauagagcucgacuccuacaguaaaaagguugguaggaacggcgaauaugaucguacgauuacugaccacgcucuggccuucgggaaacuuucagauuuucagaaugaggaggaagugagccggaugaucuccggagaggcaucuuacccaguccgauucagcuuguuugcuccgagauaugccauuuacgacaacaagaucggcuauugucacaccucagaucccguguacccuaaaaguaagacaggugaaaagagggcgcuguccaauccacagagcaugggguucaucucugugcauaaccuccgcaaacugcuucugauggaguugcucugcgagggaucauuuagucggaugcagagcgacuuccugagaaaggccaauaggauuuuagaugaaacugcagagggcaaacugcaauuuuccgcucuauuccccgaaaugcgccaccgauucauaccuccacagaaccccaagucuaaagaccggcgugagaaggccgaaaccacacucgagaaguauaaacaggagaucaagggcagaaaagauaagcugaacucgcaacuuuugagcgcuuuugacaugaaucagaggcagcugccgucccgccuccuggaugaauggaugaauauucggccugccucacauagugucaaauuaagaaccuacguuaagcagcugaacgaggacuguaggcuucgauugcgcaaguuccggaaagacggggauggaaaggcaagagccaucccccucgugggugaaauggcuacguuucugucucaagacauaguaaggaugauuaucagcgaggaaacuaaaaagcuaaucacauccgcguacuauaaugagaugcagcguucacuggcacaguacgccggcgaggaaaaccgccggcaguucagagcuauuguggccgagcuccaucugcuugauccaagcucugggcacccuuucuuguccgcaaccauggaaacugcccacagguauacagaggacuucuacaaaugcuaucuggaaaagaagcgagagugguuagcuaaaaccuuuuaccggcccgagcaagaugaaaauacgaagcgcagaaucagugucuucuuugugccagacggagaggccaggaaacuccugccccuucugauucggcgaagaaugaaggaacagaacgauuugcaggacuggauacgcaauaaacaggcacacccuaucgaucucccaagccaucuguucgacucuaagauuauggagcuacugaaaguuaaggauggcaagaaaaaguggaacgaggcguuuaaagacuggugguccaccaaguauccggaugguaugcaacccuucuacgggcucaggcgugaacugaacauccacggcaaaucagugaguuacaucccuagcgacggaaagaaguuugcugacuguuauacacaucuuauggagaaaacuguccaggauaagaaacgggaauugagaaccgccggcaagccagugcccccugaccuggcagccgauauuaaaaggucguuccaccgcgcuguaaaugagcgagaauuuauguuaagacucguucaggaggacgaucggcugaugcuuauggccauaaacaagaugaugacagacagggaggaagauauccugccagggcuaaagaauauugacuccauccucgaugaggaaaaccaguuuucucuggcagugcacgcuaaagucuuggagaaggaaggagaggguggcgacaauagccugucauuagugcccgccacuauugagaucaaaaguaagcgcaaagauugguccaaguacauacguuauagauacgaccggagggucccggggcucaugucucauuucccugaacacaaggcgacccuggacgaggugaaaacacuucugggagaauaugaucgcugccgaaucaagauuuuugacugggccuucgcuuuggagggcgcaaucaugagcgauagagaccucaaaccauaccugcaugaauccucaagccgggaggguaagaguggggagcacucuacccuaguuaaaaugcugguggaaaagaaaggcugccuuacucccgaugagucccaauaucucauucugaucaggaacaaggccgcucauaaucaguuuccuugugccgcagaaaugcccuugauauaccgcgacguaagcgcgaaggucggaucgauugagggcucaucugccaaagaucugccagaggggaguuccuuaguggacagccucuggaagaaauacgaaaugaucauuagaaagauccugccuauacuugaucccgagaacagguucuuuggaaaacuguugaauaacaugucucagccaaucaaugaccucuga

SEQ ID NO: 11315 - RNA, 3408 nt, Artificial Sequence
  Cas13b variant__Porohyromonas gulae__WP_039445055.1__Cas13b
augaacaccgugcccgccacagagaauaagggccagagcagaacugucgaagacgauccucaauacuucgggcuguaucucaaccuugcuagggagaaucugaucgaaguugagucccacgugcggauuaaauuuggaaagaaaaaguugaacgaagagucuuuaaaacagucacugcuaugcgaccaucuccugaguauagaucgcuggacgaagguauacggucacagccgacguuaucuuccauuccugcauuguuuugacccggauuccggcaucgagaaggaccacgauucuaaaaccgggguggaccccgauucggcacagagauugauuagggaacucuacucacugcuggacuuccuccggaaugauuuuagccauaaccgcuuagacggaacaacuuucgagcaccugaaggucaguccugauaucuccucuuuuauuaccggcgccuauacauucgcgugcgaaagagcucagagcagguuugccgacuucuuuaaaccagacgauuuccuuuuggcaaagaaucggaaagagcaacugaucuccguggccgacgguaaggagugucuaaccguuucaggguuugcuuucuucauaugccucuuucuggaucgcgaacaggcaaguggaaugcuuagccgaaucagaggcuucaagaggacugacgagaacugggcccgggcugugcacgaaacauuuugugaucugugcauucgucauccccacgaccgcuuggagucuuccaauaccaaagaagcccuccuguuagauaugcugaacgagcucaauagauguccuaggauccuuuacgacaugcugccagaggaagaacgggcgcaguucuugcccgcacuagaugaaaacucaaugaauaaccugagcgagaauagucucaacgaagagucucgacugcuuugggacggcuccagcgauugggccgaggcucugacgaagcgcauuagacaucaggacagguuuccuuauuugaugcuccgguucaucgaagagauggaccuguuaaaagggauacgcuuuagagucgaucugggagaaauugagcuagacucguacucuaagaaaguggguaggaacggcgaauacgaucguacuaucaccgaccacgcccucgcauucgggaagcuguccgauuuucaaaaugaggaggaaguaucacggaugauuaguggagaggcuagcuauccaguucgauucucccuuuuugccccgagauacgcgaucuaugacaacaaaaucggcuacugccacacaucugaucccguguauccuaagagcaagacuggugaaaagagggccuugucaaauccacagaguaugggguucauuuccguccaugaccugcgcaagcuccugcuuauggagcuguugugugagggcagcuuuucucggaugcagucagauuuccucagaaaagcaaacaggauacuggacgaaaccgcugagggaaaguuacaguucagugcccuguuucccgaaaugcgccaccgauucaucccuccacaaaaucccaaaagcaaggaucggcgugagaaggcugaaacaacccuagagaaauacaagcaggagauuaaaggcagaaaggacaaacucaacucccagcugcuuucugccuuugauaugaaucaaaggcaguugccgucgcgccugcucgacgaauggaugaacauccggccugcaagccauuccgugaagcugagaacguaugugaagcaguuaaaugaggacugcaggcugcgacuucgcaaauuccggaaggauggggacggaaaagccagagcuauacccuuggucggugaaauggcgacuuuucucucacaggauauuguuaggaugaucaucagugaggaaacaaagaaacugauuaccucugcauacuacaacgagaugcaacguagccuagcccaguaugcuggcgaggaaaaucgccggcaguucagagccaucguggcagagcugcaccuccuggacccauccucagggcauccuuuucuuagcgccacuauggaaacagcucacagguacaccgaggauuucuauaaguguuacuuggaaaagaaacgagaguggcuggccaagacguuuuaucggcccgagcaggacgaaaacaccaaacgcagaauuucuguauucuuugugccagauggagaggcaaggaaguuacucccccugcuuauacggcgaagaaugaaagaacaaaaugaccugcaggauuggauccgcaacaagcaggcgcacccuauugacuugccaucccaucucuucgauaguaaaaucauggagcugcuaaaggucaaggacggcaaaaagaaauggaaugaggcuuuuaaggauugguggagcacaaaauacccggacgguaugcagcccuucuaugggcugaggcgugaacucaacauccacggcaagucuguguccuacauuccuucagacggaaagaaauucgccgauugcuacacucaucugauggagaagaccguucgggacaaaaagagagaacuuaggacagcaggcaaaccagugcccccugauuuggccgcuuauauaaagcgcaguuuucaccgagccgucaacgagagagaguucaugcugcgguuagugcaagaggacgauaggcucaugcugauggcaaucaauaagaugaugacugaccgcgaggaagauauucuuccagggcugaaaaacaucgacagcauucuagaugaggaaaaucaguuuucgcucgcuguacacgccaagguucuggagaaagaaggagaggguggcgacaacuccuugucucuggugcccgcgaccaucgagauaaagagcaaacguaaggauuggucaaaguacaucagauaucgguacgacaggcgcgucccgggguuaaugagucauuucccugaacacaaagccacacucgacgaggugaagacccugcuuggagaauaugaucgaugcagaauuaaaaucuuugacugggcuuucgcacuggagggcgccauuauguccgaucgggacuugaagccauaccuccaugaaucuagcuccagggaggguaaaucaggggagcacagcacucuggucaagaugcuaguggagaaaaagggcugucugacgcccgaugaaagucaguaucuuauccucauacgcaauaaggcugcccauaaccaguuuccuugcgcagcggaaaugccccugauuuacagagacguuucugccaaagugggauccaucgagggcagcucggcuaaggauuugccagaggggucaucucugguagacaguuuauggaaaaaguacgaaaugauuaucaggaaaauacucccuauccuggaucacgagaaucgguucuuuggaaaacuucugaacaauaugucccaacccauuaacgacuuguga

SEQ ID NO: 11316 - RNA, 3528 nt, Artificial Sequence
  Cas13b variant__Porphyromonas gingivalis__WP_052912312.1__Cas13b
augaccgagcagaacgaaaagcccuacaauggcacauauuacacucuggaggacaaacacuucugggccgcauuuuucaaccucgcuagacauaaugccuauaucacgcuugcgcacauugauaggcaacuggcuuacagcaaggccgacauaaccaacgaugaagacaucuuguuuuucaaagggcaguggaagaauuuagauaacgaccuggagcggaaagcacgccuacgaucccucauucugaagcauuuuucuuuccuugaaggagccgcuuaugguaagaaacuguuugagucacagaguagcggcaauaaguccucuaaaaagaaagaguugacaaagaaggaaaaagaggaacuccaggcaaacgcccugucgcuggauaaucucaagucaaucuuauucgacuuucugcaaaaacuuaaggauuuccguaacuacuauagccacuacagacauccugagaguuccgaguugccacuguuugacgggaauaugcuacagaggcucuacaacguguucgaugucucuguucagcgggugaaacgcgaccacgaacacaaugauaagguagacccgcauagacacuuuaaccaucuggugaggaaaggaaagaaggacaaauauggcaauaacgauaaccccuucuucaagcaccacuuugucgaccgggaggaaaaagugacugaggcuggucuucuguucuuuguuagcuuguuccucgaaaagcgcgaugccauuuggaugcagaaaaagauccgaggguuuaagggaggcaccgaggcguaccaacagaugacaaaugagguguucugcagauccaggauaucacugccuaaauuaaagcuggaaagucuccggaccgacgauuggaugcuucuggacauguugaacgagcuaguccguuguccaaaacugcucuaugaucgccugagagaagaggacagggcacgguuucgagugcccguagauauccuuagcgacgaagaugacacugacggcacagaggaggauccuuucaagaauacccugguucgccaucaggacagauuuccauacuucgccuugagguauuuugaucucaaaaagguguucacgucucugcgguuucacauugacuuagggacuuaccauuucgcuaucuauaagaaaaacauuggagaacagcccgaggaucgccaccugaccagaaaucuauacgguuucggcaggauccaagacuuugccgaggaacaucguccugaagaguggaagcggcucguccgagaucuggacuacuucgagacaggggauaaaccauauauaacucagaccacaccgcacuaccacauugaaaagggaaaaaucggccuuagauuugugcccgagggucaguugcuguggccuuccccagaagugggggcaaccaggacgggacgcucaaaguaugcucaagacaagcgguucacugccgaggcguuucucagcguccaugagcugaugcccaugauguucuacuauuuucuucugagagaaaaauacagugaggaagccucugcagagaagguucagggcaggauuaaacgcgugaucgaagauguauaugcuguguacgacgccuucgcucgagaugagaucaacacacgggacgaguuggacgccugccucgcagauaagggcauucguagagggcaucugccuaggcagaugauagccaucuuaucccaggaacacaaagacauggaggaaaagguccgcaaaaagcugcaagagaugauugcugauaccgaccaccggcuagauaugcucgacagacagacugauaggaagauccgaauaggacgcaaaaaugcgggucugccaaagagcggcgugauugcagacuggcuuguucgggauaugaugagauuucagcccguggccaaagacacaucggggaagccguugaacaauucuaaagcuaacuccaccgaauacaggaugcugcagcgugcccucgcacuguucggaggcgagaaggagcgcuuaacgccuuauuuucggcaaaugaaucugaccggugggaacaauccccacccauuccuucaugaaacaagaugggagucacacacuaacaucuugaguuuuuacaggagcuaucucaaggcccgaaaggcuuuccugcaguccaucggccggucugaucgcgaagagaaucauagauuccuacugcucaaggaaccuaaaaccgacaggcagacacuggucgccggauggaaaagcgaguuucaccuuccccggggcauuuucacugaggcagugcgagauuguuugaucgaaaugggguacgacgagguaggaucauauaaagaaguugguuuuauggcgaaggcugugccacuguacuucgagagagccugcaaggaccgcguccagcccuuuuaugauuacccuuucaacgugggcaacaguuuaaaaccaaagaaagggagguuucucuccaaggagaaacgugcagaagagugggaaagcggaaaggagcgguucagagaccuggaagccuggucucauucagcugccaggcgcauugaggaugcauuugucggcauagaguacgcuaguugggaaaauaagaaaaagaucgagcaacuucugcaggacuugagccucugggaaaccuucgaguccaaacugaaggugaaagccgauaagauuaacaucgcgaaacuaaagaaggaaauccuggaggccaaagagcacccguaucacgacuuuaagucuuggcagaaauucgaacgagagcucagacugguuaagaaucaggauauuauaacauggaugaugugucgggaccuuauggaagagaacaaaguggaagguuuggauaccgggacucuguacuuaaaggacaucaggacggauguacaagagcagggcucgcucaauguccugaaccaugugaagcccaugcgccuuccuguuguggucuaucgugcugacagcagaggacacgugcauaaagaggaagcaccacuggccacaguauacauugaggaacgggacaccaagcuacucaaacagggcaauuucaaguccuuugugaaagauaggcgccugaacggguuguucucauuuguugacacuggagcucuggccauggagcaauaucccaucaguaaguuacgagucgaguacgaacucgcaaaguaucagaccgcgagagugugcgccuucgagcagacacuggaacuugaggaaucucuguugacccgguacccucaccucccagaugagagcuuuagggagaugcuggaauccuggucagacccccuacuggauaaauggccggaccuucagcgcgaggugagacuccugauugcugucaggaaugccuucagccauaaccaauacccuauguaugaugaaacuaucuuuucuuccauacggaaguacgacccaaguagcuuggaugcaaucgaggaacguaugggucugaauauugcucaccgcuuaucugaggagguuaaacucgccaaggaaaugguggagcgaaucauucaggcauga

SEQ ID NO: 11317 - RNA, 3360 nt, Artificial Sequence
  Cas13b variant__Porphyromonas gingivalis__WP_053444417.1__Cas13b
augaccgagcagaacgaaaagcccuacaauggcacauauuacacucuggaggacaaacacuucugggccgcuuuucucaaccuugcaagacauaaugccuauaucacgcuggcgcacauugauaggcaauuggcuuacagcaaggccgacauaaccaacgaugaagacaucuuauucuuuaaagggcaguggaagaaucuggauaacgaccuagagcggaaagcacgccuccgaucccugauucuuaagcauuucucuuuucuggaaggagccgcuuaugguaagaaauuguucgagucacagaguagcggcaauaaguccucuaaaaagaaagagcucucgaagaaggaaaaagaggaacugcaggcaaacgcccugucacucgauaauuuaaagagcauccuguuugacuuccuucaaaaauugaaggauuuucguaacuacuauagucacuacagacauccugaguccucugagcugccacuauucgacgggaauaugcuccagaggcuguacaacguguuugaugucagcguucagcgggugaaacgcgaccacgaacacaaugauaagguagacccgcauagacacuucaaccaucuugugaggaaaggaaagaaggacaaauauggcaauaacgauaaccccuuuuucaagcaccacuucgucgaccgggaggguacagugacugaagcugggcuguuguuuuucguuucccucuuucuggagaaacgcgaugccauuuggaugcagaagaaaauccgaggauucaagggcggcaccgaagcguaccaacagaugacaaaugagguguuuugcagaucaaggauaaguuuaccuaagcugaaacucgagagccuucggaccgacgauuggaugcuguuggacaugcuaaacgaacugguccguuguccaaagucucucuaugaucgccugagagaggaagacagggcacgguuccgagugcccguagauauccuuuccgacgaggaugacacugacgggacagaagaggauccuuuuaaaaauacccugguucgccaucaggacagauucccauacuuugccuugagguauuucgaucucaagaaaguguuuacgucacugcgguuccacauugacuuaggaacuuaccauuuugcuaucuauaagaagaacauuggugagcagcccgaagaucgccaccugaccagaaaucuauacggcuucgggaggauccaagacuucgccgaggaacaucguccugaggaauggaaacggcucguccgagaucuggacuacuuugagacaggagauaagccauauauaacucagaccacaccgcacuaccacauugagaaaggcaagaucggucuuagauucgugcccgaagggcagcauuuguggccuagcccagaggugggagcaaccaggacgggccgcaguaaauaugcucaagacaagcggcugacugccgaagcguuucucucuguccacgagcugaugcccaugauguucuacuauuuucuucugagagagaaguacuccgaagagguuagcgccgaaaaagugcagggcaggauuaagcgcguaaucgaggauguguaugcagucuacgacgcuuucgcccgagaugaaaucaacacacgggacgaguuggacgcuugccucgccgauaaagggauucguagaggacaucugccuaggcagaugauagcaaucuuaucgcaggagcacaaggacauggaagagaaagugcgcaagaaacugcaagaaaugauugccgauaccgaccaccggcuagauaugcucgacagacagacugauaggaagauccgaauaggucgcaagaaugcuggccugccaaaaucugggguuguggcggacuggcuuguccgggauaugaugagauuucagcccguggcaaaggacacauccggaaaaccguugaacaauucaaaggccaacaguaccgaguacaggaugcugcagcgugcucucgcccuguucggcggugaaaaagagcgcuuaacgccuuauuuucggcaaaugaaucugaccgggggcaacaauccccauccauuccuucacgagacaagaugggaaagccauacuaacauuuuguccuuuuacaggucuuaucucgaggcacgaaaggccuuccugcagagcaucggacggucagaucgcguagaaaaucacagauuucuacugcucaaggagccuaaaaccgacaggcagacacugguugcuggcuggaagggggaauuucaucuuccccggggaaucuucacugaggccgugcgagauuguuugauugagauggguuacgacgaagucggcaguuauaaagaggugggguuuauggcaaaggcggucccacuguacuucgaaagagcuuccaaagaccgcgugcagcccuuuuaugauuacccuuucaacguuggaaacagcuuaaagccaaagaaaggcagguuucucucuaaggagaaacgugccgaggaaugggagucagguaaggaacgguucagacuggcaaaacuuaagaaggagauccuggaagccaaagagcacccguaccacgacuuuaagaguuggcaaaaauucgagagggaauugcgccucgugaagaaucaggauauuauaaccuggaugaugugccgagaccugauggaggaaaacaaaguagaggggcuagauacaggcacccuguaucucaaggacaucagaacugauguccaggaacagggaagccugaaugugcuuaaccggguuaaacccaugagguugccuguggucguguaccgcgcugacucccguggccauguacacaaggagcaagccccacuggcaacgguguauauugaggaaagagauacaaaguuacucaaacaggggaauuuuaagucuuucguuaaagaccggaggcugaacggacuuuucucguucgucgauaccggugcucuggccauggagcaguaccccaucagcaagcuacgcguggaauaugagcucgcgaaauaccaaacugcccgagugugugcuuucgaacagacccuggaguuggaggaaucccuguuaacaagauauccucaucucccagacaagaauuuucggaagaugcuggagucauggagugacccccuucuggauaaauggccggacuugcacggcaacgucaggcuccugaucgcaguucgcaaugccuucucucauaaccaguacccuauguacgaugaaacccuauuuagcuccauuagaaaguaugacccaucaagccccgaugcuauagaggagaggauggggcugaauaucgcccaccggcuuucugaagaggugaaacaggcaaaggaaaugguggagcguauuauccaagcguga

SEQ ID NO: 11318 - RNA, 3360 nt, Artificial Sequence
  Cas13b variant__Porphyromonas gingivalis__WP_012458414.1__Cas13b
augaccgagcagaacgaaagacccuacaauggcacauauuacacucuggaggacaagcacuucugggccgcauuuuucaaccucgcuaggcauaaugccuauaucacgcuugcgcacauugaucggcaacuggcuuacagcaaagccgacauaaccaacgaugaagacaucuuguuuuucaaggggcaguggaaaaauuuagauaacgaccuggagcgcaaggcacgacuacguucccucauucugaaacauuuuucuuuccuugaaggagccgcuuaugguaagaagcuguuugagucacagaguagcggcaauaaauccucuaagaaaaaggaguugacaaagaaggaaaaggaggaacuccaggcaaacgcccugucgcuggauaaucucaaaucaaucuuauucgacuuucugcaaaaacuuaaagauuucagaaacuacuauagccacuacaggcauccugagaguuccgaguugccacuguuugacgggaauaugcuacagcggcucuacaacguguucgaugucucuguucagcgcgugaagagagaccacgaacacaaugauaaaguagacccgcauaggcacuuuaaccaucuggugcggaagggaaagaaggaccgcuauggcaauaacgauaaccccuucuucaagcaccacuuugucgaccgagaggaaaaagugacugaggcuggucuucuguucuuuguuagcuuguuccucgaaaagagagaugccauuuggaugcagaaaaagaucaggggguuuaaaggaggcaccgagacauaccaacagaugaccaaugagguguucugccggucccguauaucacugccuaaguuaaagcuggaaagucuccgcacugacgauuggaugcuucuggacauguugaacgagcuagucagauguccaaaaagccuguaugauaggcuccgggaagaggaccgagcgcgcuuuagagugcccguagauauccugucugacgaagaugacacagacggcaccgaggaggauccuuucaagaauacgcuuguuaggcaucaggaccgguuuccauacuucgcacugcgcuauuuugauuugaaaaagguguucacuucccucagauuucacauugaccuggggaccuaccauuucgccaucuauaaaaagaacauuggagaacagcccgaggauaggcacuuaacacguaaucuguacgguuucggccggauccaagacuuugcugaagaacaucgaccugaagaguggaagaggcuagucagagaucucgacuacuucgagacuggggauaaaccauauauaacccagacaaccccgcacuaccacauugaaaagggaaaaaucggccugcgcuuugugcccgagggucagcaucuuuggccuucaccagaagugggggccacgcggacuggaagaagcaaguaugcacaagacaaaagguugacagcugaggccuuccugaguguccacgagcucaugcccaugauguuuuacuauuuccugcuucgcgaaaaguacucugaugaggcguccgccgaacgaguucagggccggauuaagcgugugaucgaggacguauaugcaguguacgaugcuuuugccagaggcgaaaucaacaccagggacgagcuggacgcuugcuuggccgauaaagggauucgccggggacaucucccuagacagaugauagguauccugagccaggagcacaaggacauggaagagaaagucaggaagaaauuacaagaaaugauuguggauacugaccaccgacuggauaugcuagaccgccagacagaucggaagaucagaauaggcaggaaaaaugcagggcucccaaagucgggaguuauugccgacuggcuggugcgugauaugaugcgcuuccagcccgucgcuaaggacaccucuggcaaaccgcuuaacaauuccaaggcgaacucaacggaguaccggauguugcagagagcacuggcccucuuugguggggaaaaagagaggcugaccccuuauuuccgacaaaugaauuuaacaggcggaaacaauccccauccauuucugcacgagacucggugggaaagucauaccaacauccuuagcuucuaccgcuccuauuugaaggcuagaaaagccuuucuccagucuaucggcaggagcgaucggguggagaaucaccgauuccugcuacugaaggaaccuaagacagacagacagacucucguagcaggguggaaaggagaguuccaucugccccgcgguauuuuuaccgaagccguuagggauugucuuaucgagaugggcuuggacgagguggggucauacaaggaagucggauucauggcuaaagccgugccacuguauuuugagcgugcaugcaaggaccggguccagcccuucuacgauuauccuuuuaacgugggcaacaguuuaaaaccaaagaaggguagauuccucuccaaagaaaagagggcggaggagugggaaagcgggaaagagcgcuuucgacuggcuaaacuuaaaaaggaaauucuggaggccaaggaacacccguacuuggacuucaaaucuuggcaaaaguuugagagagagcuccggcugguuaaaaaucaggauauaaucacauggaugauuuguagggaccuaauggaagagaacaagguggaaggccuggauaccggaacucucuaccugaaagacauccgcacggauguacaggagcagggcaaucuuaacgucuugaaucgugugaagcccaugagacugccuguuguggucuaucgggcagacucaagggggcacgugcauaaagaacaagccccauuagcuacaguauacaucgaggagcgcgauaccaagcuccugaagcagggaaacuucaaaaguuuugugaaggaccgaagacuuaauggucuguucagcuucguugauacuggcgcccuagcaauggaacaguaucccauuuccaaacuccgggucgaguacgaacuggcuaaguaucaaaccgccagggugugcgcguuugagcagacauuggaacuggaggagucuuuacucacccgcuacccucaucugccagacaaaaacuucagaaagaugcuugaaucguggagcgacccccuguuggauaaguggccggaccuccacgggaaugugaggcugcuaauagccguccggaacgcuuuuucccacaaucaguauccuauguacgaugaggcaguuuucucaaguauccguaaauacgacccaucuagccccgaugccauugaggagcgcaugggacugaacaucgcucaucgacuuuccgaggaagugaagcaggccaaagagauggcagaaagaauuauccaagcguga

SEQ ID NO: 11319 - RNA, 3360 nt, Artificial Sequence
  Cas13b variant__Porphyromonas gingivalis__WP_039417390.1__Cas13b
augaccgagcagaacgaaagacccuacaauggcacauauuacacucuggaggacaagcacuucugggccgcauuuuucaaccucgcuaggcauaaugccuauaucacgcuugcgcacauugaucggcaacuggcuuacagcaaagccgacauaaccaacgaugaagacaucuuguuuuucaaggggcaguggaaaaauuuagauaacgaccuggagcgcaaggcacgacuacguucccucauucugaaacauuuuucuuuccuugaaggagccgcuuaugguaagaagcuguuugagucacagaguagcggcaauaaauccucuaagaaaaaggaguugacaaagaaggaaaaggaggaacuccaggcaaacgcccugucgcuggauaaucucaaaucaaucuuauucgacuuucugcaaaaacuuaaagauuucagaaacuacuauagccacuacaggcauccugagaguuccgaguugccacuguuugacgggaauaugcuacagcggcucuacaacguguucgaugucucuguucagcgcgugaagagagaccacgaacacaaugauaaaguagacccgcauaggcacuuuaaccaucuggugcggaagggaaagaaggaccgcuauggcaauaacgauaaccccuucuucaagcaccacuuugucgaccgagaggguacugugaccgaagcugggcuucuguucuuuguuagcuuguuccucgagaaaagagaugccauuuggaugcagaagaaaaucaggggauuuaagggcggcacagaagcguaccaacagaugaccaaugagguguucugccggucccguauaucacugccuaaauuaaagcuggagagucuccgcacugacgauuggaugcuucuggacauguugaacgagcuagucagauguccaaagagccuguaugauaggcuccgggaagaagaccgagcacgcuuuagagugcccaucgauauucugucugacgaggaugacacagacgggaccgaagaggauccuuucaaaaauacgcuuguaaggcaucaggaccgguuuccauacuucgcccugcgcuauuuugauuugaagaaaguuuucacuucccucagauuucacaucgaccugggaaccuaccauuucgcuauuuauaagaaaaacaucggugagcagcccgaagauaggcacuuaacacguaaucuguacggcuucgggcggauacaagacuuugccgaggaacaucgaccugaggaauggaagaggcuagugagagaucucgacuacuucgagacuggagauaagccauauauuacccagacaaccccgcacuaccacaucgagaaaggcaagauuggucugcgcuuuguccccgaagggcagcaucuuuggccuucaccagaggugggagcaacgcggacuggcagaagcaaauaugcucaagacaagagguugacagccgaagcguuccugagugugcacgagcucaugcccaugauguuuuacuauuuccugcuucgcgagaaauacucugaagaggucuccgccgaaaagguucagggccgaaucaagcgggugaucgaggauguauaugcaguguacgacgcuuuugcccguggggaaauugauacccuggacagauuggacgcuugccucgccgauaaaggaauaaggcgcggucaucugccucggcagaugaucgcaauuuuaagccaggagcacaaggacauggaggaaaaagucagaaagaaacugcaagagaugaucgccgauacugaccacaggcuagauaugcucgaccgacagacagaucgcaagauacggauuggcaggaaaaacgcugggcugccaaagucgggagugaucgcggacuggcuuguuagagauaugaugcguuuccagcccguggcaaaggacaccucuggcaaaccguugaauaacuccaaggccaauucaacggaauaccgcaugcugcagcgggcucucgcccuguuugguggggagaaagaaagauuaaccccuuauuucaggcaaaugaaccugacaggcggaaauaacccccauccauuucuucacgagacucgaugggagagucauaccaauaucuugagcuucuaccgguccuaucucaaggcacgcaaagccuuucugcagucuauuggcagaagcgauagggaagagaaccaccgguuccuacugcucaaggaaccuaagacagaccgacagacucuggucgcuggguggaaaucagaguuccaucuucccagaggaaucuuuaccgaagccgugcgcgauuguuugauugagauggguuacgacgagguaggcaguuauaaggaaguuggguucauggcaaaagcggugccacuguacuuugagagggcuugcaaggaccguguccagcccuucuaugauuacccuuuuaaugugggaaacuccuuaaaaccaaagaagggccgguuccucagcaaagaaaagagagccgaggagugggaaucugguaaagagagguuucgccuggcaaaacuuaaaaaggaaauacuggaggccaaggaacacccguacuuggacuucaaaucauggcaaaaguuugagcgagagcucagacuggucaaaaaccaggauaucauuacauggaugaugugucgggaccuaauggaagagaauaagguggaagggcuggauaccggcacucucuaucugaaagacaucaggacggauguucacgagcagggaagucuuaacguguugaaucgcguaaagcccaugcgucugccugucgugguuuacagagcugacagccggggccaugugcacaaagaacaggccccauuagcaacagucuauaucgaggagagggauaccaagcuccugaagcaagggaacuucaaauccuuugugaaggaccgccgacuuaauggacuguucucuuucguagauacuggugcucuagccauggaacaguaccccauuucgaaacucagaguggaguaugaacuggcgaaguaccagaccgcccggguuugcgcuuuugagcaaacauuggaacuggaggagagcuuacucaccagguauccucaucugccagacaaaaacuuccgcaagaugcuugaauccuggucagacccccuguuggauaaguggccggaccuccacagaaaagucaggcugcuaauagcagugcggaaugccuuuagucauaaccaguacccuauguacgaugaggcuguguucucuagcauccguaaguaugacccauccucacccgaugccauugaggaacgcaugggccugaauaucgcacaccgacuuagcgaggaagucaaacaggcgaaggagauggccgaaagaauuauccagguuuga

SEQ ID NO: 11320 - RNA, 3528 nt, Artificial Sequence
  Cas13b variant__Porphyromonas gingivalis__EOA10535.1__Cas13b
augaccgagcagaacgaaaagcccuacaauggcacauauuacacucuggaggacaaacacuucugggccgcauuuuucaaccucgcuagacauaaugccuauaucacgcuuacccacauugauaggcaacuggcguacagcaaggcugacauaacaaacgaugaagacaucuuguuuuucaaagggcaguggaagaauuuagauaacgaccuggagcggaaagcccgccuacgaucccucauucugaagcauuuuucuuuccuugaaggagcagccuaugguaagaaacuguuugagucacagaguagcggcaauaaguccucuaaaaagaaagaguugacuaagaaggaaaaagaggaacuccaggcuaacgcacugucgcuggauaaucucaagucaaucuuauucgacuuucugcaaaaacuuaaggauuuccguaacuacuauagccacuacagacauccugagaguuccgaguugccacuguuugacgggaauaugcuacagaggcucuacaacguguucgaugucucuguucagcgggugaaacgcgaccacgaacacaaugauaagguagacccgcauagacacuuuaaccaucuggugaggaaaggaaagaaggaccggugcggcaauaacgauaaccccuucuucaaacaccacuuugucgaccgcgaggaaaaggugaccgaggccggucuucuguucuuuguuagcuuguuccucgaaaaacgagaugcuauuuggaugcagaagaaaaucagaggguuuaagggaggcacagagaccuaucaacagaugacuaaugagguguucuguaggucccggauaucacugccuaaguuaaaacuggaaagucuccguacagacgauuggaugcuucuggacauguugaacgagcuaguccgcugcccaaagagccuguacgauagacucagggaagaggaccgggcccgauuucgcgugcccguagauauccugucugacgaagaugacaccgacggcacggaggaggauccuuucaaaaauacucuuguuagacaucaggacagguuuccauauuucgcgcugcgguacuuugauuugaagaaaguguucaccucccuccgcuuucacauugaccuggggacauaucauuucgcaaucuacaagaagaacauuggagaacagcccgaggauagacacuuaacuaggaaucuguaugguuucggccguauccaagacuuugccgaagaacaucggccugaagaguggaaacgacuggucagagaucucgacuacuucgagaccggggauaagccauacauaacacagaccacgccgcacuaucacauugaaaaaggaaagaucggccugagguuugugcccgagggucagcuuuuguggccuucaccagaagugggggcuacucgcacaggacggagcaaauacgcccaagacaagagauucaccgcagaggcuuuucugaguguccaugagcucaugcccaugauguucuauuacuuucugcuuagggaaaaguauucugaggaagccuccgcggagcgcguucagggccgaauuaaacgggugaucgaagauguauacgccguguaugacgcauucgcucguggcgagaucgauacucuggacagauuggacgccugucucgcugauaaggggauuaggcgcggacaccuaccucggcagaugauagccaucuuaagccaggagcauaaagacauggaagagaaggucaggaaaaagcugcaagaaaugauugcagauacagaccacagacuagauaugcucgaccgacagaccgaucgcaaaauccggauagguagaaagaacgccggccugccaaagucgggggugauugcugacuggcuuguuagggauaugaugcguuuucagcccguggcgaaagacacgucuggaaagccguugaauaacuccaaagcaaauucaaccgaguaccgcaugcugcagcgggcccucgcucuguucggcggugaaaaggagagauuaacaccuuacuuuaggcaaaugaaccugacugggggcaauaacccccacccauuccuucaugagacccgaugggaaagucacacaaauaucuugagcuuuuaucgguccuaccucaaagcccgcaaggcauuccugcagucuaucggaagaagcgauagggucgagaaccaucgguuccuacugcucaaggaaccuaaaacugaccgacagacccugguggccggcuggaagggggaguuucaccuucccagaggaauuuucacagaagcuguacgcgauugcuugaucgagaugggucuggacgagguuggcucauauaaagaagugggguuuauggccaaggcagucccauuauacuucgagagggcguguaaagaccgugugcagcccuuuuaugauuacccuuucaaugucggaaacagucucaagccaaagaaaggccgguuucuguccaaggagaaaagagcugaggagugggaaagcgguaaggagagguuccgcgaccuugaagccuggucucauucagcagcccgaagaauugaggaugcuuuugccgggauagaaaacgcaagucgggagaauaaaaagaagaucgagcaacuguugcaggaccucagccugugggaaaccuucgaguccaaacuaaaggugaaagcugauaagauuaacaucgccaaacugaagaaagaaauccucgaggcgaaggaacacccguaucuggacuuuaagucuuggcagaaauucgagagggagcuucgcuugguuaagaaucaggauauuauaacuuggaugaugugccgugaccugauggaagagaacaaaguggaaggcuuagauacgggaacacucuaccugaaggacaucagaaccgauguacacgagcaaggcucgcuuaauguccugaaccgggugaaacccaugaggcuaccuguuguggucuaccgcgccgacagccgagggcaugugcacaaggaacaggcuccacucgcaacuguauauauugaggagagagacaccaagcuguugaaacagggaaauuucaaguccuuugugaaagaucggaggcugaacgguuuauucucauuuguugacacaggcgcccucgcuauggaacaauaccccaucaguaagcugcgcgucgaguaugaacuugccaaauaccagaccgcaagagugugugcguucgagcagacucuggaguuggaagagucucuccugacaagguauccucaucuaccagauaagaauuuucggaagaugcuggaaagcugguccgacccccuucucgauaaauggccggaccugcacgggaacgugcguuugcugauugccguccgcaaugcuuucucacauaaccaguacccuauguaugaugagacguuauuuagcucuauccgaaaguacgacccauccagucccgaugccauagaagagagaaugggacucaauaucgcacacaggcugagcgaggaaguuaaacaagcuaaggagaugguggaacggauuauccaggccuga

SEQ ID NO: 11321 - RNA, 3360 nt, Artificial Sequence
  Cas13b variant__Porphyromonas gingivalis__WP_061156470.1__Cas13b
augaccgagcagaacgaaagacccuacaauggcacauauuacacucuggaggacaagcacuucugggccgcauuuuucaaccucgcuaggcauaaugccuauaucacgcuuacccacauugaucggcaacuggcguacagcaaagcugacauaacaaacgaugaagacaucuuguuuuucaaggggcaguggaaaaauuuagauaacgaccuggagcgcaaggcccgacuacguucccucauucugaaacauuuuucuuuccuugaaggagcagccuaugguaagaagcuguuugagaauaaaucaaguggcaacaagagcuccaaaaagaaagaguugacuaagaaggaaaaagaggaacuccaggcuaaugcacugucucuggauaaccucaagucgaucuuauucgacuuucugcagaaacuuaaggauuucagaaauuacuauucacacuacaggcauccugagagcagugaguugccacuguuugacgggaacaugcuacaacggcucuacaauguguucgaugucuccguucagcgcgugaaaagagaccacgaacacaacgauaagguagacccgcauaggcacuuuaaucaucuggugcggaaaggaaagaaggaccgcugcggcaacaacgauaaucccuucuucaaacaccacuuugucgaccgagaggguaaggugaccgaagccgggcuucuguucuuuguuucuuuguuccucgagaaaagagaugcuauuuggaugcagaagaaaaucaggggauuuaagggcggcacagaagccuaucagcaaaugaccaacgagguguucugucggagccguauaucccugccuaaguuaaaacuggagucacuccgcacugacgauuggaugcuucuggacauguugaaugaacuggucagaugcccaaagagucuguacgauaggcuccgggaggaagaccgagcgcgcuuuagagugcccguagauauccugagcgacgaggaugacacagacgggaccgaagaggauccuuucaaaaacacgcuuguuaggcaucaggaccgguuuccauauuucgcacugcgcuacuuugauuugaagaaaguguucacuucucucagauuucacauugaccugggaaccuaucauuucgccaucuacaagaagaauauuggugagcagcccgaagauaggcacuuaacacguaaccuguauggcuucgggcggauccaggacuuugcugaggaacaucgaccugaggaauggaaaaggcuagucagagaucucgacuacuucgagacuggagauaagccauacauaacccaaacaaccccgcacuaucacauugagaaaggcaagaucggucugcgcuuugugcccgaagggcagcaucuuuggccuuccccagaggugggagccacgcggacuggcagaucaaaauacgcacaggacaagagguugacagcugaagccuuccugagcguccacgagcucaugcccaugauguuuuauuacuuccugcuucgcgagaaguauagugaagagguuucugcggaaaaagugcaaggccgaauuaagcggguaaucgaggauguguacgccgucuaugacgcauuugcucguggggaaaucgauacccuggacagauuggacgccugucucgcugauaaaggaauuaggcgcggucaucugccucggcagaugauagccaucuuaucccaggagcacaaggacauggaggaaaaagugagaaagaaacugcaggagaugauugcagauacugaccacaggcuagauaugcucgaccgacaaacagaucgcaagauccggauaggcagaaagaaugccgggcugccaaaaagcggaguuauugcugacuggcuugugagggauaugaugcguuuccagcccgucgcgaaggacaccucgggcaaaccguugaacaauucuaaggcaaacuccacggaauaccgcaugcugcagcgggcccucgcucuguuugguggggagaaagaaagauuaaccccuuacuucaggcagaugaaucugacaggcggaaacaauccccauccauuucuucacgagacucgaugggagucacauaccaacaucuugaguuucuaucggagcuaccucaaggcccgcaaggcauuucugcaauccaucggcagaucugauagggaagagaaucaccgguuccuacugcucaaagaaccuaagacagaccgacagacucugguggccggguggaaaagcgaguuccaucuucccagaggaauuuuuaccgaagcuguacgcgauugcuugaucgagauggguuaugacgagguuggcucauacaaggaagugggguucauggccaaagcagucccacuguauuuugagagggcguguaaggaccgugugcagcccuucuacgauuauccuuuuaacgucggaaacaguuuaaagccgaaaaagggccgguuccucuccaaagaaaagagagcugaggagugggaaagcgguaaagagagguuucgccuggccaaacuuaagaaagaaauucuggaggcaaaggaacacccauacuuggacuucaaaucuuggcagaaguuugagcgagagcucagacuggugaaaaaucaagauauaaucacauggaugaugugccgggaccuaauggaagagaacaagguugaagggcuggauaccggcacucucuaccugaaagacauuaggacggaggugcaggaacagggaucacuuaauguauugaaccgcgucaagcccaugcgucugccugugguuguguauagagccgauagucggggccacguccauaaggagcaggcuccauuagccacaguguacaucgaggaaagggacaccaaacuccugaagcaagggaauuucaagagcuuuguaaaggaucgccgacuuaacggacuguucuccuucguggacacugguggccuagcaauggagcaguaucccaucucuaaacucagaguugaauacgagcuggcuaaguaucagaccgcccgggucugugcguuugaacaaacauuggagcuggaggaaucguuacucaccaggugcccucaccuaccagauaagaauuuccgcaaaaugcuugagagcugguccgacccccuguuggacaaguggccggaucuccagagagaaguguggcugcuaauugccgugaggaacgcuuuuucacauaaucaguacccuauguaugacgaggcagucuucaguucuauacggaaauacgauccaagcucccccgacgccaucgaggaacguauggggcugaacauugcucaccgccuuucagaggaaguuaagcaggccaaagagauggcagaacgaaucauucaagcguga

SEQ ID NO: 11322 - RNA, 3360 nt, Artificial Sequence
  Cas13b variant__Porphyromonas gingivalis__WP_013816155.1__Cas13b
augaccgagcagaacgaaaagcccuacaauggcacauauuacacucuggaggacaaacacuucugggccgcauuuuucaaccucgcuagacauaaugccuauaucacgcuugcgcacauugauaggcaacuggcuuacagcaaggccgacauaaccaacgaugaagacaucuuguuuuucaaagggcaguggaagaauuuagauaacgaccuggagcggaaagcacgccuacgaucccucauucugaagcauuuuucuuuccuugaaggagccgcuuaugguaagaaacuguuugagucacagaguagcggcaauaaguccucuaaaaacaaggaguugacaaagaaggaaaaggaggaacuccaggcaaaugcccugucgcuggauaaccucaaaucaaucuuauucgacuuucugcaaaaacuuaaagauuuccguaauuacuauagccacuacagacauccugagaguuccgaguugccacuguuugacgggaacaugcuacagaggcucuacaauguguucgaugucucuguucagcgggugaagcgcgaccacgaacacaacgauaaaguagacccgcauagacacuuuaaucaucuggugaggaagggcaaaaaggaccgguauggaaacaacgauaaucccuucuucaagcaccacuuugucgaccgcgaggguacugugaccgaagcugggcuucuguucuuuguuagcuuguuccucgagaaacgagaugccauuuggaugcagaagaaaaucagaggauuuaagggcggcacagaaaccuaccaacagaugacuaacgagguguucugcaggucccggauaucacugccuaaauuaaagcuggagagucuccguacagacgauuggaugcuucuggacauguugaaugagcuaguccgcuguccaaagagccuguaugauagacucagggaagaagaccgggcgcgauuucgcgugcccguagauauccugucugacgaggaagauaccgacggggcagaggaggacccuuucaaaaacacgcuuguuagacaucaggauagguuuccauacuucgcccugcgguauuuugacuugaagaaaguguucacuucccuccgcuuucagauugaucugggaaccuaccacuucgcuaucuauaagaaaaauauuggugaacaacccgaggacagacauuuaacaaggaaccuguacggcuucgggcguauccaggauuuugccgaggaacaccggccugaagaguggaagcgacucgucagagaccuagauuacuucgagacuggagacaagccauauauaacccagacaaccccgcauuaccacauugaaaaaggcaagaucggucugagguuugugcccgaggggcaacaccuuuggccuucaccagaagugggagcaacgcgcacuggccggagcaaauaugcucaggauaagagauucacagccgaggcguuuuugagugcccaugagcugaugcccaugauguucuacuauuuucuccugagggaaaaauacucugaggaagcauccgcugagcgcguccagggccgaauuaagcggguuaucgaagacguguaugccguauacgaugcuuucgcccgugacgagaucaauaccagagaugagcuugacgcaugccuggccgacaaggggauuaggcgcggacacuugccucggcagaugauagguauccucagccaagaacauaaagauauggaggaaaagauucguaaaaagcugcaggagaugauggcugacacugaucacagguuagacaugcuggaucgacagacagaccgcaaaauccggauaggcagaaagaacgcggggcuaccaaaaucgggagugauugcagauuggcucgucagggacaugaugcguuuucagcccguggccaaggauaccucuggcaagccgcugaauaacuccaaagcuaauucaacggaauaccgcaugcuucaacgggccuuggcacuguucgguggggagaaggagagacucaccccuuauuuuaggcagaugaaccugacaggcggaaauaacccccacccauucuuacaugaaacucgaugggagagucacaccaauauccugagcuuuuaccgguccuaucuuaaagcccgcaaggcuuucuugcagucuaucggcagaagcgacaggguugaaaaccaucgguuccuccugcuaaaagagccuaagacagaucgacagacucugguggccggguggaagggagaauuucaccuccccagagguauuuucaccgaggcaguccgcgacugucugaucgagaugggccuugaugaaguggggucauacaaagagguaggauuuauggcgaaggcuguuccauuguauuucgaaagggccugcaaagacugggugcaacccuuuuacaacuauccuuucaaugucggcaacagucugaagccgaaaaaggguagauuuuuauccaaggagaaacgggcagaggaaugggagagcgggaaggaaagauucaggcucgccaaacugaagaaagagauucuugaagcuaaggagcauccauaccuggacuuuaagucuuggcagaaauucgagcgcgaauugcgacucgugaagaaucaggauauaaucacauggaugauuuguggcgaccugauggaggaaaacaaagucgagggacuagauaccggcacucuguaccucaaggacaucagaacggaugugcaggaacaagggucacugaauguucuuaaccgggugaaacccaugagguugccuguagucguguaucgcgccgacagucguggacacguucacaaggagcaggcaccacuggcuacaguguacaucgaggaaagagauaccaaauuacucaagcaggguaauuuuaagagcuucgucaaagaccggaggcugaacggccuuuucuccuuuguggauacuggggcccuggcgauggagcaauaucccauuucuaagcuacgcguagaauacgagcucgccaaauaucagaccgcucgagugugcgcauucgaacagacacuggaguuggaggaaucgcuguuaaccagauguccucaucucccagacaagaauuuucggaaaaugcuggagagcugguccgauccccuucuggacaaguggccggacuugcacaggaagguucgccuccugauagccgucagaaacgcuuucucacauaaucaguacccuauguaugaugaagccguguuuaguucuaucaggaaauacgaccccagcuucccagaugcaauugaggagcggaugggacuaaacaucgcgcaccgucuguccgaagaggugaagcaagccaaagaaacugucgagcgcauuauccaggcuuga

SEQ ID NO: 11323 - RNA, 3528 nt, Artificial Sequence
  Cas13b variant__Porphyromonas gingivalis__WP_005874195.1__Cas13b
augaccgagcagaacgaaaagcccuacaauggcacauauuacacucuggaggacaaacacuucugggccgcauuuuucaaccucgcuagacauaaugccuauaucacgcuugcgcacauugauaggcaacuggcuuacagcaaggccgacauaaccaacgaugaagacaucuuguuuuucaaagggcaguggaagaauuuagauaacgaccuggagcggaaagcacgccuacgaucccucauucugaagcauuuuucuuuccuugaaggagccgcuuaugguaagaaacuguuugagucacagaguagcggcaauaaguccucuaaaaagaaagaguugacaaagaaggaaaaagaggaacuccaggcaaacgcccugucgcuggauaaucucaagucaaucuuauucgacuuucugcaaaaacuuaaggauuuccguaacuacuauagccacuacagacauccugagaguuccgaguugccacuguuugacgggaauaugcuacagaggcucuacaacguguucgaugucucuguucagcgggugaaacgcgaccacgaacacaaugauaagguagacccgcauagacacuuuaaccaucuggugaggaaaggaaagaaggacaaauauggcaauaacgauaaccccuucuucaagcaccacuuugucgaccgggaggaaaaagugacugaggcuggucuucuguucuuuguuagcuuguuccucgaaaagcgcgaugccauuuggaugcagaaaaagauccgaggguuuaagggaggcaccgaggcguaccaacagaugacaaaugagguguucugcagauccaggauaucacugccuaaauuaaagcuggaaagucuccggaccgacgauuggaugcuucuggacauguugaacgagcuaguccguuguccaaaaagccuguaugaucgccucagagaagaggacagggcacgguuucgagugcccguagauauccugucugacgaagaugacacugacggcacagaggaggauccuuucaagaauacccuuguucgccaucaggacagauuuccauacuucgcccugagguauuuugauuugaaaaagguguucacgucccuccgguuucacauugaccuggggacuuaccauuucgcuaucuauaagaaaaacauuggagaacagcccgaggaucgccacuuaaccagaaaucuguacgguuucggcaggauccaagacuuugccgaggaacaucguccugaagaguggaagcggcuaguccgagaucucgacuacuucgagacaggggauaaaccauauauaacucagaccacaccgcacuaccacauugaaaagggaaaaaucggccugagauuugugcccgagggucagcuuuuguggccuucaccagaagugggggcaaccaggacgggacgcagcaaguaugcucaagacaagcgguucacugccgaggcguuucugaguguccaugagcucaugcccaugauguucuacuauuuucugcuuagagaaaaauacucugaggaagccuccgcagagaagguucagggcaggauuaaacgcgugaucgaagauguauaugcuguguacgacgccuucgcucgagaugagaucaacacacgggacgagcuggacgccugcuuggcagauaagggcauucguagagggcaccucccuaggcagaugauagccauccugagccaggaacauaaagacauggaggaaaagguccgcaaaaaguuacaagagaugauugcugauaccgaccaccggcuggauaugcuagacagacagacugauaggaagauccgaauaggacgcaaaaaugcgggucucccaaagucgggcgugauugcagacuggcugguucgggauaugaugagauuucagcccguggccaaagacacaucugggaagccgcuuaacaauuccaaagcuaacucaaccgaauacaggauguugcagcgugcccuggcacucuucggaggcgagaaggagcgccugacgccuuauuuucggcaaaugaauuuaaccggugggaacaauccccacccauuccugcaugaaacaagaugggagagucacacuaacauccuuagcuuuuacagguccuauuugaaggcccgaaaggcuuuccuccagucuaucggccggagcgaucgcgaagagaaucauagauuccugcuacugaaagaaccuaaaaccgacaggcagacacucgucgccggauggaagucagaguuucaucugccccggggcauuuucacugaggcagugcgagauugucuuaucgaaaugggguacgacgagguaggaaguuauaaagaaguugguuuuauggcgaaggcugugccauuguacuucgagagagccugcaaggaccgcguccagcccuuuuaugauuacccuuucaacgugggcaacucccugaaaccaaagaaagggagguuuuuaagcaaggagaaacgugcagaagagugggaaucuggaaaggagcgguucagagaccucgaagccuggucacacagugcugccaggcgcauugaggaugcauuugucggcauagaguacgcuagcugggaaaauaagaaaaagaucgagcaacugcuucaggaccuguccuugugggaaaccuucgagucuaaacucaaggugaaagccgauaagauuaacaucgcgaaacugaagaaggaaauccuagaggccaaagagcacccguaucacgacuuuaagucguggcagaaauucgaacgagagcugagacucguuaagaaucaggauauuauaacauggaugaugugucgggaccugauggaagagaacaaaguggaaggucuugauaccgggacuuuguaccugaaggacaucaggacggauguacaagagcagggcagcuuaaauguccucaaccaugugaagcccaugcgccugccuguuguggucuaucgugcugacuccagaggacacgugcauaaagaggaagcaccacuugccacaguauacauugaggaacgggacaccaagcugcuaaaacagggcaauuucaagucauuugugaaagauaggcgccucaacgggcuguucaguuuuguugacacuggagcuuuggccauggagcaauaucccaucucuaagcugcgagucgaguacgaauuagcaaaguaucagaccgcgagagugugcgccuucgagcagacacucgaacuggaggaaagccuucugacccgguacccucacuugccagaugaguccuuuagggagaugcucgaaucauggagcgacccccugcuagauaaauggccggaccugcagcgcgaggugagacuucucauugcugucaggaaugccuucucucauaaccaauacccuauguaugaugaaacuaucuuuuccaguauacggaaguacgacccaagcucucuggaugcaaucgaggaacguauggguuugaauauugcucaccgccuguccgaggagguuaaauuagccaaggaaaugguggagcgaaucauucaggcauga

SEQ ID NO: 11324 - RNA, 3360 nt, Artificial Sequence
  Cas13b variant__Porphyromonas gulae__WP_039437199.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaugaagacaucuuauucuuuaaggggcaguggaaaaaccuggauaaugaccuagagcgcaagucucgacuccguucacugauucuuaaacauuucaguuuucuggaaggagccgcauaugguaagaaguucuuugagagcaaauccucuggcaacaagucgucaaagaauaaggaguugacuaaaaaggaaaaggaggaacuccaggccaacgcucugagccuggauaaucucaaaaguaucuuauucgacuuucugcagaaacuuaaagauuucagaaacuacuauucccacuacaggcauucugggagcuccgaguugccucuguuugacggaaauaugcuacaacggcucuacaacguguucgaugucucaguucagcgcgugaagagagaccacgagcacaaugaugaaguagacccacauuaucacuuuaaccaucuggugaggaaaggcaagaaagaccgguacggucacaaugauaacccgaguuucaagcaccauuucgucgacggggagggaauggugaccgaagcaggccuucuguuuuucguuagcuuguuucucgagaagcgcgaugccauuuggaugcagaaaaagauccgaggcuucaaagggggaacagaacccuaugagcagaugaccaacgagguguuuugcagaucuaggauaucccugccuaaguuaaaacuggaaucacuccggacugacgauuggaugcuucuggacauguugaaugagcuaguccguuguccaaagccccuguacgaucgccucagagaaaaggacagggcuugcuuccgggugccuguagauauccugccagacgaggaugacacagacgguggcggggaagaucccuuuaaaaacacccuuguucgacaccaagaccgcuucccuuauuuugcccugagauacuucgauuugaagaaaguguuuacgagccucagguuccauauugaccugggaacuuaucacuuugcgaucuacaagaaaaugauuggcgagcagccagaggaucggcauuuaacccgcaaucuguacgguuucgggagaauccaggacuucgcagaggaacacaggccggaagaguggaagcgucuaguccgggaucucgacuauuuugaaacaggagauaagcccuacauaagucagacuaccccucacuaucauauugagaaaggcaagaucggccugcgauucgugccagaggggcaacaccuuuggcccucuccugaagugggaacaaccagaacggguagguccaaauacgcccaggacaagcgcuugacugcugaggccuuucugagcguccaugaacucaugccaaugauguucuauuacuuucugcuucgggagaaauauucggaggaaguuucugcagagaaggugcagggcagaauuaagaggguaaucgaagauguguacgcuaucuacgacgccuucgcgcgcgaugagauuaacacacugaaagaauuggacgccugucucgcagacaaggggauacgacggggacaucugcccaaacaaaugaucggcauuuuaucccaggagcguaaggauauggaggaaaaagucagaaagaaacugcaggagaugaucgcugacaccgaucacaggcuagacaugcucgaucgccagacugaccggaagauaagaauugguaggaagaaugccgggcugccgaaaucaggcgugaucgcugauuggcuuguucgagacaugaugcgcuuucaaccuguggccaaggauacaaguggaaaacccuugaacaauagcaaggcaaacuccaccgaauaucggaugcugcagagagcccucgcucuguucggcggggagaaagaaagguuaacgccauacuuucgucagaugaaucugaccggagguaacaauccucaccccuuccuucacgagacacgcugggagucucauacuaacaucuugagcuuuuaucggucauaccucagagcgaggaaggcauuccuggaacgaauuggccggagugaccgcgucgagaauugcccauuucuacugcucaaggaacccaaaaccgauagacagacacugguggccggguggaagggagaguuccaccuuccuaggggcaucuucacugaagcuguacgggacuguuugauugagauggguuaugaugagguuggguccuaccgagaagugggcuuuauggccaaagcagucccacuguauuucgagagagccugcgaagaccgcgugcaaccguuuuacgacagccccuucaacgucggaaauucuuuaaagccuaaaaagggcagguuucucucaaaggagaaacgugcugaggaaugggagagugggaaggaacgguucagacuggccaaacuuaagaaagagauacuggaagcacaggagcauccauaccacgauuuuaagagcuggcagaaguucgagagggaauugcgccucgugaaaaaccaggacaucauuaccuggaugaugugucgagaucugauggaggaaaacaagguugagggacuagacacagguacccuguaucucaaagauaucagacccaaugugcaagaacagggcucccugaacguacuuaaucgggucaagccuaugagguugccagugguuguguaccgcgcggacucucgugggcacguccauaaagaggaggcuccccuggccacuguguauaucgaagagagagauacgaaguuacucaaacagggaaacuuuaagucguucguaaaggaccggaggcugaauggccuuuuuagcuucguggauacaggugcacuggccauggaacaguacccgauuuccaaacuacgcguugaguaugaacucgcuaaguaccaaaccgcccgagucugcgcauucgagcagacucuggaguuggaagagucacuguuaaccagauauccucaccucccagacgaaaguuuucgggagaugcuggagucuuggagcgauccccuucugacaaaauggccugaauugcaugggaaggugaggcuccugauagcugugcgcaacgccuucucccacaaucaguaccccauguacgacgaggcggucuuuucaagcaucuggaaauaugacccaucuuccccugaugccauugaagagagaaugggccuaaacaucgcucauaggcugagugaagagguuaagcaagcaaaggagaccauugaacggaucauacaggccuga

SEQ ID NO: 11325 - RNA, 3360 nt, Artificial Sequence
  Cas13b variant__Porphyromonas gulae__WP_039419792.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaaccuagauaaugaccucgaacgcaagucacgacugcguagucuuauccugaaacauuuuagcuucuuggagggggcagccuauggaaagaagcucuuugaauccaaaucuucggguaacaagucaagcaaaaauaaggagcugacuaaaaaggagaaggaagaacugcaggcuaacgcacucaguuuagauaaucugaaauccauucuuuucgacuuuuugcagaagcugaaagauuucagaaacuacuauucucacuacaggcauagcggcuccucagaacuaccucucuuugacgggaauaugcugcaacggcuuuacaacgucuucgauguuagugugcagcgcguaaagagagaccacgagcacaaugauaaaguggacccacauaggcacuuuaaccaucugguccggaagggaaagaaggaccgcuauggccacaaugauaacccgagcuucaagcaccauuuuguggacggugaggggaugguuaccgaagccggacuucucuucuucgugucucuguuuuuagagaaacgagaugcuaucuggaugcagaagaaaauuagaggcuucaagggcgggacagaaaccuaccagcaaaugacuaacgaggucuuuugcaggucccggaucucacugcccaaacucaaguuggaaagccugcguacagacgauuggauguugcuagacaugcugaaugagcucgugcgcuguccuaagccacuguaugauagacuuagggagaaagaccgggcccgauuccgcguacccguugauauacugccugacgaagaugacaccgacggagguggcgaggauccauuuaagaacacguuggugagacaccaggacagguuccccuacuuugcgcuccgguauuucgaucugaaaaaggucuuuaccaguuuacgcuuccauaucgaccuggggacuuaccacuuugcaauuuauaaaaaggugaucggagaacagccugaggauagacaucuaacaaggaaucucuacggcuucggucguauucaggacuuugccgaagaacaccggccagaggaauggaagcgacuggugagagaucuugacuacuucgagacuggggauaaaccguauaucucucaaaccacaccccacuaccauauagaaaagggaaaaauuggcuugagguucgucccugagggccagcaccuguggccaucccccgaaguugggaccacgcgcacuggacggagcaaguaugcucaggacaaaagacucacagccgaggcauuucugucggugcaugagcuuaugccuaugauguucuacuauuuucuguugagggaaaaguacucugaggaaguauccgcugagaaggugcaaggucgcaucaaacgagucauugaggauguguaugccaucuacgacgcguucgcccgggaugaaaucaacacccgugacgagcucgacgcaugccuggcugauaagggcauuagaagggggcacuuaccaaaacagaugauaggaauccugucacaggaacacaagaauauggaggaaaaaguucgcaagaaacuacaggagaugauugccgacacugaucaucggcucgacaugcuggauagacaaacagacaggaagauccgaauaggccgcaagaacgcuggucuucccaaaaguggggugauugccgauugguugguccgggacaugaugagauuucagccgguggcaaaggauaccagcggcaaaccucugaauaacuccaaggccaauucuacggaguacaggaugcuccagcgugcucuggcguuauucggaggcgaaaaagagcgccugacccccuauuuucggcagaugaaccuuacagggggaaauaacccacacccuuucuuggacgaaacuagaugggagagccauaccaauauccucucauuuuacaggaguuaucugcgagcacggaaggccuuccuagaacgcaucgguagauccgauaggguagagaaccggcccuuucugcuccugaaggagccaaaaacagaccgacaaacucuuguugcuggcuggaaaagcgaguuccacuugcccagagggauuuuuaccgaggccgugcgcgauugucugaucgaaaugggauacgacgaggucggcucuuauaaagaaguggguuucauggcaaaggccgucccuuuauacuucgagagggcuugcaaagaccgugugcagccauuuuaugauucaccguucaauguugggaacagucucaagcccaagaaaggccgguuucugagcaaggagaaaagagccgaagagugggaauccggaaaggagagguuccgccuugcaaaacugaagaaggagauuuuggaagcgcaggagcauccuuaccacgacuuuaaaucuuggcagaaguucgaacgagagcucagacuggugaaaaaccaagauauaaucacauggaugaugugucgggaccuaauggaagagaauaagguagagggccuggauaccgggacucucuaccugaaagacauuaggccaaacguccaggaacagggaucgcuuaauguguugaaccgcguuaagcccaugcgucugccuguggucguguauagagcugauagccggggucacguacauaaagaggaagccccauuagcaacgguguacaucgaggaaagggacacaaagcuccugaagcagggcaauuuuaaauccuucguuaaggaucgccgacuuaacgggcuguuuucauucgucgacaccggaggccuagccauggagcaauaucccaucaguaaacucagaguggaguacgaacuggcuaaguaucagacugcccgggugugcgucuuugaguugacccugagguuagaagagucucuccugagccgcuacccgcaccuuccugaugaauccuucagagagaugcuggagucauggagcgacccauugcucgcaaaauggcccgaacugcaugguaagguuaggcuacugauugcugugcggaaugccuucucucacaaccaguauccuauguacgacgaggcgguguuuuccaguauacguaaguacgaucccagcucuccagacgccaucgaggagcgcauggggcuuaauauugcucaucgacucuccgaggaaguaaaacaagcaaaggagacagucgaaagaaucauucaggccuga

SEQ ID NO: 11326 - RNA, 3528 nt, Artificial Sequence
  Cas13b variant__Porphyromonas gulae__WP_039431778.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaacuuugauaaugaccuagaacgcaagucacgacuccguagucugauccuuaaacauuucagcuuucuggagggggcagccuauggaaagaaguuguucgaauccaaaucuucggguaacaagucaagcaaaaauaaggagcucacuaaaaaggagaaggaagaacugcaggcuaacgcacugagucucgauaauuuaaaauccauucuguuugacuuccuucagaaguugaaagauuuuagaaacuacuauucucacuacaggcauagcgaauccucagagcugccucuauucgacggcaauaugcuccaacggcuguacaacgucuuugauguuagugugcagcgcguaaagagagaccacgagcacaaugauaaaguggacccacauaggcacuucaaccaucuuguccggaaggggaaaaaggaccgcuauggacacaaugauaacccgagcuuuaagcaccauuucguggacggcgaagguaugguuaccgaggccgggcuguuguucuuugugucucucuuccuggaaaaacgagaugcuaucuggaugcagaagaaaauuagaggauuuaagggcggcacagagaccuaccagcaaaugacuaacgaagucuucugcaggucccggaucucauuacccaaacugaagcucgagagccuucguacagacgauuggaugcuguuggacaugcuaaaugagcuggugcgcuguccuaagccacucuaugauagacugagggaagacgaucgggccugcuuucgaguacccguugacauacuuccugaugaggacgacaccgaugggggaggugaagacccauucaaaaacacgcuggugcgccaccaggauagauuucccuacuucgcguugagguauuuugaccucaagaaagucuucacuucccugcgguuucauaucgauuuaggcaccuaccacuucgcaauuuauaagaaaaugaucggggagcagccugaagaccgccaucugacaagaaaucuauacggauuuggcaggauucaggauuucgccgaggagcaccguccagaagaguggaagcggcucgugcgagaccuggauuacuucgaaacuggugacaagccguauaucucucaaaccaguccccacuaccauauagagaaagggaagauuggacuuagauuuaugccugaaggccagcacuuguggccaagccccgaggugggcacaaccaggacggggcgcucgaaauaugcucaggauaagcggcugacugccgaggcauuccucucuguccaugaacugaugccuaugauguuuuacuauuuccuucugagagagaaauacuccgaagagguuucagcugagaaggugcaaggaaggaucaagcgcguaauugaagacguguaugccaucuacgaugcguuugcccgagacgagaucaacacauugaaagaacucgacgcaugucuggcugauaaggguauucggcguggccacuuaccaaaacagaugauagccauccugagucaggagcacaaggacauggaagagaaaauuagaaagaaacuacaggagaugaucgcugauaccgaccauaggcucgauaugcuggaccgccaaacugaucggaagauaagaauugggaggaagaaugccggacuucccaaaagcggcgucaucgcagacugguuggugcgagauaugaugcgcuuccagccgguugccaaggacacauccgguaaaccucugaacaauucuaaggcuaacagcaccgaauaccggaugcuccagagagcgcuggcauuauuugggggcgagaaaaagaggcugacgcccuauuuccgucagaugaaucuuaccggaggcaacaauccacaccccuuuuugcaugaaacacgcugggagucacacacuaacauccucaguuucuaccgguccuaucugagagccaggaaggcuuuucuagaacgaauugggcggagcgaucgcauggagaauagacccuuccugcuccugaaagagccaaagaccgacaggcaaacacuuguggccggauggaaaucugaauuucauuugccccgggguaucuucacugaggcaguccgagauugccugauugaaaugggcuacgacgagguggggucauauagagaaguaggauucauggccaaggcuguuccuuuauacuuugagcgcgccugugaggacagggugcagccauucuaugauaguccguuuaacgucggcaauagccucaaacccaagaagggucguuuccuguccaaagaagaacgggcagaagagugggagagagggaaggaaagguuucgcgaccuugaggcguggucucacucggcugcccgaagaauagaagaugcauucgccggcaucgaguacgcuagcccuggaaacaaaaagaaaauugaacagcuguugcgggaccucucccugugggaggccuuugagucaaagcuaaaggugagggcagauaaaaucaaccuggcuaagcucaaaaaggaaauccuggaggcccaggaacacccauaccaugacuucaaaaguuggcaaaaguuugagcgcgaacuucguuuggucaaaaaucaggauauuauaaccuggaugaugugcagagaccugauggaggagaacaagguggaaggcuuagauacagggacccucuaucugaaggacauccggcccaauguucaggagcagggaucucuuaacgugcugaauaggguaaaaccuaugcgccuaccagucgugguuuaccgagcggauagcagaggucacgugcauaaggaagaggccccucucgcuacugucuauauugaggagcgggacacgaaacuguugaagcaaggcaacuucaaauccuuugugaaggacaggcgccugaauggguuauucucauucguagauacaggaggccucgcaauggagcaguacccgaucagcaagcugagaguggaauaugagcuugccaaauaccagaccgcuaggguuugugucuuugaacugacuuugcggcucgaggagucucugcuaacccguuauccucaucugccagacgaauccuuccgcaagaugcuugagaguuggagcgauccccuccuggccaaauggccugaauugcacgguaaggugcgacuguuaauugcagugagaaacgcguuuucucacaaucaauaccccauguacgacgaggccgucuucuccucaaucaggaaauaugauccaaguagcccugacgcuauagaggagcggauggggcucaacaucgcccaccgccugucggaggaaguuaagcaggcaaaggagacaguggaaagaauuauccagguguga

SEQ ID NO: 11327 - RNA, 3528 nt, Artificial Sequence
  Cas13b variant__Porphyromonas gulae__WP_046201018.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaacuuugauaaugaccuagaacgcaagucacgacuccguagucugauccuuaaacauuucagcuuucuggagggggcagccuauggaaagaaguuguucgaauccaaaucuucggguaacaagucaagcaaaaauaaggagcucacuaaaaaggagaaggaagaacugcaggcuaacgcacugagucucgauaauuuaaaauccauucuguuugacuuccuucagaaguugaaagauuuuagaaacuacuauucucacuacaggcauagcgaauccucagagcugccucuauucgacggcaauaugcuccaacggcuguacaacgucuuugauguuagugugcagcgcguaaagagagaccacgagcacaaugauaaaguggacccacauaggcacuucaaccaucuuguccggaaggggaaaaaggaccgcuauggacacaaugauaacccgagcuuuaagcaccauuucguggacucugaaggcaugguuaccgaggccggucuguuguucuuugugucccucuuccuggaaaaacgagaugcuaucuggaugcagaagaaaauuagaggguuuaagggaggcacagagaccuaccagcaaaugacuaacgaagucuucugcaggucacggaucagcuuacccaaacugaagcucgagagucuucguacagacgauuggaugcuguuggacaugcuaaaugagcuggugcgcuguccuaagccacucuaugauagacugagggaaaaagaccgggcccgauuucgcguacccguugauauacuuccugacgaggaugacaccgacggcgggggagaagauccauucaagaacacgcuggugagacaccaggacagguuucccuacuucgcguugcgguauuuugaucucaaaaaggucuucacuucucugcgcuuucauaucgacuuagguaccuaccacuucgcaauuuauaaaaagaugaucggcgagcagccugaagauagacaucugacaaggaaucuauacggguuuggacguauucaggacuucgccgaggagcaccggccagaagaguggaagcgacucgugagagaucuggacuacuucgaaacuggcgauaaaccguauaucucccaaaccacaccccacuaccauauagagaaggguaaaauugggcuuagguuuaugccugaaggacagcacuuguggccaagccccgaggugggcaccacgcgcacuggccggucgaaguaugcucaggacaaaagacugacagccgaggcauuccucucuguccaugaacugaugccuaugauguuuuacuauuuccuucugagggagaaguacuccgaagagguuucagcugagaaggugcaagggcgcaucaaacgaguaauugaagauguguaugccaucuacgacgcguuugcccgggaugagaucaacaccuugaaggaacucgacgcaugccuggcugacaaagguauucguagaggacacuuaccaaagcagaugauagccauccugagucaggagcacaaagauauggaagagaagauuaggaaaaagcuacaggagaugaucgcugacacugaucaucgccucgacaugcuggaucggcaaacagacagaaagauaaggauuggccgcaaaaaugccgggcuucccaagagcggagucaucgcagauugguuggugcgagacaugaugcgguuccagccgguugccaaagauaccuccggcaagccucugaacaauucuaaagcuaacagcacggaauacagaaugcuccagagggcgcuggcauuauuugguggggagaagaagcgucugacccccuauuuccgccagaugaaucuuacaggcggaaacaauccacaccccuuuuugcaugaaacucggugggagucacacaccaacauccucaguuucuacagauccuaucugagggcccgaaaggcuuuucuagaacggauuggccgcagcgacagaauggagaauaggcccuuccugcuccugaaagagccaaaaacagaucggcaaacucuuguggccggguggaagucugaauuucauuugccccgaggaaucuucaccgaggcagucagagacugucugauugaaauggguuacgaugaggugggcucauaucgcgaaguaggguucauggccaaagcuguuccuuuauacuuugagagggccugcgaggaccgugugcagccauucuaugacaguccguuuaacgucggaaauagccucaagcccaagaaaggccgguuccuguccaaggaagagagagcagaagagugggagagggguaaagaacgcuuucgagaucuugaggcguggucucacucggcugccagacggauagaagacgcauucgccgggaucgaguacgcuagcccuggcaacaagaaaaagauugaacagcuguugagggaucucucccugugggaggccuuugagucaaagcuaaaagugcgcgcagacaagaucaaccuggcuaaacucaagaaagaaauccuggaggcccaggaacacccauaccaugauuucaagaguuggcaaaaauuugagcgugaacuuagauuggucaagaaucaggacauuauaacauggaugaugugucgggaucugauggaggagaacaagguggaaggauuagacaccggcacucucuaucugaaagauaucaggcccaauguucaggagcaggggucucuuaacgugcugaaucgcguaaagccuaugcgacuaccagucgugguuuacagagcggacagccggggacacgugcauaaagaagaggccccucucgcuacggucuauauugaagagagggauacaaagcuguugaaacaagguaacuucaaguccuuugugaaggaccgcagacugaauggcuuauucucauucguagacaccgggggacucgcaauggagcaguacccgaucagcaaacugaggguggaauaugagcuugccaaguaccagacugcucggguuugcgucuuugaacugaccuugcgucucgaggagucucugcuaacacgcuauccucaucugccagaugaauccuuccgaaaaaugcuugagaguuggagcgacccccuccuggccaaguggccugaauugcacggcaaagugagacuguuaauugcagugaggaacgcguuuucucacaaucaauaccccauguacgaugaggccgucuucuccucaauccggaaguaugacccaaguagcccugaugcuauagaggagcgcaugggucucaacaucgcccacagacugucggaggaaguuaagcaggcaaaagagaccguggaaaggauuauccagguguga

SEQ ID NO: 11328 - RNA, 3525 nt, Artificial Sequence
  Cas13b variant__Porphyromonas gulae__WP_039442171.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaaccuagauaaugaccucgaacgcaagucacgacugcguagucuuauccugaaacauuuuagcuucuuggagggggcagccuauggaaagaagcucuuugaauccaaaucuucggguaacaagucaagcaaaaauaaggagcugacuaaaaaggagaaggaagaacugcaggcuaacgcacucaguuuagauaaucugaaauccauucuuuucgacuuuuugcagaagcugaaagauuucagaaacuacuauucucacuacaggcauagcggcuccucagaacuaccucucuuugacgggaauaugcugcaacggcuuuacaacgucuucgauguuagugugcagcgcguaaagagagaccacgagcacaaugauaaaguggacccacauuaucacuuuaaccaucuggucaggaagggaaagaaggaccgguacggccacaaugauaacccgagcuucaagcaccauuuuguggacucugaggguaugguuaccgaagccgggcucuuguucuucgugucccuguuuuuagagaaacgcgaugcuaucuggaugcagaagaaaauucgaggauucaagggcggcacagggcccuaugaacagaugaccaacgaggucuuuugcagaucaaggaucagccugccuaaacucaaacuugaaagucugcggacugacgauuggauguugcuagacaugcugaaugagcucgugcguuguccaaagccccuguacgaucgccuuagagagaaagacagggccugcuuccggguaccuguugauauacugccagacgaagaugacacagacggagguggcgaggaucccuuuaagaacaccuuggugcgacaccaagaccgcuucccuuauuuugcgcucagauacuucgaucugaaaaaggucuuuacgucuuuaagguuccauaucgaccuggggacuuaucacuuugcaauuuacaaaaagaugaucggagaacagccagaggaucggcaucuaacccgcaaucucuacggcuucgguaggauucaggacuuugccgaggagcacagaccggaggaauggaagcgucuggugcgggaucuugacuauuuggagacaggggauaaacccuacaucucccagacuaccccucacuaucauauagaaaagggaaaaauuggccugcgauucgugccagagggccaacaccucuggcccagcccugaagucgggacaaccagaacgggaaggucgaagugugcucaggacaaacgccugacugccgaggcauuccuuucuguucaugagcugaugccaaugauguuuuacuauuucuugcuccgggaaaaguacuccgaggaagugucagcugagaagguacaggguagaaucaaaagggugauugaggaugucuaugccaucuacgacgcguuugcccgcgaugaaaucaacacacugaaggaguuagauaccugccuggcagacaaaggcauucgacgggggcaccuacccaagcaaaugauaacuauccucagucaggaacguaaagacaugaaggagaaaauuagaaagaagcugcaggaaaugaucgcugacacagaucacaggcuugacauguuggaucgccagaccgaccggaaaauaagaauuggaaggaagaaugccggccugccgaaaagcggugugaucgcugauuggcucguucgagacaugaugcgcuuccaaccuguggccaaggaugcauccgggaaaccccugaacaauucuaaggccaacagcacggaguaccggauguuacagagagcucuggcgcuuuuuggcggagagaaggaaagguugaccccauauuuccgucagaugaaucucacaggcgggaacaauccucaucccuuucugcacgagacucgcugggaaucacauaccaacauccuaaguuucuaccgguccuaucugagagcaaggaaagccuuucucgagcgaauuggacggagcgaccgcgucgaaaauuguccauuccugcuuuugaaggagcccaaaacagauagacagacucugguggcugguuggaaggacgaguuucacuuaccuaggggcaucuucaccgaagccguacgggauugccucauugagaugggguacgacgaaguuggaucuuaucgagaggugggcuuuauggcaaaagccgucccacuguacuucgaaagagcuugugaggaccgcgugcaaccguucuaugauucacccuuuaacgucgguaauagucuuaagccuaagaaagggagguuccugagcaaggaggaccgugccgaagagugggaacggggcauggagagauuuagggauuuggaggcauggucccauucugcggcucgccgaauaaaagacgccuucgcaggaaucgaauacgccucgccaggcaacaagaaaaagauugagcagcuccugagagaucuaagccugugggaggcuuuugaauccaagcucaaagugcgggccgacaagaucaaccuggcaaaacuuaagaaagaaaucuuggaggcucaggagcaccccuaccacgauuucaagucauggcagaaauuugaaagggagcugcgcuuaguuaagaaucaagacauuauaacauggaugaugugccgugaucucauggaagagaacaagguggaagggcuggacaccggaacucuuuaucugaaagauaucagaccuaauguacaggagcaggguagucuaaacguccucaaucgggugaagccaaugaggcugcccguuguggucuaccgcgccgacucucgaggccaugugcacaaagaggcgccguuggccacgguauauauugaagagagaaacacaaagcuguuaaaacaggggaauuucaagagcuuugugaaggaccggaggcucaacggacuguucuccuuuguugauaccggcggucuugcuauggaacaauacccuaucucaaaacugcgcgucgaguaugaauuggcaaaguaccagacugccagaguguguguguucgagcucacccugaggcuagaggaaagccugcuuucucgguauccacaucuccccgacgaguccuuccgugaaaugcuggagaguuggagcgauccuuugcuggcuaaauggcccgaguuacacgggaagguccgccuccugauugccguucgaaaugcauuuucucauaaccaguacccaauguacgacgaagcgguguucuccucaaucagaaaauaugauccuaguagccccgacgccauagaggaaaggaugggccuuaauaucgcucaccggcugucggaggaagugaagcaagccaaggagacaguagagcgcauuauccaggcauga

SEQ ID NO: 11329 - RNA, 3360 nt, Artificial Sequence
  Cas13b variant__Porphyromonas gulae__WP_039426176.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaacuuugauaaugaccuagaacgcaagucacgacuccguagucugauccuuaaacauuucagcuuucuggagggggcagccuauggaaagaaguuguucgaauccaaaucuucggguaacaagucaagcaaaaauaaggagcucacuaaaaaggagaaggaagaacugcaggcuaacgcacugagucucgauaauuuaaaauccauucuguuugacuuccuucagaaguugaaagauuuuagaaacuacuauucucacuacaggcauagcggcuccucagaacugccucuauucgacgggaauaugcuccaacggcuguacaacgucuuugauguuagugugcagcgcguaaagagagaccacgagcacaaugauaaaguggacccacauuaucacuucaaccaucuugucaggaagggaaagaaggaccgguacggccacaaugauaacccgagcuuuaagcaccauuucguggacucugaggguaugguuaccgaagccgggcuguuguucuuugugucccucuuccuggagaaacgcgaugcuaucuggaugcagaagaaaauucgaggauuuaagggcggcacagggcccuaugaacagaugaccaacgaggucuucugcagaucaaggaucagcuuaccuaaacugaagcucgaaagucuucggacugacgauuggaugcuguuggacaugcuaaaugagcuggugcguuguccaaagccccucuacgaucgccugagagagaaagacagggccugcuuucggguaccuguugauauacuuccagacgaagaugacacagacggagguggcgaggaucccuucaagaacacccuggugcgacaccaagaccgcuuuccuuauuucgcguugagauacuuugaucucaaaaaggucuucacgucucugagguuucauaucgacuuagggacuuaucacuucgcaauuuacaaaaagaugaucggagaacagccagaggaucggcaucugacccgcaaucuauacggcuuugguaggauucaggacuucgccgaggagcacagaccggaggaauggaagcgucucgugcgggaucuggacuauuucgagacaggggauaaacccuacaucucccagacuaccccucacuaucauauagaaaagggaaaaauuggccuucgauuuaugccagagggccaacacuuguggcccagcccugaaguggggacaaccagaacgggaaggucgaaguacgcucaggacaaacgccugacugccgaggcauuccucucuguccaugagcugaugccaaugauguuuuauuacuuccuucugcgggaaaaguauuccgaggaaguuucagcugagaaggugcaggguagaaucaaaaggguaauuaaggauguguacgccaucuacgacgcguuugcccgcgaugagaucaacacauugaaagaacucgacgcauguagugcugacaagggcauucgacgggggcaucugcccaaacaaaugauaggaaucuuaagccaggagcacaagaauauggaagagaaaguccguaagaagcugcaggaaaugauugccgauaccgaccacagacuagauaugcucgacaggcagacugaucgcaaaauccggauaggcagaaagaacgcuggucugccgaaauccggggugauugccgacuggcuuguuagggauaugaugcgauuccaaccuguggcaaaggacacaucuggcaaacccuugaauaacagcaaggccaauucaaccgaguaucgcaugcugcagcgggcucucgcgcuguuuggaggcgagaaggaaagauuaacgccauacuucaggcagaugaaccugaccgggggaaauaacccucaccccuuucuugaugagacacguugggaaagucauacuaauaucuuguccuucuaucgcagcuaccuccgggcaagaaaagccuuucuggagaggaucggucgaucugaccgggucgaaaaccgcccauuccuacugcucaaggagcccaaaaaugauagacagacccugguggcuggcuggaagucagaguuucaccuuccuagggggauuuucacagaagccguacgggacugcuugaucgagaugggauaugaugaaguuggcaguuacaaagagguggguuucauggcaaaggccgucccacuguauuuugaacgagcuuguaaggacagagugcaaccguucuacgacagccccuuuaacgucgggaacuccuuaaaaccuaagaaaggccgcuuccucucuaaggagaaaagggccgaggaaugggagucgggaaaggaacguuuucggcuggcaaaacuuaaaaaggagauucuggaggcgaaagaacauccauaccacgauuucaagagcuggcagaaauuugagagagaauugaggcucgugaagaaucaggacauaaucacuuggaugaugugccgcgaucugauggaggaaaacaaaguugagggccuagacaccgggacacuguaucucaaggauauucgaaccgacgugcacgagcagggaucccugaauguacuuaacagagucaagcccaugcgguugccugugguuguguacagggcugauucacgcggucauguccacaaagaacaagccccacuggcaacuguguauaucgaggaacgugacacgaaguuacucaaacagggcaauuucaagaguuuuguaaaagauagacggcugaacgggcuuuucucuuuuguggacacaggaggccuggccauggagcaguaccccaucagcaagcuaaggguugaauaugagcucgcuaaguaccagaccgcccgcgucugugcauucgagcaaacucuggaauuggaggaaucccuguuaacccgauauccgcaucucccugaugagaauuucagagaaaugcuggagucauggagcgacccacuucuggguaaauggcccgacuugcacgggaaggugcggcuccugauugcugugaggaacgccuuuucucauaaucaguacccuauguacgaugaggcggucuucuccaguauacgcaaauaugaccccagcucuccagaugccaucgaagagagaaugggccuaaacauugcucacaggcuguccgaagagguuaagcaggcaaaagagacaguggaacggaucauucaagccuga

SEQ ID NO: 11330 - RNA, 3528 nt, Artificial Sequence
  Cas13b variant__Porphyromonas gulae__WP_039418912.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaaccuagauaaugaccucgaacgcaagucacgacugcguagucuuauccugaaacauuuuagcuucuuggagggggcagccuauggaaagaagcucuuugaauccaaaucuucggguaacaagucaagcaaaaauaaggagcugacuaaaaaggagaaggaagaacugcaggcuaacgcacucaguuuagauaaucugaaauccauucuuuucgacuuuuugcagaagcugaaagauuucagaaacuacuauucucacuacaggcauagcggcuccucagaacuaccucucuuugacgggaauaugcugcaacggcuuuacaacgucuucgauguuagugugcagcgcguaaagagagaccacgagcacaaugauaaaguggacccacauaggcacuuuaaccaucugguccggaagggaaagaaggaccgcuauggccacaaugauaacccgagcuucaagcaccauuuuguggacucugaggguaugguuaccgaagccgggcuucucuucuucgugucccuguuuuuagagaaacgagaugcuaucuggaugcagaagaaaauuagaggauucaagggcggcacagaaaccuaccagcaaaugacuaacgaggucuuuugcaggucacggaucagccugcccaaacucaaguuggaaagucugcguauggacgauuggauguugcuagacaugcugaaugagcucgugcgcuguccuaagccacuguaugauagacuuagggaggacgaucgggccugcuuccgaguacccguugacauacugccugaugaagacgacacagaugggggaggugaggacccauuuaaaaacaccuuggugcgccaccaggauagauuccccuacuuugcgcucagguauuucgaccugaagaaagucuuuacgucuuuacgguuccauaucgaucugggcacuuaccacuuugcaauuuauaagaaaaugaucggggaacagccugaggaccgccaucuaaccagaaaucucuacggauucggcaggauucaggauuuugccgaggagcaccguccagaggaauggaagcggcuggugcgagaccuugauuacuucgagacaggugacaagccguauaucucccaaacuagcccccacuaccauauagaaaaagggaagauuggauugagauucaugccugagggccagcaccuguggccaucgcccgaagugggcaccacaaggaccgggcgcucuaaauaugcucaggauaagcggcucacggccgaggcauuucuguccguccaugagcuuaugccuaugauguucuacuauuuucuguugagagaaaaauacucagaggaaguuagugcugagaaggugcaaggaaggaucaagcgcguaauugaggacguguaugccaucuacgaugcguucgcccgagacgaaaucaacacucucaaagagcuggacgcauguuuagcugauaaggguauucggcguggccaucugccaaaacagaugauagccauccuaagccaggaacacaagaauauggaggaaaaagucagaaagaaacuccaggagaugauugcugacacagaucacaggcuggacaugcuugaucgccaaaccgaccggaagaucagaauagggaggaagaacgccggauugcccaaauccggcgugauugcagauuggcugguucgagacaugaugcgcuuucagccgguggccaaggaugcuucugguaaaccucucaauaacagcaaggcuaauucaacugaguaccggaugcugcagagagcauuagcccuguucgggggcgaaaaagagaggcuuacacccuauuuucgucagaugaacuugaccggaggcaauaacccacacccuuuccuccaugacacgcgcugggaaagucacaccaauauccuguccuuuuaccggagcuaucuaagagcuaggaaggccuuccuggagcgaaucgggcggucugaucgcauggaaaacagacccuuucuccugcuuaaggagccaaaaacagacaggcaaacuuuggucgcaggauggaagucagaguuccaucugccccgggguauuuuuaccgaagccgugcgagauugcuuaaucgagaugggcuacgacgaaguagggaguuauagagagguuggauucauggcuaaagccgugccucucuacuucgaacgcgcaugugaggacaggguccagccauuuuaugauagcccguucaaugugggcaacucccugaagcccaaaaagggucguuuucuuucuaaggaggaacgggcggaggaaugggagagagggaaagagagguuccgcgaccuggaagcguggucgcacagcgccgcacgaagaauugaggaugccuuugcuggcauagaauacgccuccccuggaaacaagaaaaagaucgagcaguugcuccgggaccugucacuaugggaagcauucgagaguaaacugaaggucagggcugauaagauuaaucucgccaaacugaagaaagagauccuugaagcgcaggagcacccauaccaugacuuuaagucuuggcaaaaauucgaacgcgaguugcgucuggugaagaaccaggauaucauuacauggaugaugugcagagacuuaauggaagagaauaaaguugagggccucgauacugggacccuguaucuuaaggacauacggacaaacgugcaggaacagggaagccugaauguacuaaaccacgucaagcccaugaggcucccugugguuguguaccgcgccgauucccgaggucauguccacaaagaggaagcuccacuggcaaccguguauaucgaggaaagagacacuaaguugcugaaacaaggcaauuuuaagucauucguaaaagaccggagguuaaacgggcucuuuagcuucguggauacgggaggccuggccauggagcaguaccccauuucuaaacuucgcguugaguaugaacuggcuaaguaccagacagccagagucugugcauucgagcaaaccuuggaacucgaggagucccugcuaacuagguauccgcaucugccugacaaaaauuuucggaagaugcuugaaaguuggagcgauccacuccuggcgaaauggcccgaguugcacgguaaggugcgucuguuaaucgccgugcgcaacgcuuucucucacaaucaguacccuauguacgacgaagccgucuuuuccucaauucgaaaauaugaucccaguagcccagacgcaaucgaggaaagaauggggcucaacauagcucauaggcugucggaggagguuaagcaggccaaggaaaccguggagcggaucauucaggcauga

SEQ ID NO: 11331 - RNA, 3528 nt, Artificial Sequence
  Cas13b variant__Porphyromonas gulae__WP_039434803.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaacuuugauaaugaccuagaacgcaagucacgacuccguagucugauccuuaaacauuucagcuuucuggagggggcagccuauggaaagaaguuguucgaauccaaaucuucggguaacaagucaagcaaaaauaaggagcucacuaaaaaggagaaggaggaacugcaggcuaacgcacugagucucgauaauuuaaaauccauucuguuugacuuccuucagaaguugaaagauuuuagaaacuacuauucucacuacaggcauagcggcuccucagaacugccucuauucgacgggaauaugcuccaacggcuguacaacgucuuugauguuagugugcagcgcguaaagaucgaccacgagcacaaugaugagguggacccacauuaucacuucaaccaucuugucagaaaaggaaagaaagacagguacggccacaaugauaacccgagcuuuaagcaccauuucguggacggugaagggaugguuaccgaggccggacuguuguucuuugugucucucuuccuggaaaagcgggaugcuauuuggaugcagaaaaagauccgcggcuuuaaaggcgggacagagaccuaucagcaaaugacuaacgaagucuucugccgauccagaauaucauuacccaagcugaaacucgagagccuuaggauggacgauuggaugcuguuggacaugcuaaaugagcuggugcgguguccuaagccacucuacgaucgucugcgcgaagacgauagagccugcuuuaggguacccguugacauccuuccugaugaggacgacacagauggagguggcgaagacccauucaagaacacccuggugcggcaccaggaucgauuucccuauuucgcguugcgcuacuuugaccucaaaaaggucuucacgagucugagauuucauauugauuuagggacuuaucacuucgcaaucuacaaaaagaugauuggagagcagccugaagacaggcaucugacccggaaucuauacggcuuuggucgcauccaggauuucgccgaggagcacagaccagaagaguggaaaaggcucgugcgugaccuggauuauuucgaaacaggggacaagccguacauaucucaaacuagcccccacuaucauauugagaagggaaaaaucggccuucgguuuaugccugaaggccagcacuuguggccaucccccgagguggggaccacacgaaccggaagaucgaaguacgcucaggauaaaaggcugacggccgaggcauuccucucuguccaugaacugaugccuaugauguuuuauuacuuccuucugcgcgagaaguauuccgaagagguuucagcugagcgggugcaagguagaauuaaaaggguaaucgaagacguguacgccgucuacgaugcguuugcccgcgacgagaucaacacucgagacgaauuggaugcaugucucgcugacaagggcauucggcgugggcaucugccaagacagaugauagccaucuuaagucaggagcacaaggauauggaagagaaaauuaggaagaaacugcaggagaugauggcugacacagaucaccgccuagacaugcucgaucggcaaaccgacagaaagaucaggauaggacgcaaaaaugccggccugcccaagagcggugugauugcagauuggcuuguucgagacaugaugcgguuccagccgguggccaaagaugcuuccgggaagccuuugaacaauucuaaggcgaacagcacugaauauagaaugcugcagagggcacucgcccuguuuggcggagagaaagaacguuuaacacccuacuuccgccagaugaaucugaccggcgggaacaauccacacccuuuucuucaugagacgcggugggaaucacacaccaacaucuugaguuucuauagauccuaccucagggcucgaaaggccuuucuggagcggaucggacgcagcgacagagucgagaauaggcccuuccuacugcucaaagaaccaaagacagaucggcaaacucugguggcagguuggaaaggcgaguuucaucuuccccgagggauuuucaccgaagccguaagagacugcuugaucgagaugggacacgacgaaguugcuucuuauaaggaggugggcuucauggccaaggcagucccucuguacuuugagcgcgcgugugaagauagggugcagccauucuaugacucaccguuuaacgucgguaauaguuuaaaacccaagaaagggcguuuccucagcaaggaggaacgggcugaggagugggaaagaggcaaagagagguuucgcgaucuggaagccugguccuacucugcagcccgaagaauugaggacgcuuucgccggaauagaauacgcaucgccuggcaacaagaagaaaaucgagcagcuucugcgggauuugagccucugggaggcuuuugaauccaagcugaaagugagggccgaccgcauuaaccuagcgaagcugaaaaaggagauccucgaagcccaggagcacccauaucaugauuucaagucauggcaaaaauuugaacgugagcugagacuuguuaagaaucaggacaucauuacauggaugaugugccgggauuugauggaggaaaacaaaguggaggggcuggacacuggaaccuuauaccucaaggauauaaggcccaauguacaggaacaggguagucugaacguccuuaaucgcgugaaaccuaugcgacugccaguuguggucuauagagcugacucucggggccacgugcauaaggaggaagcaccccuagccacaguauacaucgaggagagggacaccaaacuccugaagcaagggaacuucaagagcuuugugaaagaucgcagauugaauggacuguucuccuucguugacacuggcgguuuagcuauggaacaguauccgauuucaaagcucagggucgaguacgaacuggccaaauaucagacggcacggguguguguguuugagcuuacacugcguuuggaggaaagccuccugacccgcuacccucaccuaccagaugagucuuuccgagaaaugcuggaguccuggagugacccccuucucgcgaaguggccugaacugcaugggaaagucagauugcugaucgccguuaggaacgcuuuuagccacaaucaauaccccauguaugaugaggccguguucucuuccauucggaaguacgacccaucaaguccugaugcaaucgaggaacgcaugggcuuaaacauagcucacagacucagcgaggaagugaagcaggccaaagagacuguagaaaggaucauucaggcauga

SEQ ID NO: 11332 - RNA, 3528 nt, Artificial Sequence
  Cas13b variant__Porphyromonas sp.__WP_039428968.1__Cas13b
augaccgagcagagcgaaagacccuacaacggcacauauuacacucuggaggacaagcacuucugggccgcuuuucucaaucuugcaaggcauaacgccuauaucacgcugacccacauugaucggcaauuggcguacuccaaagcugacauaacaaaugaucaggacguguuaucuuucaaggcccuguggaaaaacuuugauaaugaccuagaacgcaagucacgacuccguagucugauccuuaaacauuucagcuuucuggagggggcagccuauggaaagaaguuguucgaauccaaaucuucggguaacaagucaagcaaaaauaaggagcucacuaaaaaggagaaggaagaguugcaggcuaacgcacugagucucgauaauuuaaaauccauucuguuugacuuccuucagaaguugaaagauuuuagaaacuacuauucucacuacaggcauagcgaauccucagagcugccucuauucgacggcaauaugcuccaacggcuguacaacgucuuugauguuagugugcagcgcguaaagagagaccacgagcacaaugauaaaguggacccacauaggcacuucaaccaucuuguccggaaggggaaaaaggaccgcuauggacacaaugauaacccgagcuuuaagcaccauuucguggacucugaaggcaugguuaccgaggccggucuguuguucuuugugucccucuuccuggaaaaacgagaugcuaucuggaugcagaagaaaauuagaggguuuaagggaggcacagagaccuaccagcaaaugacuaacgaagucuucugcaggucacggaucagcuuacccaaacugaagcucgagagucuucguacagacgauuggaugcuguuggacaugcuaaaugagcuggugcgcuguccuaagccacucuaugauagacugagggaagacgaucgggccugcuuucgaguacccguugacauacuuccugaugaggacgacaccgauggcgggggagaagacccauucaaaaacacgcuggugcgccaccaggauagauuucccuacuucgcguugagguauuuugaccucaagaaagucuucacuucucugcgguuucauaucgauuuagguaccuaccacuucgcaauuuauaagaaaaugaucggcgagcagccugaagaccgccaucugacaagaaaucuauacggguuuggaaggauucaggauuucgccgaggagcaccguccagaagaguggaagcggcucgugcgagaccuggauuacuucgaaacuggcgacaagccguauaucucccaaaccacaccccacuaccauauagagaaagguaagauugggcuuagauuugugccugaaggacagcacuuguggccaagccccgaggucggcaccacgaggacuggccgcucgaaauaugcucaggauaagcggcugacagccgaggcauuccucucuguucaugaacugaugccuaugauguuuuacuauuuccuucugagagagaaauacuccgaagaggugucagcugagaagguacaagggaggaucaagcgcgugauugaagacgucuaugccaucuacgaugcguuugcccgagacgagaucaacaccuugaaagaacucgacgcaugucuggcugauaaggguauucggcguggacacuuaccaaaacagaugauaggcauccugagucaggagagaaaggacauggaagagaaagugaggaagaaacuacaggagaugauugccgauacugaccaccgccucgauaugcuggaccggcaaacagauagaaagaucaggauagggcgaaagaaugcuggacuucccaaaagcggcguuauugccgacugguuggugcgcgauaugaugcgguuccagccggucgcaaaggacaccuccgguaaaccucugaacaauucuaaggccaacagcacggaauacagaaugcuccagagggcucuggcguuauuugggggcgagaaagaacgucugacccccuauuuccgccagaugaaucuuacaggaggcaacaauccacauccuuuucugcacgagacucggugggaaucacauaccaacauccucaguuucuacagauccuaucugagggcacgaaaggccuuucuagagcggaucgggcgcagcgauagaguggagaauugccccuuccugcuccugaaggaaccaaaaacagacaggcaaacucuuguagcuggauggaagggugaguuucacuugccccggggcauuuucaccgaagccguucgagauugucugaucgagaugggguacgacgaagugggaucuuauagagaggucggcuucauggcaaaagccgugccuuuauacuuugagcgcgcuugcgaagacaggguccagccauucuaugauucaccguuuaacguggguaauagucucaagcccaaaaaggggcguuuccugagcaaggaggaccgggccgaagagugggagagaggcaaagaaagguuucgcgaucuugaggcauggucccauucugcggcucgaagaauuaaggacgccuucgcaggaauagaauacgccucgccuggcaacaaaaagaaaaucgagcagcuguugcgggaucucagccugugggaggcuuuugaguccaagcuaaagguuagggccgacaaaauuaaccuggcaaagcucaaaaaggagauccuggaagcucaggagcacccauaccacgauuucaaaucauggcaaaaguuugaacgcgagcuucguuuggugaaaaaucaggacaucauuacauggaugauguguagagaucugauggaagagaacaagguagagggguuagacaccggaacucucuaucugaaggauauacggcccaauguccaggaacaggguagucuuaacgugcugaauaggguuaaaccuaugcgccuaccaguggucguguaccgagccgacucuagaggccauguacacaaggaggaagcgccccucgccacgguguauaucgaggaacgggacacaaaacuguugaagcaagggaacuucaagagcuuuguuaaagauaggcgccugaauggauuauucuccuucgucgacaccggcggucucgcuauggagcaguacccgauuucaaagcugagaguggaguaugaacuugcaaaauaccagacugccagggugugcgucuuugagcugaccuugcggcucgaagagagccugcuaucucguuauccucaucugccagaugaguccuuccgcgaaaugcuugagaguuggagcgacccccuccuggcuaaguggccugaauugcacgggaaaguucgacuguuaaucgccgugagaaacgcauuuucucauaaucaauaccccauguacgaugaggcgguguucuccucaauuaggaaguaugacccaaguagcccugaugccaucgaagaacggaugggccucaacauagcucaccgccugucggaggaaguaaaacaggccaaggagacagucgaaagaaucauucaggcauga

SEQ ID NO: 11333 - RNA, 3375 nt, Artificial Sequence
  Cas13b variant__Prevotella aurantiaca__WP_025000926.1__Cas13b
auggaggacgauaagaaaaccacaggcagcaucuccuacgaacugaaggacaaacacuucugggccgcuuuucucaaccuugcaagacauaauguguauauuacuauaaaccacaucaauaagcuguuggagauuagggaaaucgauaacgacgagaaagucuuagauauuaagacgcuguggcagaaggggaauaaagaccuaaaccaaaaggcccggcuccgcgaacugaugaccaaacauuuccccuuucuugagacagcgaucuacacuaagaauaaagaggauaagaaggaaguuaaacaggagaagcaggcugaagcccagucucuggagucauugaaagacugccucuuccuguuucuggauaagcuccaagaggcacgaaacuauuacagucacuauaaauacagcgaauuuuccaaggagccugaauuugaggaaggauuacuggagaaaauguauaauauauucgguaacaauauccagcuugugauuaacgacuaccagcauaauaaggauaucaacccagacgaggauuuuaagcacuuggaccguaaaggccaguucaaguacucuuuugccgacaaugaagggaacauuaccgagucgggacugcuauucuuuguaucacucuuccuggagaaaaaggaugcuaucuggaugcaacagaaacuuaacggcuucaaggacaaucuggagaacaagaaaaagaugacacacgaaguguuuuguagaagcaggauauugaugccgaaacuccggcuggagaguacccagacucaggauuggauuuuacuggacaugcucaaugagcuuauccgcugccccaagucccuguaugaaagauugcaaggugaugacagggagaaauucaaggucccuuuugauccagcagacgaagauuacaacgccgagcaggaacccuucaagaauacacuaauucggcaucaggaccgcuuuccuuauuucgugcugcgauacuuugauuauaacgagaucuucaaaaaucucagauuucaaaucgaccuggggaccuaccacuucucuauuuauaagaaacuuauaggaggccagaaggaggacaggcaucugacgcacaaauuguacggcuuugaacggauccaggaguucgcuaagcagaaccguccagaugaauggaaggccauuguuaaagaccucgauacuuacgagaccagcaauaagcgcuauaucuccgagacaacuccccacuaccaucuggaaaaccagaaaauagggauuagauuuaggaauggaaacaaggagaucuggccuucauuaaaaaccaaugacgaaaacaaugagaagaguaaauauaagcuggauaagcaauaccaggcggaagcauuccuaagcgugcacgagcuccugccaaugauguucuauuaccuuuugcugaaaaaggagaaaccgaacaacgacgaaaucaaugccucuauugucgaggguuuuaucaagcgggaaauucgaaacauauucaaacucuaugaugcuuuugccaauggcgagaucaacaauauugacgaucuggaaaaguacugugcagacaaggggauccccaaacgccaucuuccuaagcagaugguggcuauccuguacgaugagcacaaagacaugguaaaggaggccaaaagaaagcaaaaggaaaugguuaaagauacaaagaaauugcucgcgacccuggagaagcagacgcagaaagaaaaggaggacgacggaaggaacgugaaguuacugaaauccggcgaaauugcccgguggcuagucaaugauaugaugcgcuuccagccagugcaaaaggacaacgaggguaaaccccucaauaacucaaaggcaaauagcacugaguaucagaugcugcagagaagucuugcuuuguacaacaaugaagagaaaccuacaagguauuuucgucaggugaaccugauagaaucuaauaacccacaucccuuccucaaguggaccaaaugggaggagugcaacaauauccugacuuuuuacuauuccuacuuaacaaagaagauugaguuccugaacaaacuuaagccggaagauuggaaaaagaaucaauauuucuugaaacucaaggaaccuaagaccaaccgggagacgcugguccagggguggaaaaauggauucaaccuaccccgaggcaucuuuaccgaaccaauuagagagugguucaagaggcaccagaauaacagcaaagaguacgaaaagguugaggcccuggaccgcgugggccucguaacaaaagugaucccucuguuuuucaaggaagaguacuucaaggauaaagaagagaauuuuaaggaggacacucaaaaagaaauaaacgauuguguccagcccuucuauaauuuuccauacaacguggggaauauccacaagcccaaagagaaggacuuccuucaucgggaagagagaauugaauugugggauaagaaaaaggacaaauuuaagggauauaaagagaagaucaagucgaaaaagcugaccgagaaagauaaggaagaguucaggucuuacuuagaauuucaguccuggaacaaauucgagcgcgagcuccgacugguucggaaucaggacauugugacauggcuucugugcaaggaauugaucgauaaacucaagauagacgagcugaacauugaagaacuaaagaaacugcgucucaacaauaucgacacugauaccgcuaagaaagaaaagaacaauauucugaacagagucaugccuauggagcuuccagugacaguauaugagaucgacgauucacacaaaauaguuaaggacaagccguugcauaccaucuacauuaaagaagccgagacuaagcuguuaaaacaagguaauuuuaaggcacucgugaaagauaggcgccugaacggccuuuucaguuuugucaagacgaauagcgaagccgaguccaagcggaaccccaucucuaaacugagaguggaauaugagcuaggggaguaccaggaagcuaggauugagaucauacaggacaugcucgcgcuggaagagaaguugauuaauaaauacaaggaucugccuacaaacaaauucagcgaaauguuaaauucauggcucgagggaaaggacgaggcagauaaggcccgauuccagaacgacgucgauuuucugaucgcugugcgcaaugccuucagucacaaccaauauccaaugcacaauaaaaucgaauuugcaaacauuaagcccuucucccuuuacaccgccaauaacagcgaggaaaaaggccuggguaucgcuaaccaguugaaggacaaaacuaaggagaccacagacaaaauuaagaagauagagaaaccuaucgaaaccaaggaguga

SEQ ID NO: 11334 - RNA, 3384 nt, Artificial Sequence; identical to SEQ ID NO: 11284
  Cas13b variant__Prevotella buccae__EFU31981.1__Cas13b

SEQ ID NO: 11335 - RNA, 3384 nt, Artificial Sequence
  Cas13b variant__Prevotella buccae__WP_004343581.1__Cas13b
augcagaagcaagacaaacuguucguggauagaaagaaaaacgccaucuuugcuuuccccaaguacauuaccauaauggagaaucaggaaaaaccugagccaaucuauuacgaacucacagacaagcacuuuugggcagccuuccuuaaccuggcgaggcauaaugucuauacuacgauuaaccacaucaaucggcgcuuggagauugcugaauuaaaggaugacggcuacaugauggauaucaaagggagcuggaacgagcaggccaagaaacuggacaagaaaguucgacuacgugaucucauaaugaagcauuuuccguuccuggaggcagccgcuuaugaaaucaccaauuccaagucucccaacaauaaagagcagagagaaaaggagcaaucagaggcacuuagucugaacaauuugaaaaacgugcucuuuauuuuccuggaaaagcugcagguacucaggaauuacuauagccacuacaaauacuccgaggaaucuccuaagccaaucuuugagacaucguuacugaaaaacauguauaagguguucgacgccaauguccggcuugugaagcgcgauuacaugcaucacgaaaacauugacaugcagagagauuuuacucacuugaacaggaaaaagcagguuggacggaccaaaaauaucauagacucacccaacuuccauuaucacuuugcugauaaggaggguaauaugacaauugccggccugcuauucuucgugagccucuuucuggacaaaaaggacgcgaucuggaugcaaaagaaacuuaagggguucaaagauggacgcaaccugcgagagcagaugaccaaugaagucuuuugcagaaguaggauuuccuugccuaagcucaaacuggagaacgugcagacuaaggacuggaugcaguuagauaugcugaaugaacucguacgguguccaaagucucuuuacgagcgucugcgcgaaaaagacagagagagcuucaagguucccuuugauaucuucuccgacgauuaugacgcagaggaggagccuuuuaaaaacacauuggugaggcaucaagaucgguucccauacuuuguccuacgauauuucgaccugaaugaaaucuuugagcagcuccgcuuccagauugaucugggcaccuaccacuuuucaauauacaacaagagaaucggugacgaagacgaggugaggcaccuuacgcaucaccuguauggguucgcccggauucaagauuucgcucagcagaaucagccggagguguggcgcaaauuggucaaggaccucgauuacuuugaagccagucaagagcccuauaucccuaagacugcaccacauuaccaccuggaaaacgagaaaauaggaauuaaguucugcagcacccauaauaacuuauuucccucucugaaaacagagaagacuuguaauggcagauccaaauucaaccuaggcacccaguuuacagcugaagccuuccucucaguucacgagcugcuuccuaugauguuuuauuacuugcugcucaccaaggacuauagcaggaaagaaagugcggauaagguggaggggaucauccguaaggaaauuucuaacaucuacgccauuuacgacgcauucgcuaauggagagauaaacuccaucgccgaucugacgugccggcuucagaaaacuaauauucugcagggucacuugccaaagcaaaugaucagcauccucgagggccgacagaaagacauggaaaaggaggcugaaagaaaaauuggggagaugauagaugacacacagaggcgccuggauuuacuguguaagcagaccaaccaaaagauccggauuggaaaaagaaaugccggccuacucaagucggguaaaaucgcagacuggcugguaaacgauaugaugagguuucagcccgugcagaaggaccagaauaacauuccgaucaauaacucuaaagccaauuccacugaauaucgcaugcuucaacgagcuuuggcgcuguucgggucagagaacuuucggcucaaggcauacuucaaucagaugaaccuggucggaaaugacaacccucaucccuuuuuagccgagacacagugggaacaccaaaccaacauacugaguuucuaucguaauuaccuugaggcuagaaagaaauauuugaagggccucaaaccacagaacuggaagcaguaccagcauuuccugauccuaaaagugcaaaagacgaauaggaacacccugguuacaggcuggaagaauagcuuuaaccucccucgcgggauuuucacucagcccauccgggaaugguuugagaaacacaauaacuccaagagaauuuaugaucagauccugucuuucgacagggugggauuugucgccaaagcaauaccacuuuacuucgccgaagaguacaaggauaaugugcagcccuuuuaugacuacccuuucaacauugguaauaaauugaagccacaaaaaggccaguuucuggauaagaaggagcgaguagaauuauggcagaaaaacaaggaacucuucaaaaauuauccgagcgaaaagaaaaagaccgaccuggcuuaccuugauuuucugucauggaagaaauucgagcgcgaguugcggcucaucaagaaccaggacauuguuacauggcugauguucaaagaacuauuuaauauggccacuguggaggggcugaagaucggagaaauacaccucagagauaucgacaccaacacagcaaacgaggaaaguaauaacauucugaauaggaucaugcccaugaaacuuccugucaagaccuaugagacugauaacaagggcaauauuuugaaagagcguccacuggcgacguucuacaucgaagagacagaaaccaagguguuaaaacaagguaacuuuaagguccucgcuaaagaccgccggcugaaugggcuucuguccuucgccgagacuaccgauauagaccuagaaaagaaccccauuacaaagcucagcguggaccaugagcugaucaaauaucagaccacuagaaucucuauuuuugagaugacauugggccuggaaaagaaauuaaucaauaaguacccuacgcucccaaccgauucauucaggaacaugcuggagcgauggcuucagugcaaagcaaaucggcccgaacugaagaacuacguuaauaguuugauugccgugcgcaacgcuuuuagccacaaucaauauccgauguacgacgccacucucuucgcagagguaaagaaauuuacacuguucccuuccgucgauaccaagaaaauagaacuaaacaucgcuccacagcugcuugagauugugggaaaggccaucaaagagauugaaaagucugagaauaaaaacuga

SEQ ID NO: 11336 - RNA, 3402 nt, Artificial Sequence
  Cas13b variant__Prevotella falsenii__WP_036884929.1__Cas13b
augaagaacgacaauaacagcaccaaauccacagauuacacucugggcgacaagcacuucugggccgcuuuucucaaucuugcaagacauaacguguauaucacggucaaucacauuaacaaaguucuggaguugaagaauaaaaaggaucaggaaauaaucauugacaacgaucaagacaucuuagccauuaagacccugugggggaaaguggauacagacaucaauaagaaagauaggcuacgggagcucauaaugaagcauuuccccuuucuggaagcggcuacuuaccagcagucuucaaccaacaauacaaaacagaaggaggaagaacaagccaaggcacagaguuucgagagccuuaaagacugccuguuuuuguuccucgaaaagcugcgcgaggcccgaaacuauuacucccacuauaaacauucuaagucgcuggaggagccuaaacucgaggaaaaguuacuggagaauauguacaacaucuuugauaccaauguacagcuugugauuaaagacuaugaacacaacaaggauaucaacccagaggaagacuucaagcacuugggacgugcugagggugaguuuaauuacuacuucacuagaaacaaaaagggcaauauuacagaaucagggcugcuauuuuucgucagccucuuucuggagaaaaaggacgcaaucugggcccagaccaaaauaaagggauucaaggauaacagggaaaauaaacaaaagaugacgcaugagguguucugucggagucgcaugcuucugccgaaauugagacucgaauccacucagacccaggacuggauucuguuagauaugcugaacgagcucaucaggugccccaagucucuuuauaaacggcugcagggcgagaagcgcgaaaaguuucgaguuccuuucgacccagcugaugaggacuacgaugccgaacaagagcccuuuaaaaauacauuggugagacaccaggacagguucccuuauuuugcgcuacgguacuucgauuauaacgaaauuuuuacuaaucugcguuuccagaucgaccucgguaccuaccauuuuagcaucuauaagaaacaaauuggggauaagaaagaggaccgccaccugacacacaaacuuuacggauucgagagaauacaggaauuugcaaaggagaacaggccagacgaauggaaagcccuggucaaggauuuggacaccuucgaggaguccaaugaacccuacaucucagagacgacuccucauuaucaccucgaaaaccagaaaauuggcauccggaauaagaacaaaaagaaaaagaagacaauauggccaagucuggagaccaaaacuacagugaaugaacgaagcaaguacaacuuaggcaaaucuuuuaaggcugaggccuuccuguccguacaugagcuacucccgaugauguucuauuaccugcuuuugaacaaagaggaacccaauaacgggaagauuaaugcaucaaagguugaaggaaucaucgagaaaaagauucgcgauaucuauaaacuguacggugcuuuugccaacgaagagauuaauaacgaggaggaacucaaggaauauugugagggcaaagacauagcgaucagacaucugccuaagcagaugauugccauccuuaagaaugaauacaaagauauggcaaagaaagcugaggacaagcaaaagaagaugaucaaggauaccaaaaagaggcuggccgcuuuggacaaacaggugaagggggaggucgaagauggaggccggaacauuaaaccacucaagagcggucgcauagccaguuggcuggugaaugacaugaugagauuccagcccgugcagagggaucgugacggguacccuuuaaacaauucuaaagcaaacuccacggaguaucaacugcuacagcggacccucgcccuguuuggaagcgaacgagagagacuugcuccauacuucaggcagaugaauuugaucggcaaggauaacccccacccguuucugaaggacacaaaauggaaggagcacaauaacauucucucguucuaucgcucuuaccuggaagcgaaaaagaacuuuuuaggcucccugaaaccugaggacuggaagaagaaucaguauuuccuuaaauugaaggaacccaaaacuaaccgggagacccucguccaaggguggaagaauggauuuaaccugccaagagguaucuucacagaaccuauuagggagugguuuauccgccaccagaaugagucagaagaguacaaaaagguuaaggauuucgaccgaauaggccuaguggcaaaaguaaucccccuguuuuucaaggaagauuaucagaaagagauugaagacuacgugcagccauucuacggguaucccuuuaacgucggaaauauccauaacagucaagagggcacuuuccucaauaagaaagagcgggaggaacuguggaaggguaacaagaccaaauuuaaggauuacaaaacaaaggaaaagaauaaggagaagaccaacaaagacaaguucaaaaagaaaacugaugaagagaaggaggaauuucguagcuaucuugacuuccaguccuggaaaaaguuugagagagaauugaggcuggugcgcaaucaggauauuguuacgugguuacucugcauggagcugaucgacaaacuuaaaauagaugagcugaacauugaagaguugcaaaagcuccggcugaaagacaucgauacagacaccgccaagaaagaaaagaauaacauucuaaacagaaucaugccuauggagcugccagugacugucuacgaaaccgacgauucuaauaacauaaucaaggacaaaccgcuccacacaauuuauaucaaggaggcugagaccaaacugcuuaagcaggggaauuucaaagccuuggugaaggauaggcgacugaacggcuuauuuagcuucguagaaacuucaagugaggcagaacucaaguccaaacccauuagcaagucucugguugaguacgaacuuggagaguaucagcgcgcccggguggagaucauaaaagacaugcugagacuagaagagacacucauuggcaaugaugaaaagcugccuacgaacaaauuuaggcagauguuggacaaguggcuggagcauaagaaagaaaccgaugacacugauuuaaagaaugacgucaaacuccugacagaggugcguaacgcuuucucacacaaucaauacccaaugcgcgaucggaucgccuucgcaaacaucaagcccuuuagucuuagcuccgcgaauaccucuaacgaggaagggcugggaauugcuaaaaaguugaaagacaagacaaaggagacuaucgacagaauuauagaaaucgaggagcagaccgccacgaaaagguga

SEQ ID NO: 11337 - RNA, 3402 nt, Artificial Sequence
  Cas13b variant__Prevotella intermedia__BAU18623.1__Cas13b
auggaggacgauaagaaaaccacagacagcaucuccuacgaacugaaggauaaacacuucugggccgcuuuucucaaccuugcaagacauaauguguauauuacugucaaccacauaaauaagguucuggaguugaaaaacaagaaggaccaggauaucauuaucgacaaugaucaagacauuuuagccaucaaaacgcauugggaaaaggugaacggcgaucugaauaaaaccgagaggcuacgggaacucaugacaaagcacuuccccuuucuggagacugcgauauacucuaaaaacaaggaggacaaggaagagguaaaacaggaaaagcaggcuaaagcccagucauucgauagucuuaagcauugccuguuuuuguuccucgagaaacugcaagagacccgcaauuauuacagccacuauaaguacuccgaaucuacaaaagagccuaugcuggaaaaggagcucuuaaagaaaauguauaacaucuuugacgauaauauucagcuggugaucaaggacuaccagcacaacaaagacauuaauccagaugaagacuucaagcaucuugaucgaaccgaggaggacuuuaacuacuauuucacucguaauaaaaaggggaacaucacagaaucgggauugcuguuuuucgucucacuauuucucgagaagaaagaugcaauauggaugcagcaaaagcugagagguuucaaagacaacagggaaagcaagaaaaagaugacccacgagguguucugucggagucgcaugcuucugccgaaguugagacucgaauccacgcagacucaggauuggauucuguuagacaugcugaaugagcucaucaggugccccaaaucucuuuacgagcggcugcagggcgaagaucgcgagaaguuuaaaguuccuuucgacccagccgaugaagacuaugacgcugagcaagaacccuuuaagaacaccuuggugcgacaucaggauagauucccuuacuuugcacuaagguauuucgacuacaaugagauuuuuacaaaccugcgguuccagaucgaucucgggacuuuucacuucagcaucuauaaaaagcugauuggaggccaaaaggaggaccgucaccuuacccauaaacuguacgguuuugaacgcauacaggaguucgccaagcagaauagaccagaugaauggaaagcuaucgucaaggacuuggauacauacgagaccuccaacgagagguauauuucagaaacgacuccccacuaccaucucgagaaucagaaaaucgggauacgguuucgaaacgacaaugaugaaauuuggccuagucugaagacaaacggagagaauaacgaaaaaucaaaguauaaguuagacaaacaauaccaggccgaggcguuccugucugugcacgagcuacucccaaugauguucuauuaccugcuuuugaagaaagaagaaccgaauaacgauaagaaaaaugcauccaucguagaaggcuuuaucaagcgcgagauuagagacauguauaagcuguacgaugccuucgcuaacggcgaaaucaacaauauugacgaccucgagaaauacugugaggauaaggggauacccaaaaggcaucugccuaagcagaugguugccauccuuuaugacgaacacaaagauauggugaaggaggcaaagcggaaacagcgcaagauggucaaagacaccgaaaagcuguuggcugcccucgagaaacaaacucaggaaaagacagaggauggagguagaaacauuaggcuguuaaagucaggcgagaucgcgcguuggcuggugaaugacaugaugcgguuucagccagugcagaaagauaacgaagggaauccccuaaacaauagcaaggccaacaguaccgaguaccaaaugcuccagcgaucucuggcacuuuauaauaaagaagagaagccuacgagauacuucaggcaggucaacuugaucaauuccagcaacccacaccccuuucugaaauggaccaagugggaggaaugcaauaacauucucucguucuaucgcucuuaccugacuaaaaagauagaguuuuuaaauaagcugaaaccggaagacugggagaagaaccaguauuuccuuaaauugaaggaaccuaaaacaaaccgggagacccucguucaaggauggaagaauggcuuuaaccugcccagagguaucuucacagagccaauuagggaaugguuuaagcgccaucagaaugauuccaaagaguacgaaaagguggaggcucuagaccgaguagggcuggugacuaaagucaucccucucuucuuuaagaaagaagauucaaaggacaaggaggaggaucugaaaaaggacgcccagaaagaaauuaacaauugugugcaacccuucuacaguuucccauauaacguuggaaauauccacaagcccgacgagaaagauuuucuucaucgggaggagcguauagaauugugggacaagaagaaagauaaguucaaaggcuacaaggcuaaagucaagagcaagaaacugaccgacaaggagaaagaggaauauagauccuacuuagaguuucagucuuggaacaaguucgaaagggagcuccgccuggugcggaaucaggauaucgugacauggcuucugugcaccgaguugauugacaaacucaagguagaaggccugaacguugaggaacugaaaaagcugagacucaaggauaucgacacugauacggccaaacaggagaagaauaacauucugaauagggugaugccuaugcaacuuccagucacaguguaugaaaucgacgauagccacaacauagucaaagaccgaccguugcacaccguguacauugaggagacuaagaccaaacuguuaaagcaggggaauuuuaaggcacucguuaaagaccgccggcugaacggacuuuucucauuuguggauacaaguuccgaagccgagcuaaagagcaaccccaucucuaaaagccuaguagaauaugagcucggugaauaccagaaugcuagaauugagaccaucaaggacaugcuguugcuggaggaaacuuuaauagagaaauacaagaaccucccuacagauaauuucagugacaugcugaacggcuggcuugaagggaaggaugaggcggacaaagcaagguuucagaaugaugucaagcuguugguggccguucguaacgcuuucagccauaaucaauauccaaugcgcaaccggaucgccuuugcaaauauuaaccccuucucccucucuucggccgacacgagcgaagagaaaaagcuggauaucgcuaaucagcuaaaagacaagacccacaagauuaucaaaagaauaauugagaucgaaaagccuaucgagacuaaagaauga

SEQ ID NO: 11338 - RNA, 3405 nt, Artificial Sequence
  Cas13b variant__Prevotella intermedia__AFJ07523.1__Cas13b
augaagauggaggacgauaaaaagaccaaagaaagcacaaacaugcuggacaauaagcacuucugggccgcuuuucucaaccuugcaagacauaauguguacaucacugucaaccacauuaauaaaguucuggaguugaagaacaagaaagaucaggacauaaucauugauaaugaccaagauaucuuagccauuaagacgcauugggaaaaagugaacggcgaccugaauaagaccgagaggcuacgggaacucaugacaaaacacuuccccuuucuggagacugcgaucuauaccaagaacaaggaggauaaagaagagguaaagcaggaaaaacaggcuaaggcccaguccuucgacucucuuaaacauugccuguuuuuguuccucgagaagcugcaagaggcacgcaauuacuauucacacuacaaauauagugaaagcacaaaggagccuaugcuggaaaaggagcuccuuaaaaagauguacaacauauuugaugacaauauccagcuggugauuaaagauuaucagcacaacaaggacaucaauccagacgaagauuucaaacaucuugaccgaaccgaggaggaauuuaacuacuacuucacuacaaacaagaaggggaauauuaccgccuccggauugcuguuuuucgucucucuauuucucgagaaaaaggaugcuaucuggaugcagcaaaaacugcgugguuucaaggacaacagagaaucgaaaaagaagaugacgcacgagguguucuguaggucacggaugcuucugccgaaauugcgccucgaaagcacucagacccaggauuggauacuguuagacaugcugaaugagcucauuagaugccccaagagucuuuaugagaggcugcagggcgaauaccggaaaaaguuuaacguuccuuucgauuccgcagacgaggauuaugacgccgaacaagagccauuuaaaaauacauuggugcgccaucaggaucgauuccccuacuuugcucuaagauauuucgacuacaacgaaaucuuuacuaaucugagguuccagauugaccucgggaccuaucacuuuucuaucuacaagaagcugaucggaggccaaaaagaggaucggcaccuuacacauaagcuguacgguuucgagcguauucaggaauuugccaaacagaaccgcaccgacgaguggaaggcgauagucaaagauuucgacacguaugaaacuagcgaggagccuuacaucuccgaaacagcaccacacuaucauuuggagaaucagaagauugggaucagauuuaggaacgauaaugacgaaauauggcccucacucaaaaccaacggagagaauaacgaaaagcggaaguacaaacuggauaagcaauaucaggccgaggcuuucuuaagugugcacgagcugcuaccuaugauguucuacuaucuccugcuuaaaaaggaagaaccaaauaacgacaaaaagaacgccagcauuguagaaggcuuuaucaagcgagagauccgcgauauuuacaaauuguacgacgcauucgcuaauggcgaaaucaacaauauugaugaccuggagaaguauugugaggauaaagggauaccgaagagacaucuccccaaacagaugguugccauccuguacgacgaacacaaggacauggcggaggaagccaagaggaaacagaaggagauggugaaagauacuaagaaacuucuggcaacauuggaaaagcaaacccagggagagauugaggacgguggccggaacauccgccuccugaagucuggggaaaucgcuagaugguuagucaaugauaugaugagguuucagccugugcagaaagacaacgagggaaauccacugaacaauuccaaggccaacucaacggaauaucaaaugcuacagcguagccucgcucuguacaauaaagaggagaagcccacccgguauuuccgacaggugaaccuuauuaauaguucuaacccucacccauuuuugaaauggacaaagugggaagagugcaauaacauacuguccuucuacagaagcuaucucacuaaaaagaucgaauuucugaacaaguuaaaacccgaggauugggaaaagaaucaguacuuccugaaacuuaaggagccgaaaaccaacagggagacauugguccaaggcuggaagaaugguuuuaaccucccucgcgggauuuucacugaacccauccgggagugguuuaagagacaucagaaugacucggaagaguacgaaaaaguugagacccuggauaggguggggcuaguaacaaaggugauuccacuguucuuuaaaaaggaggacucuaaagauaaggaagaguaucucaagaaagacgcccagaaggaaaucaacaauuguguccaaccuuucuacggcuuccccuauaacgugggcaauauacacaaaccagaugagaaggacuuucugcccuccgaggagcgcaaaaaguuauggggagauaagaaauacaaguucaaaggauauaaggcaaaaguuaagucaaagaaauugaccgacaaggagaaagaagaguaccgaaguuaucuggaauuucagagcuggaacaaguucgagcgggaguuacgucucgugagaaaucaggacaucgucacuuggcugcuuugcacggaacugauugauaaauugaagguggagggucucaacguagaggaacugaaaaagcuaaggcugaaggacaucgauacagacaccgccaaacaggaaaagaauaacauucucaaucgcguuaugccuaugcaacugccagugacugucuacgagaucgaugacucccauaacauagugaaagaucggccgcuucacaccgucuacauugaggaaacaaagaccaaauugcugaagcagggcaacuuuaaggcuuuagugaaagacagaaggcucaaugggcuguucucuuuuguugauacuagcucagagacagaacuuaagaguaaccccaucuccaaaagccugguggaguaugaacuaggagaguaccagaaugcgcgaauugagacgaucaaggacaugcuccuguuggaagagacccugauagaaaaauauaagacuuuaccuacagauaacuucucugacaugcucaauggcuggcuggaggguaaggacgaagcagauaaagcccgcuuucagaacgacguaaaacuucuggucgcugugcggaaugccuucucacacaaccaauacccaaugagaaauaggaucgcauuugccaacauuaaucccuucaguuugagcuccgcugauaccucugaggagaagaagcucgacaucgccaaccagcugaaagauaagacacauaagauuaucaaacguauaauugaaaucgagaagccuaucgaaacuaaagaguga

SEQ ID NO: 11339 - RNA, 3399 nt, Artificial Sequence
  Cas13b variant__Prevotella intermedia__WP_014708441.1__Cas13b
auggaggacgauaagaaaaccaaggaaagcacaaacaugcuggacaauaaacacuucugggccgcuuuucucaaccuugcaagacauaauguguacaucacugucaaccacauuaauaagguucuggaguugaaaaacaagaaggaucaggacauaaucauugauaaugaccaagauaucuuagccauuaaaacgcauugggaaaaggugaacggcgaccugaauaaaaccgagaggcuacgggaacucaugacaaagcacuuccccuuucuggagacugcgaucuauaccaaaaacaaggaggauaaggaagagguaaaacaggaaaagcaggcuaaagcccaguccuucgacucucuuaagcauugccuguuuuuguuccucgagaaacugcaagaggcacgcaauuacuauucacacuacaaguauagugaaagcacaaaagagccuaugcuggaaaaggagcucuuaaagaaaauguacaacauauuugaugacaauauccagcuggugauuaaggauuaucagcacaacaaagacaucaauccagacgaagauuucaagcaucuugaccgaaccgaggaggaauuuaacuacuacuucacuacaaacaaaaaggggaauauuaccgccuccggauugcuguuuuucgucucucuauuucucgagaagaaagaugcuaucuggaugcagcaaaagcugcgugguuucaaagacaacagagaaucgaagaaaaagaugacgcacgagguguucuguaggucacggaugcuucugccgaaguugcgccucgaaagcacucagacccaggauuggauacuguuagacaugcugaaugagcucauuagaugccccaaaagucuuuaugagaggcugcagggcgaauaccggaagaaauuuaacguuccuuucgauuccgcagacgaggauuaugacgccgaacaagagccauuuaagaauacauuggugcgccaucaggaucgauuccccuacuuugcucuaagauauuucgacuacaacgaaaucuuuacuaaucugagguuccagauugaccucgggaccuaucacuuuucuaucuacaaaaagcugaucggaggccaaaaggaggaucggcaccuuacacauaaacuguacgguuucgagcguauucaggaauuugccaagcagaaccgcaccgacgaguggaaagcgauagucaaggauuucgacacguaugaaacuagcgaggagccuuacaucuccgaaacagcaccacacuaucauuuggagaaucagaaaauugggaucagauuuaggaacgauaaugacgaaauauggcccucacucaagaccaacggagagaauaacgaaaaacggaaguacaagcuggauaaacaauaucaggccgaggcuuucuuaagugugcacgagcugcuaccuaugauguucuacuaucuccugcuuaagaaagaagaaccaaauaacgacaagaaaaacgccagcauuguagaaggcuuuaucaagcgagagauccgcgauauuuacaaguuguacgacgcauucgcuaauggcgaaaucaacaauauugaugaccuggagaaauauugugaggauaaggggauaccgaaaagacaucuccccaagcagaugguugccauccuguacgacgaacacaaagacauggcggaggaagccaagaggaagcagaaagagauggugaaggauacuaaaaagcugcuugcaacauuggaaaaacaaacccagggagagauugaggacgguggccggaacauccgccuccugaagucuggggaaaucgcuagaugguuagucaaugauaugaugagguuucagccugugcagaaggacaacgagggaaauccacugaacaauuccaaagccaacucaacggaauaucaaaugcuacagcguagccucgcucuguacaauaaggaggagaaacccacccgguauuuccgacaggugaaccuuauuaauaguucuaacccucacccauuuuugaaguggacaaaaugggaagagugcaauaacauacuguccuucuacagaagcuaucucacuaagaaaaucgaauuucugaacaaguuaaagcccgaggauugggaaaagaaucaguacuuccugaaacuuaaagagccgaagaccaacagggagacauugguccaaggcuggaaaaaugguuuuaaccucccucgcgggauuuucacugaacccauccgggagugguuuaagagacaucagaaugacucggaagaguacgaaaagguugagacccuggauaggguggggcuaguaacaaaagugauuccacuguucuuuaagaaagaggacucuaaggauaaagaagaguaucucaagaaggacgcccagaaagaaaucaacaauuguguccaaccuuucuacggcuuccccuauaacgugggcaauauacacaagccagaugagaaagacuuucugcccuccgaggagcgcaagaaacuuuggggagauaagaaguacaaauucaagggauauaaagcaaagguuaaaucaaagaaguugaccgacaaagagaaggaagaguaccgaaguuaucuggaauuucagagcuggaacaaauucgagcgggaguuacgucucgugagaaaucaggacaucgucacuuggcugcuuugcacggaacugauugauaaguugaaaguggagggucucaacguagaggaacugaagaaacuaaggcugaaggacaucgauacagacaccgccaagcaggagaaaaauaacauucucaaucgcguuaugccuaugcaacugccagugacugucuacgaaaucgaugacucccauaacauagugaaggaucggccgcuucacaccgucuacauugaggaaacaaaaaccaaguugcugaaacagggcaacuuuaaggcuuuagugaaggacagaaggcucaaugggcuguucucuuuuguugauacuagcucagagacagaacuuaaaaguaaccccaucuccaagagccugguggaguaugaacuaggagaguaccagaaugcgcgaauugagacgaucaaagacaugcuccuguuggaagagacccugauagaaaaguauaaaacuuuaccuacagauaacuucucugacaugcucaauggcuggcuggaggguaaggacgaagcagauaaggcccgcuuucagaacgacguaaaacuucuggucgcugugcggaaugccuucucacacaaccaauacccaaugagaaauaggaucgcauuugccaacauuaaucccuucaguuugagcuccgcugauaccucugaggagaagaaacucgacaucgccaaccagcugaaggauaaaacacauaagauuaucaagcguauaauugaaaucgagaaaccuaucgaaacuaaggaguga

SEQ ID NO: 11340 - RNA, 3381 nt, Artificial Sequence
  Cas13b variant__Prevotella intermedia__WP_036860899.1__Cas13b
auggaggacgauaagaaaaccacagacagcaucagauacgaacugaaggauaaacacuucugggccgcuuuucucaaccuugcaaggcauaauguguauauuacugucaaccacauaaauaagauccuggaggaaggcgagauuaaccgggacggguacgaaacgaccuugaaaaauacauggaacgagaucaaggauauuaauaagaaagaccgcuuauccaagcugaucauaaaacauuuccccuuucuagaggccgcgacuuaucgacucaacccuaccgauacaaccaagcagaaagaagagaagcaagcugaagcccagucucuggagucacuucguaagaguuucuuuguuuucaucuacaaacugagagacuugaggaaucacuauagccauuacaagcacuccaaaucucucgagcggccaaaguuugaagagggacugcuggagaaaauguauaacauuuucaaugcaucgauccgccucgugaaggaagauuaccaguacaacaaagacauuaauccggaugaagacuuuaagcacuuagauagaacugaggaggaauuuaacuauuacuuuacaaaggacaaugaggguaacaucaccgaaucaggccugcuuuucuuuguaaguuuguuccuggagaaaaaggacgccauauggaugcagcaaaaacuaaggggguucaaggauaaccgggaaaauaaaaagaagaugacgaacgagguguuuugccgcagucgaaugcuccugcccaaacuuagacugcaguccacucagacccaggacuggauuuugcucgauaugcugaaugaguuaaucagguguccuaagucucuguaugaacggcuccgugaggaagaccgcgagaaauucagagucccaauugaaaucgcugaugaggacuacgaugcagagcaagaacccuuuaagaacacacuugugaggcaucaggaccgguucccuuauuuugcccugcgauacuucgauuauaaugagaucuuuacuaacuugcgcuuccagauugaccuaggaaccuaccacuuuagcauauacaaaaagcagaucggcgauuauaaggaaucccaucaccugacacacaaacucuacgguuucgagaggauucaagaguuuaccaagcagaauagaccagacgaauggcggaaauucguuaagacguuuaacucauucgagacuagcaaagaacccuauaucccugagacaaccccacauuaccaccuggaaaaucagaagauagggauucgcuucagaaacgacaaugauaagaucuggccgagccuuaaaacuaacucugagaagaaugagaaauccaaguauaaacuggacaagucauuucaagcugaagccuucuugagcgugcaugagcuccugcccaugauguuuuacuauuuacugcuaaaaacagaaaacaccgauaaugacaacgagaucgaaacgaagaagaaagagaacaagaaugauaaacaggagaagcacaaaauugaagagaucauugaaaacaagauaaccgagaucuacgcgcucuacgacacauucgcaaauggagaaauuaagaguaucgaugagcuggaggaauauugcaaaggcaaggacaucgagauuggccaucuuccuaaacagaugauagccaucuugaaggaugaacacaaagucauggcuacugaggccgagaggaagcaggaagagaugcugguggacguacaaaagucucucgaaucccuggauaaccagauuaaugaggaaaucgagaacguugagcguaaaaauagcucgcuuaagucugggaaaauugcauccuggcuggugaacgacaugaugcgguuucagccaguccagaaggauaaugaaggaaaacccuugaacaauucaaaggcuaacaguaccgaguaccaacuccugcagcgaacauuagccuucuuugguagcgaacacgagagacuggcgccuuauuucaagcagacuaaacuaaucgaauccucuaauccacaucccuuucucaaggacaccgagugggagaaauguaacaauauacugagcuucuacaggucauaucuugaagccaagaaaaacuuuuuggagagucugaagccggaagacugggagaaaaaccaguacuuccucaagcugaaggaaccuaaaacaaagcccaaaaccuuagugcaaggcuggaagaauggguuuaaccugccacgcggaaucuucacugagccuauucggaaaugguucaugaagcacagagagaauaucacgguggcagaacuuaagagggucggcuugguugcuaaagugauuccccucuuuuucuccgaggaauauaaggauagcguacagccauuuuacaacuaccauuucaauguggguaacaucaauaaacccgacgagaagaacuuucugaauugcgaggaacgccgagagcuacugcggaaaaagaaggaugaguucaaaaagaugacagacaaagaaaaggaagagaacccuucuuaucucgaguuuaaaucauggaauaaguucgaacgugagcugagacuugucaggaaccaggauauagugaccugguugcuguguauggaauuauuuaauaagaaaaagauuaaagagcucaacguugaaaagaucuaccugaaaaauauuaacacuaacaccacaaagaaggagaaaaauaccgaggaaaagaacggggaggaaaagaauaucaaagagaaaaacaauauacuuaaccgcaucaugccaaugcggcugccgauuaagguguauggaagagaaaauuucaguaaaaacaagaagaaaaagaucaggcgaaauacuuucuucacagucuacauugaggagaaaggcacgaaguugcucaaacagggcaacuucaaggcccuggaacgcgaccggagacuagggggacuguuuagcuucgugaagacccccuccaaagcugagucuaagucgaauacuaucagcaaacucaggguagaauaugagcugggugaguaccaaaaggcccguauagaaauuaucaaagauaugcuugcauuggagaagacacugaucgacaaguauaacuccuuagauaccgacaauuuuaacaaaaugcucacagauuggcuggaacuuaagggcgagccugacaaagccucauuccagaaugauguugaccugcuaauugcugugcgcaacgcguuuagucacaaucaguacccaaugcggaacagaaucgcauucgccaacauuaaucccuuuucucucagcuccgcuaacacuucagaagagaaggggcugggaauagccaaucaauugaaagacaagacccacaagacgaucgagaaaauuaucgaaauugagaagccuaucgaaaccaaagaguga

SEQ ID NO: 11341 - RNA, 3363 nt, Artificial Sequence
  Cas13b variant__Prevotella intermedia__WP_061868553.1__Cas13b
auggaggacgauaagaaaaccacagacagcaucagauacgaacugaaggauaaacacuucugggccgcuuuucucaaccuugcaaggcauaauguguauauuacugucaaccacauaaauaagauccuggaggaagacgagauuaaccgggauggcuacgaaaauacguuggagaacuccuggaaugagaucaaagacauuaacaagaaggaucgcuuaucuaaacugaucauaaagcauuuccccuuucuagaagccaccacauaucgacagaauccuacugacaccacaaaacaaaaggaggaaaaacaggcggaggcucagucacucgagagucugaaaaagagcuucuuuguuuucaucuacaaacuucgugaucugagaaaccacuauucccauuacaagcacucuaaaucguuggaaaggccaaaguuugaggaagaccuccagaauaaaauguauaacauuuucgaugugucaauccaauuuguaaaggaggacuacaaacacaauaccgauauuaacccgaagaaggacuucaaacaucuggaccggaagcgcaaagggaaguuucacuacagcuucgccgauaaugaaggaaacaucacugagaguggucugcucuuuuucguguccuuauuccuggagaaaaaggacgcaauauggguccagaagaaacuugaaggcuuuaagugcucuaacaaaagcuaucagaagaugacaaaugagguguucuguagauccaggauguugcugcccaaacuacggcucgaaucaacccagacgcaagauuggauucugcuugacaugcugaacgaguugauccgcugcccuaagagucucuacgaacgacugcaggggguuaauagaaagaaauuuuaugugagcuucgauccagccgacgaggauuacgacgcugagcaggaacccuuuaagaacacuuuagucaggcaucaggaucgguucccuuauuuugcacugcguuacuucgacuauaaugagguguuugccaaccuccgcuuccaaauugaucuuggaaccuaccacuuuucuaucuacaaaaagcugaucggcggucagaaagaagacagacacuugacacauaagcuauauggguucgagaggauucaggaauuugacaagcaaaaucggccagaugaguggaaagcuauaguaaaggacuccgauacuuucaaaaagaaagaggaaaaggaggaagagaaacccuacaucucagagaccacaccucacuaucaucuggaaaacaagaagauuggaaucgccuucaaaaaucacaacauauggccaagcacccagacggagcucacuaauaacaagcgaaagaaguacaaucugggcacaaguauuaaagcggaagcauuucuuucuguucaugagcuguugccgaugauguucuauuaccuccuguuaaagaccgaaaacacuaagaaugacaacaaagugggcgggaagaaagagacaaagaaacagggaaagcacaagaucgaggccaucauugaauccaaaaucaaggauauuuaugcucuguacgacgccuuugcaaacggugagauaaauagcgaagaugagcuaaaagaauaccucaagggcaaagacaucaagauuguccaucugcccaagcagaugaucgcuauccuuaaaaacgagcacaaggauauggccgagaaagcggaagccaagcaagagaaaaugaaguuggcaaccgaaaaucgccugaaaacgcucgacaagcagcugaaggggaaaauucagaacggaaagagauauaauucggcuccuaaaucuggcgagauagccuccuggcuugugaacgauaugaugagguuccagccagugcaaaaggacgaaaauggugagucacugaacaauaguaaagcuaacagcaccgaguaccaguugcuccagcggacacuggccuuuuucggguccgaacacgagcgcuuagcacccuauuuuaagcagacuaagcugaucgaaucuagcaauccucauccauuccuaaacgauaccgagugggagaaauguucaaauauucucaguuuuuacagauccuaucugaaggccaggaaaaacuuccuugagagcuugaagcccgaagacugggaaaagaaucaauacuuucugaugcucaaggagccgaagacaaaccgugaaacucugguccagggauggaaaaacggcuucaauuuaccucggggcuuuuucaccgagcccauccgaaagugguucauggagcacuggaaaucuauuaagguugacgaucugaaaagaguggggcuuguagcuaaggugacaccauuguuuuucucagaaaaguauaaagacaguguccagccuuuuuacaacuaccccuucaaugugggagauguuaacaagccaaaagaggaagacuuucuccacagggaggaacgcaucgagcugugggauaagaaaaaggacaaguucaaagguuauaaggcgaaaaagaaauuuaaggagaugaccgauaaagaaaaggaggaacaucggagcuaccuagaguuccaguccuggaauaaguuugaaagagagcugaggcucgugcgcaaccaagacauagucacuuggcugcuuugcacggaguugaucgauaaacugaagauugacgaauuaaauaucaaagagcucaagaaacugcgacuuaaggauauuaacacagacaccgcaaagaaagaaaagaauaacauccugaaucgggugaugcccauggaguugccuguaacuguuuauaaagugaacaagggcggguacauaauuaaaaauaagccacuccacaccaucuauauuaaggaggccgaaacaaaacugcuaaagcagggaaacuucaaagcucuggucaaggaucguagacucaauggccuguuuucuuucgugaaaaccccgucggaggccgaaagcgaguccaaccccaucucaaaacuuagggucgaauacgaguuggguaaguaucagaacgcacgccuggacauaaucgaggacauguuagcccucgagaaaaagcugauugauaaauacaauagucuugacacugauaacuuccauaauaugcugacaggguggcuagaacucaagggcgaagcuaaaaaggcccgguuucaaaacgacgugaaacuguugacggcaguuagaaaugcguucucucacaaccaguacccuauguaugaugagaaucuguuuggaaacaucgaaagguucagcuuauccucaagcaauauuaucgagucuaagggccucgacauagcugccaagcugaaagaggaaguguccaaggcagccaaaaagauucagaacgaggaagauaauaaaaaggagaaggaaaccuga

SEQ ID NO: 11342 - RNA, 3378 nt, Artificial Sequence
  Cas13b variant__Prevotella intermedia__KJJ86756.1__Cas13b
augaagauggaggacgauaaaaagaccacagaaagcacuaacaugcuggacaauaaacacuucugggccgcuuuucucaaccuugcaagacauaauguguacaucacggucaaccacauuaauaagguucuggaguugaaaaacaagaaggaucaggacauaaucauugauaaugaccaagauaucuuagccauuaaaacccauugggaaaaggugaacggcgaccugaauaaaacagagaggcuacgggaacucaugacuaagcacuuccccuuucuggagaccgcgaucuauacaaagaacaaggaggauaaggaagagguaaaacaggaaaagcaggcugaggcccagucccuugagucucugaaagacugcuuguuccucuuucuggaaaagcugcaagaggcacgcaauuacuauucacauuacaaauauagugaaagcaccaaggagccuaugcucgaagagggguuacuggagaaaauguacaacauauucgaugacaauauccagcuugugauuaaggauuaucagcacaacaaggacaucaauccagacgaagauuuuaaacacuuggaccgaaagggacaguucaaauacuccuuugccgauaacgaggguaacauuacugaaucuggccugcuauucuuugucucacucuuccuggagaagaaagacgcuaucuggaugcaacagaaacuuacaggguuuaaggauaaucgugaaucgaaaaagaaaaugacccaugagguguucuguagaaggcggaugcuguugccgaagcuccgccuggagagcacgcagacucaggacuggauauuacuggauaugcucaacgaacuuauuagaugccccaaaagucuguacgagagguugcaaggagaauaucggaagaaguucaauguuccuuuugacuccgcagaugaggacuacgaugccgaacaggagccauucaaaaacacccuagugcgccaccaggaccgauuucccuauuucgcucugagauacuuugacuauaaugagaucuucacaaaccucagguuucaaauugaucugggcacuuaccauuucucuaucuauaagaaacuuaucggugggcagaaggaagaccggcaccugacccacaaauuguacggauuugagcguauucaggaguucgccaagcagaaucgcccugaugaauggaaggcgcucgucaaagaccuggauacauacgagaccagcaacgaaagauauauauccgagacgacuccacauuaccacuuagaaaaucaaaagaucggcauuagguuucggaacggcaauaaagagaucuggcccucacugaagacaaacggggaaaauaacgagaaaaguaaguauaaacuagacaagccuuaccaggcagaggccuuccucagcgugcaugaacugcuuccaaugauguuuuauuacuugcugcucaagaaagaggaaccgaauaacgauaagaaaaacgcuucuauaguagagggauucauuaagcgagaaauccgcgacauguauaaacuguacgaugccuucgcaaauggugagaucaacaauauuggcgaccuugagaaguacugugaagauaaggggauccccaaaagacaucugccuaagcagaugguugcuauuuuguaugacgagccaaaagauauggugaaggaagccaaaaggaagcagaaggagauggucaaagacaccaagaaacuccuggcgacuuuagaaaagcaaacacaggaggagauagaagacggaggccggaacauccgccugcuaaaauccggugagauugccagauggcucgugaaugauaugaugagguuucagcccgugcagaaggacaacgaagggaauccucugaacaauucaaaggcaaacagcaccgaguaccaaaugcuucagcguaguuuggcucuguauaauaaagaggaaaagccaacgcgguacuuccgacaggucaaccucaucaauucuuccaacccccacccguuucugaaauggaccaagugggaggaaugcaauaacauccuuagcuucuauagaaacuaccugacuaaaaagauugaguuucuuaauaaauugaagccugaagauugggagaagaaccaguauuuccucaaacugaaggagcccaaaacaaauagggaaacccuaguucaaggauggaagaacggcuuuaaucugccacgcggcauauucacagagccuauccgggaaugguuuaaaagacaccagaacgacucgaaggaguacgaaaagguggaggcccucaaaaggguagggcuggugacuaaggucauuccccuuuucuuuaaagaggaauacuucaaggaggaugcucagaaagaaaucaauaacugugugcaaccauuuuauucuuuccccuacaauguuggaaacauucacaagccugacgagaaggauuucuugccauccgaggaacgcaaaaagcuguggggugacaaaaaggauaaauuuaagggcuauaaggccaaagugaagaguaaaaaguuaaccgacaaagagaaggaagaguaccgaucauaucucgaguuccagagcuggaauaaguuugaacgggagcugcgucuugucagaaaccaggauaucgugacauggcuguugugcaccgaacucauagacaaaaugaagguagaggggcugaauguugaggaacuacagaaacugaggcucaaggauaucgacacugacacggcaaaacaagaaaagaacaauauucugaaccgcaucaugccgaugcagcuucccgugacagucuacgagauugaugacucccauaacaucgugaaagaucggccuuugcacaccgucuauauagaggaaacuaagaccaagcuguuaaaacagggaaauuucaaggcccucgugaaagacagaaggcugaacggcuuauuuucuuucguugauacaagcucaaaggcugagcugaaagacaagccaauuaguaaguccgugguagaauacgagcuaggugaauaccagaaugcgcgaaucgagaccauuaaagauaugcuccuguuggagaagacucugaucaaaaaguaugaaaaauuacccacagacaacuuuagcgauaugcucaauggguggcuggagggcaaggacgaaucugauaaggcacgcuuccaaaacgacgucaaacuucugguggccguucggaaugcuuuuucacauaaccaguacccuaugagaaauaggauagccuucgcaaacaucaauccauuuaguuugagcuccgccgacauuucugaggaaaagaaacucgauaucgcuaaccagcugaaggacaaaacgcacaagauuaucaagaaaauaauugagaucgagaagcccaucgaaaccaaagaguga

SEQ ID NO: 11343 - RNA, 3378 nt, Artificial Sequence
  Cas13b variant__Prevotella pallens__EGQ18444.1__Cas13b
augaaggaggaagagaaaggcaagacccccguggucagcacauacaacaaagacgauaagcacuucugggccgcuuuucugaaucucgcaagacauaacguuuauaucacugugaaucacauuaacaaaauacuuggggaaggagagaucaauagggacgguuacgaaaacacgcuggagaaguccuggaaugagauuaaggauaucaacaaaaaggaccgguugucuaaauuaauuaucaagcauuucccuuuucuggaaguaaccacauaucagcgcaauucagccgauacuaccaaacaaaaggaggaaaagcaggcggaggcucagagucuagagagccucaaaaaguccuucuuuguguucauauacaaacugcgagaccuucguaaccacuauucucauuacaagcacucgaaaucacuggaaagaccaaaguuugaggaagauuugcaggagaaaauguauaauaucuucgacgccagcauucaacucgucaaggaagauuacaagcacaacacagacaucaaaaccgaggaggauuuuaagcaucuggacaggaaaggccaguucaaguacaguuuugcagauaaugaagggaacauuacugaguccggacuccuguucuuugugucuuuauuccuggagaaaaaggacgccaucuggguucagaagaaacuugaaggcuucaagugcagcaaugaauccuaucagaaaaugacaaacgagguguuuugucggucacgcauguugcugccgaagcuaagacuccaaaguacccagacgcaggacuggauacugcuugauaugcugaacgaguugauuaggugccccaaaagccucuacgaacggcugcgcgaggaagaccgaaagaaguucagagucccuaucgagauugcugaugaagacuaugaugcagagcaggagccauuuaaaaaugccuuagugaggcaccaagaccgguuccccuacuuugcucugcguuauuucgauuacaacgaaaucuuuacuaaucuccgcuuccagaucgaccuugguaccuaucauuuuucuauuuacaagaaacagauaggggauuacaaggagucccaccaccugacacauaaauuguauggauucgaaagaauccaagaguuuacuaagcagaacaggccugacgaguggcggaaguucguaaaaaccuuuaauucauucgaaacaagcaaggagccauacauucccgaaaccacgccucacuaucaucuagagaaccagaaaaucggcauacgauuccgcaaugauaacgacaagauuuggccaagucugaaaacuaauucugaaaagaacgagaaauccaaguacaagcucgacaagagcuuucaggccgaggcguuccugucgguucacgaacuucugccgaugauguuuuauuacuugcuccugaaaacagagaauaccgauaacgacaaugaaaucgagacuaaaaagaaagaaaacaagaaugauaagcaagagaaacauaagaucgaggaaauuaucgagaacaaaauuacagaaauauaugcauuauacgacgccuucgcuaacggcaagaucaauucuauugauaaacuggaggaauacuguaaggggaaggacaucgagaucggacaccuacccaaacagaugauugccauacucaaguccgagcacaaagauauggcaaccgaagcuaagagaaaacaggaggaaaugcuggccgacgugcagaagucacuugagaguuuggauaaccaaaucaaugaggaaauugagaacgucgaaaggaagaauagcucccugaaaucuggugagaucgcgagcuggcucgugaacgacaugaugcgguuucagccugugcagaaggauaaugaaggcaacccacugaauaacucaaaagccaauaguacggaguaucagaugcuucaacgcucccuggcauuguacaacaaggaggaaaaacccaccagauauuucaggcaggucaaucucauugagagcucuaacccucauccauuucugaauaacacagaaugggagaagugcaacaauaucuuaucauucuaccguaguuaucuggaagcuaaaaagaacuuucuagagagccucaagcccgaggacugggagaaaaaucaguacuuccugaugcuuaaggaaccgaaaacuaacugugaaaccuugguucagggguggaagaauggauuuaaccugccucggggcauauucacagagcccauccgaaaaugguuuauggaacacagaaagaauauuacuguggccgagcucaagaggguaggucugguggcuaaagucaucccauuauucuucuccgaggaauauaaggauucugugcaaccuuuuuacaacuaccuguucaauguugggaacauuaauaaacccgacgagaagaacuuucuuaauugcgaggaacgccgggaguugcucaggaaaaagaaggacgaguucaaaaagaugaccgauaaagaaaaggaagagaacccaucguaucuggaauuucagagcuggaauaaauucgagagagagcuacgccuggugcgaaaccaggacaucgucacauggcuccuguguauggaacuuuuuaacaagaagaaaauaaaggaguugaauguggagaaaauuuaccugaagaacaucaauaccaacacuacgaaaaaggaaaagaauacagaagagaaaaacggagaggaaaagauuaucaaagagaagaauaacauauuaaaucggaucaugcccaugcgucucccuauuaaaguauauggcagagaaaacuucuccaagaauaaaaagaagaaaaucaggcgcaacaccuuuuucacuguuuacauugaggaaaagggcaccaaacugcuuaagcaagggaauuuuaaagcccuggagcgggauagaagguugggaggucucuucucauucgugaagacacauaguaaggcagagucuaaaagcaacaccaucuccaagucacgagucgaauaugagcugggcgaauaccagaaagcccgcauagagauuaucaaggacaugcuagcucuggaggaaacucucaucgauaaauauaauagccuggacacagauaacuuucacaauaugcuuacggggugguugaagcugaaggacgagccagauaaagcgucuuuccagaacgacguggauuuacucauugcaguccggaacgccuuuucccacaaucaguacccgaugagaaacaggaucgcuuucgccaauauuaaccccuuuagucugagcucugcaaauaccuccgaagagaagggacuuggcauagccaaccaacugaaagacaagacucauaaaacaaucgaaaagauuaucgagauugagaagccuaucgaaaccaaagaguga

SEQ ID NO: 11344 - RNA, 3453 nt, Artificial Sequence
  Cas13b variant__Prevotella saccharolytica__EKY00089.1__Cas13b
augauggagaaggaaaacgugcagggcagccacaucuacuaugagcccaccgacaaaugcuucugggccgcuuuuuacaaucuggcaagacauaacgccuaucucacaauugcgcacauaaauuccuucgucaacucuaagaaagggaucaauaacgaugacaagguucuugauauuaucgacgauuggucaaaauuugacaaugaucuguugaugggagcuagguuaaacaagcugauucuaaagcauuucccuuuucucaaagccccacuguaccaacuugcaaagcggaaaacucgcaagcagcaggguaaagaacagcaagacuaugagaagaagggcgaugaagacccggaggugauccaggaggccauagcuaaugcauucaaaauggccaacguacgaaagacgcugcacgccuuuuugaaacagcucgaagaucugcguaaucauuucagucacuacaacuauaauagccccgcuaagaaaauggaggugaaguuugacgauggguucuguaacaaacuguacuacgucuuugacgcggcacuccagauggugaaggacgauaauagaaugaacccugaaaucaacaugcaaaccgacuucgagcacuuaguuaggcugggacggaaucgcaagauuccaaacacauuuaaauauaauuucacuaacuccgauggcaccaucaauaacaauggucuuuuguucuuugugucucuguuccuagagaagagagacgccauuuggaugcagaaaaagaucaaaggguuuaagggaggcacagaaaacuacaugaggaugaccaaugaggucuucugccggaaccgcauggugauacccaagcuccgacuggaaacugauuaugacaaucaucagcuuauguuugauaugcugaacgaguugguaagauguccucucucgcuguacaaaagguuaaagcaggaagaccaagauaaauuccggguuccaauugaguuucuggacgaggauaaugaagcugacaaccccuaucaggagaaugccaacucagacgaaaacccuacagaggaaaccgauccacucaagaauacgcuugugcgucaccagcaucgcuucccguacuuuguccugagauauuucgacuugaacgagguguuuaaacaacuaagguuccagaucaaucugggcugcuaccacuuuagcauuuacgauaagacuaucggggagcggaccgaaaagcgacaccucacacgcacucuguucggauucgacagacuucagaacuuuagugugaaacugcagcccgagcauuggaagaauauggucaaacacuuggauaccgaagaguccucugacaagccuuaucucagcgaugcaaugccacauuaccaaaucgaaaacgagaaaauugguauacacuuccugaagacagacaccgagaagaaagaaacgguuuggcccuccuuagagguggaagagguaucaaguaauaggaacaaguauaaaagcgagaagaaucugacugcugaugccuuucuaucuacacaugaacuccugccuaugauguucuacuaucagcuuuuguccucagaggagaaaacccgggcggccgcaggcgacaaggugcaggggguccugcagagcuaccgcaaaaagaucuuugauauuuaugacgauuucgcuaacggaacuaucaauaguaugcaaaagcucgacgaaagacuggccaaagacaaccuucugaggggcaauaugccacagcagauguuggcuauacucgaacaccaggagcccgauauggagcaaaaggccaaagaaaagcuggaccguuuaauuacagagaccaaaaagcggaucgguaagcuggaagaucaguuuaaacagaaggugcgaaucgggaaaagaagggcagaccuaccgaagguuggaucuauugccgauuggcucgugaacgacaugaugcgcuuccagccugcuaaacggaaugcggauaacacgggcguccccgacuccaaggcaaacagcaccgaguacagacugcuucaagaagccuuggcuuuuuacucggccuauaaggauaggcuggagccauacuuccgccaggugaaucucaucggcgggacaaacccucaccccuuucugcaucgaguagacuggaaaaaguguaaucacuuacugucuuucuaucaugauuaccuugaggcaaaagaacaguauuugucccaccucucaccagccgacuggcaaaagcaccagcauuuucugcuacugaaaguucggaaggauauucagaacgagaagaaagacuggaagaaaagucucguggcuggauggaagaaugguuucaaccugccccguggccuuuucacugaaagcauaaaaaccugguuuuccacagacgccgauaagguccagaucacugacaccaaauuguucgagaauagaguggggcugauugcaaaguuaaucccucucuacuaugauaaggucuacaacgacaaaccacaaccguuuuaccaguaucccuucaauaucaacgauagguacaagccugaagacacacgcaaacgguuuaccgcggcuucuagcaagcuguggaaugagaaaaagaugcuuuauaagaacgcccagccagauucaagugacaaaauugaguacccccaguaucuggauuucuuguccuggaagaaacucgaaagagagcugaggaugcuacgaaaucaagacaugaugguguggcugaugugcaaggaucucuuugcacaguguacuguugaaggaguggaguucgccgaccugaaacuuagccaguuggagguagacgucaacgugcaggauaaucugaacguuuuaaacaaugugucuucaaugauacucccucugagugucuacccaagcgacgcucaaggcaacgugcuucgcaauuccaagccccugcacacgguauaugugcaggaaaacaauacaaagcuacucaaacaggguaacuuuaagucucuguugaaagaucggagacugaauggguuauucucguuuaucgccgcagagggcgaagaccuccaacagcauccgcugaccaagaacaggcuugaguacgaacugagcauuuaccagacuaugcguaucuccguuuucgagcagaccuugcaacucgagaaagcuauucugacacgcaauaagacccuaugcggaaacaauuucaacaaucugcuuaacucauggagugaacaccggacugauaagaaaacacuccagccugacaucgauuuucugauagccgucagaaaugcguucucucauaaccaguauccaaugagcacgaauaccgugaugcagggcaucgagaaguuuaacauucaaacucccaaauuggaagagaaggacgggcugggaaucgccucccaguuagcuaaaaagacaaaggaugcagccucaaggcuccagaacauuaucaaugguggcaccaacuga

SEQ ID NO: 11345 - RNA, 3969 nt, Artificial Sequence
  Cas13b variant__Prevotella sp.__WP_036929175.1__Cas13b
augagcaaggagugcaaaaagcagagacaagaaaagaagaggcggcugcagaaagccaacuucuccaucucucucaccggcaagcacguguuuggggcuuacuucaauauggcacgcacaaacuuugucaagacuauuaauuauauacuucccaucgccggaguucgagguaacuacucagagaaucagauuaacaaaaugcugcaugcguuguucuuaauccaggcuggccguaaugaagaacugacgaccgaacaaaagcagugggagaaaaagcuaagacucaacccugagcagcagacaaaauuucaaaagcugcuuuucaagcacuuuccagugcuggggccgaugauggccgacguagcagaucauaaagccuauuugaauaagaaaaagaguacugugcagaccgaagacgagacauucgcuaugcucaaaggagucagccuggcagauugucuggacauuaucugccucauggccgauaccuuaacugaauguaggaacuuuuacacacacaaggaccccuauaauaaaccuucccagcuggcugaucaguaccuucaucaagagaugauagccaagaaguuggacaaagugguuguggcgucucggcgcauccugaaggauagagagggccuaucggucaacgaaguggaguuccucaccgguauugaccaucugcaccaggaaguacuuaaagaugaguuugggaaugcaaagguuaaagacggaaaggugaugaagacguucgucgaauaugaugacuuuuacuucaaaaucucaggcaagaggcuggugaacggcuacacugugaccacaaaagacgauaagccagucaauguuaacacuauguugcccgcccucagcgacuucgggcuguuauauuuuugcgugcuguuccucaguaaaccuuacgcuaaguuauuuauugaugagguacggcuguucgaguauuccccauuugacgauaaggaaaacaugaucaugucugagauguugagcauauaccgcauucgaacccccagacuacacaaaaucgacucccacgauucaaaggccacacuggcaauggacauuuucggagaacucaggcgguguccuauggagcuguauaaucuucuggauaaaaacgcuggucagccauuuuuccaugacgaagugaagcacccgaauagucacacccccgaugucagcaaacguuugcgcuacgacgacagauuuccuacgcucgcccugagguauaucgaugagacugaguuauucaagcggauccgauuucaacugcagcuaggcucuuuccgcuacaaguuuuacgacaaagaaaacugcauugaugggagagugaggguucggcgcauacagaaggagaucaauggauauggcagaaugcaggaaguggcggacaaaaggauggauaaguggggugaccucauucaaaaacgugaggaacgguccgucaagcuggagcaugaggaacuuuacaucaacuuggaucaguuccuggaggacacagccgauucaaccccauaugugacugaccgaagacccgcauacaauauacacgcuaacaggauugggcucuauugggaagauagccagaauccuaaacaguacaagguauucgacgagaacggaauguauaucccagagcugguugugacagaagauaagaaagcccccaucaagaugccggcuccucgcugugcccuuagugucuacgaccugcccgcaauguuguuuuacgaguaucuccgggaacaacaggacaaugaguucccaucugccgaacaggugauuaucgaguacgaggaugacuauagaaaauuuuucaaggcugucgcggaaggcaaacugaagccuuuuaagaggcccaaagaguuccgcgauuuucuuaagaaagaauacccaaagcugcgaauggcagacauucccaaaaagcuacaacucuuccugugcucccauggccuuuguuauaacaauaagccugagaccguguacgaacgguuggaucgucugacgcuccagcaccuggaggagagagaauuacauauacagaacaggcuggagcacuaucagaaagaccgcgauaugaucgggaauaaggacaaccaguacgguaaaaagagcuuuucggauguucggcacggagcccuugcuagauacuuggcccaaucuaugauggaauggcagccaaccaaacucaaggacaaggagaaaggccaugauaagcugacagggcuaaacuauaaugugcugacugcauaccucgccaccuauggacacccgcagguacccgaagagggcuucacaccuaggacucuggagcaaguccuuauuaacgcucauuugaucgguggguccaauccacaccccuuuaucaacaaagugcuggccuuaggcaaucgaaacauugaggagcucuaccugcacuaucuugaagaggagcugaagcauauacgcucacggauccagaguuugagcuccaauccuucugacaaagcacucagcgcgcugccauucauucaccaugauagaaugagguaccacgaacguaccucagaggaaaugauggcucuagccgcacgcuauacaaccauccagcugcccgacggacucuuuacuccguacauucuggagauccuucagaagcauuacacggaaaacagugacuugcaaaaugcccugucccaggauguuccugugaaauuaaacccaacaugcaaugcugccuaucucauaacccuguucuaccagacuguccuuaaggacaacgcacagcccuucuaucugagcgauaagaccuacacacggaauaaagacggcgagaaggcugagucuuuuucauucaaaagagccuaugaacuauuuagugugcucaacaauaacaagaaagauaccuucccuuuugagaugaucccccuguucuugacuagcgacgaaauucaagagaggcuguccgcgaaguuacucgauggggacggaaacccaguaccugaagugggugagaagggcaaacccgccacagauucucaggggaauacgaucuggaagcgacggauuuacucggagguugacgauuaugcugaaaaacugaccgaccgcgacaugaagaucagcuuuaaaggagagugggaaaaacuuccaagauggaagcaggauaaaauaauuaagaggcgggacgagacucgaagacagaugcgcgaugaacuguugcaaaggaugccgcguuacauccgggacauuaaagauaacgagagaacacucaggcgcuacaagacccaggacaugguccuguuccuacuggcagagaaaauguuuacaaauaucauauccgaacagucaagugaguucaacuggaagcaaaugcgacuuucuaagguguguaaugaagccuuucucagacagacucugaccuuccgggugccugucacgguuggcgagaccacaaucuauguggagcaggaaaacaugagcuugaaaaauuacggugaguucuauagguuucugacugaugaccgcuuaaugucccuccugaacaauauuguggaaacccuuaagcccaacgagaauggggaucugguaauccgucacacagacuugaugucagaacucgcugccuacgaucaguauagaagcacuauuuucaugcugauccaaucuauagagaaccuaauuaucaccaauaacgcaguccuggacgauccagacgcggacggcuuuugggugcgggaggaucuucccaaaaggaauaacuucgccucccuccuggaauugaucaaccaguuaaauaacguugagcugacggacgaugaacgcaagcuccugguggcuauucgaaaugccuuuagucacaacagcuacaauaucgacuucucucuuauuaaagaugucaagcaucugccugagguggcaaagggaauauugcagcaccuacaguccaugcugggcguugaaaucacaaaauga

SEQ ID NO: 11346 - RNA, 3384 nt, Artificial Sequence
  Cas13b variant__Prevotella sp.__WP_007412163.1__Cas13b
augcagaagcaagacaaacuguucguggauagaaagaaaaacgccaucuuugcuuuccccaaguacauuaccauaauggagaaucaggaaaaaccugagccaaucuauuacgaacucacagacaagcacuuuugggcagccuuccuuaaccuggcgaggcauaaugucuauacuacgauuaaccacaucaaucggcgcuuggagauugcugaauuaaaggaugacggcuacaugauggggaucaaaggaagcuggaacgagcaggccaagaaacuggauaagaaaguucgacuacgugaccucauaaugaagcauuuuccguuccuggaggcagccgcuuaugaaaucaccaauuccaagucucccaacaauaaagagcagagagaaaaggagcaaucagaggcacuuagucugaacaauuugaaaaacgugcucuuuauuuuccuggaaaagcugcagguacucaggaauuacuauagccacuacaaauacuccgaggaaucuccuaagccaaucuuugagacaucguuacugaaaaacauguauaagguguucgaugccaauguccggcuugugaagcgcgacuacaugcaucacgaaaacauugauaugcagagagacuuuacucacuugaacaggaaaaagcagguuggucggaccaaaaauaucauagauucacccaacuuccauuaucacuuugcugacaaggagggcaauaugacaauugccgggcugcuauucuucgugagccucuuucuggauaaaaaggacgcgaucuggaugcaaaagaaacuuaagggauucaaagacggccgcaaccugcgagagcagaugaccaaugaagucuuuugcagaaguaggauuuccuugccuaagcucaaacuggagaacgugcagacuaaggauuggaugcaguuagacaugcugaaugaacucguacgguguccaaagucucuuuacgagcgucugcgcgaaaaagauagagagagcuucaagguucccuuugacaucuucuccgaugacuaugaugcagaggaggaaccuuuuaaaaacacauuggugaggcaucaagaccgguucccauacuuuguccuacgauauuucgaucugaaugaaaucuuugagcagcuccgcuuccagauugaccuggguaccuaccacuuuucaauauacaacaagagaaucggggaugaagacgaggugaggcaccuuacgcaucaccuguauggauucgcccggauucaagacuucgcuccgcagaaucagcccgaggaauggcgcaaauuggugaaggaucucgaccauuuugagaccagucaggaaccuuacaucagcaagacugccccacacuaucaucuggagaacgagaaaauaggcauuaaguucugcucuacacacaauaacuuauuucccucccugaaaagagaaaagacuuguaauggcaggucaaaauucaaccuagggacccaauuuacagcagaggcuuuccucagcguccacgaacugcuuccuaugauguuuuacuauuugcugcucaccaaggauuacagucguaaagagucugccgacaagguugaaggaaucauccggaaggagauuuccaacaucuaugcgauuuacgaugccuucgcaaauaacgagauaaauagcaucgcugaccugacgugccgacuucagaaaacuaacauucugcagggucauuugccaaagcagaugaucucgauccucgaaggcagacaaaaagauauggagaaggaagccgagaggaaaauuggggaaaugauagacgauacacagcgccggcuggacuuacuguguaagcagaccaaucagaagaucagaauuggaaaaaggaacgcuggccuacucaagucugguaaaaucgccgauuggcugguguccgacaugaugcgcuuucaacccguacagaaggauacuaauaacgcaccgauuaauaacucaaaagccaauaguacagaguaccgaaugcuucagcacgcuuuggcgcuguucgggagcgaguccucucggcucaaggcauauuuucgucagaugaaccuggugggaaaugccaacccucaucccuucuuagcugaaacccaaugggagcaccagacgaauauccugagcuuuuacagaaacuaucuugaagccaggaagaaauacuugaagggccucaaaccacagaacuggaagcaauaucagcacuuccugauacuaaaaguccagaagaccaaucgcaacacacuggugacuggcuggaaaaauucauucaaccucccucgggggaucuuuacccagcccauuagagagugguucgaaaaacauaauaacaguaagaggaucuacgaccaaauucuguccuuugaccgaguuggauucguggcaaaagccaucccacuuuauuuugcugaggaguacaaggauaauguccagcccuucuacgacuauccuuuuaacauagguaauaaauugaagccacagaaaggccaguuccuggauaagaaggaacgcguggaguuauggcaaaagaacaaggaacucuuuaaaaauuacccgagcgagaagaacaaaacagaccuggccuaucuugauuuccugucuuggaagaaguuugagcgggaauugagacucauuaaaaaucaggacaucguaacuuggcugauguucaaggagcuauucaaaaccacaaccguugaagggcugaagauuggagagauccaccucagggauauagacacuaacacggcaaaugaagagucaaacaacauccugaaucguauuaugcccaugaaacuuccugugaagacauacgagaccgauaacaagggcaauaucuugaaagaacgcccacuggcgacuuuuuauauugaggaaaccgagacaaaggucuuaaaacaggguaacuucaaggugcucgcuaaagaccggagacugaaugggcuucugaguuuugccgaaaccacugauaucgaccuagagaagaaccccauaacaaagcucagcgucgauuacgagcugauuaaauaucagacgaccaggaucuccaucuucgaaaugacuuugggccuggagaagaaauuaauugacaaguacucuacacucccuaccgacucguuucgaaauaugcuggaacgguggcuucaaugcaaagcaaaccgcccagagcugaagaauuacgugaacagcuugaucgccguuagaaaugcuuucucccauaaccaguaucccauguacgaugccacacucuuugcagaagugaagaaauucacucuguuuccgucaguagacaccaagaaaauugagcuaaauauagcuccucagcugcuugagaucgucggaaaggccauuaaagaaaucgagaagagugaaaacaaaaauuga

SEQ ID NO: 11347 - RNA, 3273 nt, Artificial Sequence
  Cas13b variant__Prevotella sp.__WP_044072147.1__Cas13b
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagagaaaacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccaggcaagccauuacaagacguacgaugagaaacugaucgacgggugcgaguuucuuaccuccacagaacaaccccugucuggaaugauaaacaauuauuacacuguggccuugcguaacaugaacgagagauauggcuacaagaccgaagaucucgcuuucauccaggacaagagguuuaaauucgucaaggaugcauaugguaaaaagaaaucacaggugaauacaggguuuuuccugucgcugcaggacuacaacggagauacccaaaagaaacuccacuuaagcggcguaggcauugcccugcuuaucuguuuguuucuggacaagcaguauauuaauaucuuccuaagucggcucccuauauucuccucuuacaacgcucagagcgaggaacgcagaauuaucauuagguccuuugggaucaauucaaucaagcaaccaaaagaucggauucauagugaaaagagcaacaaaucuguugccauggacaugcugaaugagauaaagcgcugccccaacgaacuuuucgagacucuguccgcggaaaaacagucacgauuuagaaucauuagcaaugaccacaacgagguguugaugaagaggaguucugaucgguucgucccucuccuguuacaguacaucgacuauggaaagcuguuugaucacauacguuuccaugugaauauggguaaacuccgcuaccuucugaaggcagacaaaacauguauugauggccagaccagagugagggucaucgaacaaccauugaacggguuuggacggcuagaggagguugaaacgaugcgaaagcaggagaauggcacuuucgguaacuccgggauccgcauuagagacuuugaaaauaugaaaagggaugacgccaaccccgcuaacuauccuuacaucguggauaccuauacacacuacauucuggagaauaacaagguagaaauguucauaagcgacgaggagacuccagccccgcuccugcccgugaucgaagaugaccgguaugucgugaagaccauuccuucgugccgcaugucuacacuugagaucccagcaauggcuuuucauauguuccuguuuggauccaaaaagaccgaaaaauugaucguugacgugcacaauagauacaagcgucucuucaaagccaugcagaaggaggaggucacggcggaaaacauugccucauucggcauagcagagagugaucugccccagaagaucauugacuuaaucagcggcaaugcucacgggaaagauguggacgccuuuauuaggcugacuguagaugacaugcuagcugauacagaacggcgaaucaagagauucaaagacgauaggaaguccauacgcucugccgacaacaaaaugggaaagcgggguuuuaaacaaaucagcaccggcaagcucgcagauuuccuggccaaggacauuguucuuuuucagccuucagugaaugauggggagaacaaaaucacuggauugaauuacagaauuaugcagagugcuaucgcggucuauaacuccggcgacgacuacgaagcaaagcagcaauucaaacugauguuugagaaggccaggcucauagguaaagggacaaccgagccacaucccuuccuguauaagguguuuguccgcagcauuccggcuaaugccguggauuucuacgaacgauaucuuaucgagcggaaguuuuaccugauuggcuugucuaacgaaaucaaaaagggaaaucguguugacgugccuuucauaagaagggaucagaacaaauggaagacgcccgcaaugaaaacccucggccgcaucuaugacgaggaucugccaguagaauuaccucggcagauguuugacaaugagauuaagucacaccugaagagucuaccccagauggaggggaucgauuucaacaacgccaaugucacauaccucauugcugaauacaugaaaagagugcugaacgacgauuuccaaacuuuuuaucaguggaagaggaauuaccgauauauggacaugcuucgcggagaguacgaucggaaagguagcuugcaguccuguuucaccucuguugaagagagagaaggccuguggaaggagagggccucgcguacagagcgcuaucggaaacucgcaagcaacaagaucagauccaauaggcaaaugcgaaacgcgucaagugaagagauagaaacuauucuggacaagcgguuaucuaauagccgcaacgaguaccagaaauccgagaaggugaucagaagguaucggguccaggaugcucugcuuuuucuccucgccaaaaagacccugacagaacuagcagacuucgacggggagcgauuuaaacugaaggaaaucaugccagaugccgagaaaggaauuuugucagaaaucaugcccaugagcuucaccuuugagaagggcgguaagaaauacacuauuacgucugaggggaugaagcugaaaaauuacggcgacuucuuugugcuugcuuccgauaagagaauaggaaacuugcuggaauuaguaggcagugacacagugagcaaagaggauaucauggaagaguucaagaaguaugaccagugccgcccugaaauuucuuccaucguuuuuaaucucgagaaaugggccuucgauaccuacccagagcugucagcaagggucgaccgugaagagaagguggauuucaaaaguauucuuaagauccuguugaacaauaaaaacauaaauaaggaacaaagcgacauccuccggaagauuagaaacgcuuuugaucauaacaauuauccggacaaagggguggucgagaucagggcccugcccgaaauugcgaugucgaucaagaaagccuucggagaguacgcuauaaugaaguga

SEQ ID NO: 11348 - RNA, 3273 nt, Artificial Sequence
  Cas13b variant__Prevotella sp.__WP_042518169.1__Cas13b
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaaccauuacaagaccuacgaggagaaacuuaucgaugggugcgaauuucugacaagcacugagcagcccuuguccggaaugauaucuaaguauuacaccguggcacuccguaauacaaaggaaagauauggcuacaaaaccgaggaccuggccuucauccaagauaacauuaagaaaaucacuaaggacgcuuaugguaaaaggaagucgcaggucaacacaggguuuuuccugucacuccaggauuacaauggagacacccagaaaaaguuacaccugagcggcgugggcauugcacuuuugaucugucuguuucuagauaagcaauauauaaacauuuuccucagucggcugccuaucuuuuccucuuacaaugcccagagcgaagaacgcagaauuaucaucagguccuucgggauuaacucaauaaaacuuccaaaggaccggauccauagugagaaaagcaauaagucuguagcuauggauaugcugaacgaaguuaaacgcugccccgacgaguuguucacgacucucuccgccgaaaagcagucacgauuuagaauuaucagcgacgaucacaaugaggugcugaugaagaggaguaccgaccgguucgucccuuuacugcuccaauacauagauuauggaaaacuuuuugaccacauucguuuccaugugaacauggguaagcugcgcuacuugcuaaaagcggauaagacauguaucgacggccagacuagagugagggucaucgaacagccacugaauggguuuggacggcucgaggaggcagaaaccaugcgaaaacaggagaacggcacauucgguaauucugggauucgcaucagagauuuugaaaacguuaagagggacgaugccaaucccgcuaacuauccuuacauuguggacaccuauacgcacuacauacuggagaauaacaagguagaaauguucaucuccgauaaaggaagcucggccccacuucugccguugauugaggacgaccgguauguggucaagacuauccccucuugccgcauguccacacucgagaucccugcaauggcuuuucauauguuccuguuuggcaguaaaaagaccgaaaaauuaauuguggauguucacaacagauacaagaggcuguuccaagccaugcagaaggaggaagugacugcggagaauauagccucauuuggcaucgcagagagcgaccuaccacagaaaauucucgaucugaucuccgggaacgcucacggaaaggacgucgaugccuucauucgucuuacaguggacgauauguugaccgacacggaacggcgaaucaaaagauucaaggaugacaggaaaucuauacgcagcgcugauaauaagauggguaaacggggcuuuaagcagaucucaaccgggaagcuggccgacuuccucgcaaaagauauuguacuguuucaacccaguguuaacgacggagagaauaagaucacaggccuuaacuacagaauuaugcaguccgccaucgcuguguaugacagcggugaugacuacgaagcgaaacagcaguucaagcugauguuugagaaagcaagguugauagggaagggcacuaccgaaccucauccauuccucuauaaggucuuugcccgcucuauucccgcuaaugccguggauuucuacgagcgauaucugaucgagcggaaauuuuacuuaacaggacuguguaacgaaauuaagcguggcaauagagucgacgugccguucaucaggcgcgaucaaaacaaauggaagacuccugcaaugaaaacccuagggcggauauauucagaggaccuccccguugaacugccaagacagauguuugauaaugagaucaagagucaccuuaagagcuugccucagauggaaggaauugacuucaacaaugccaacgugacauaccugaucgcugaguacaugaaaaggguacucaaugaugacuuucagaccuucuaucaauggaagcgaaacuaccauuauauggauaugcugaaaggugaguacgaccgcaagggcuccuuacagcacugcuucacuucugucgaggagcgggaagggcuguggaaagagagagccucgaggacggaacguuaucgcaaacuugcaagcaacaagauucgguccaauagacagaugaggaacgcgucaagugaggagaucgaaacaauauuggauaaacgacucucuaauugucggaacgaguaccaaaagagcgaaaaagugauucgcagauauaggguucaggacgcucugcuauuucugcucgccaagaaaacccugacugagcuugcagacuucgauggagagcgguuuaaguugaaagaaaucaugcccgacgccgagaagggcauccuguccgaaauuaugccaaugucauucaccuuugagaagggugggaaaaaguacacaaucaccagcgaaggcaugaaauuaaagaauuacggagauuucuuugugcucgcuucugacaaacgaauuggcaaccugcuugagcuggucggguccgauauagugaguaaggaggacaucauggaagaguucaauaaguaugaucagugcagacccgaaauuagcucuaucguauuuaacuuggagaaaugggccuucgacacuuacccugaacucuccgcacgcguggauagggaggagaagguugacuuuaaaucaauucugaagauccuacugaauaacaaaaauauaaacaaggaacagagugauauccuccguaagauucggaaugcuuucgaccauaacaauuauccagacaaaggaaucgucgagauuaaggcccugccggaaaucgcgaugagcauuaaaaaggccuucggugaguacgcuauaaugaaauga

SEQ ID NO: 11349 - RNA, 3273 nt, Artificial Sequence
  Cas13b variant__Prevotella sp.__WP_044074780.1__Cas13b
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaaccauuacaagaccuacgaggagaaacuuaucgaugggugcgaauuucugacaagcacugagcagcccuucuccggaaugauaucuaaguauuacaccguggcauugcguaauacaaaggaaagauauggcuacaaagccgaggaccucgcuuuuauccaagauaacagguauaaguucaccaaagacgcauacgguaagcggaaaucgcaggucaacacugggucauuucugagccugcaggauuauaauggagacacaaccaagaaacuccacuuaaguggcgugggcauugcccugcuuaucuguuuguuccuggauaagcaguacauuaaccuauuucucucccgccugccuaucuucucuagcuacaaugcucaauccgaagagagaaggauaauuauccggucauucgggauuaacaguaucaagcagccaaaagaccgcauccauagcgagaagucuaauaaauccguagccauggauaugcuuaacgaaguuaagcgaugccccgacgagcuguuuacgacuuugucagcggaaaaacagagcagauucaggauuauaagugacgaucacaaugaggugcucaugaagcggucuuccgaccguuuugucccucuguuacugcaauauaucgauuacggaaagcucuuugaccacauucgcuuucaugugaacauggguaaacuuagauaucuguugaaggcagauaaaaccuguaucgacggccagacaagggugcgggucauagaacagccacuaaauggguucggacgacuggaggagguugaaacuaugcgcaagcaggagaacggcaccuuugguaauagcgggauuagaaucagggauuucgaaaacaugaaacgggacgaugccaaucccgcuaacuacccuuauaucguggagacauacacccacuauauucucgaaaauaacaagguagagauguuuaucucggacgaggaaaacccaacgccgcugcuucccgugauugaggaugaccgcuacgucgugaagacuauaccuucuugcagaauguccacacuggaaaucccagccauggcauuccauauguuuuuguucggaucagagaaaaccgagaagcucauuaucgacguucacgauagguacaaacgucuguuucaagcuaugcagaaggaagaggugacugccgaaaauaucgcgaguuucggcauugccgagagcgacuuaccccagaaaauaauggaucugaucuccggcaacgcacacgggaaggacgucgaugcuuucauucggcuaacaguggacgauaugcucaccgacacggaacgaagaaucaagagguuuaaagaugaccgcaagucuauucggagcgccgauaauaaaaugggaaagagagguuucaaacagaucucaaccggcaagcuggcugacuuucuugccaaagauauaguauuguuccaaccuaguguuaacgacggggagaauaagaucacaggacugaacuauaggauuaugcaguccgcaaucgccguguacgacagcggcgaugacuaugaggcuaagcagcaguuuaaacucauguucgaaaaggcgcgccugauugguaaagggacuaccgagccacaucccuuucuuuacaaggucuucgugcgaucuaucccggcaaaugccgucgauuuuuaugaacgguaccugauagagcguaaauucuauuugauuggccucucaaacgaaaucaagaagggaaauagaguggacguuccuuuuauuaggcgcgaucaaaacaaauggaagacacccgcuaugaaaacucugggccggaucuacagugaggacuuaccaguggagcugccuagacagauguucgauaaugaaauaaagagccaccuaaaaucccucccccagauggaggggaucgacuuuaacaaugccaacguaaccuaccugauugcagaauauaugaagaggguccuuaaugaugacuuccagacauucuaccaauggaagcgaaacuaucgcuacauggauauguugcggggagaguaugacagaaaagguucucugcagcauuguuuuaccucgaucgaagagagggagggccucuggaaggaacgugccagccgcacugagcgguacagaaaacuggcuuccaacaagauuaggucaaaucgacagaugcggaacgccaguucugaagagaucgagacgauauuagauaaacgccugagcaauugcagaaacgaauaucaaaaguccgagaagauuaucaggcgguaccgagugcaggacgcacuuuuguuccuccuggcgaaaaagacacuaaccgaacuggcugacuuugauggggagagauucaaacucaaggaaaucaugccagacgccgagaaaggaauacugucagagaucaugcccaugagcuuuacuuucgaaaagggcgguaaaauuuacaccauaacaucugggggcaugaaacuuaagaauuauggagauuucuucguuuuggcauccgacaaacgcaucggcaaccuguuagagcucguggggaguaauaccgucagcaaggaagauauuauggaggaauuuaaaaaguacgaccaguguaggccugagaucucuuccauuguguucaaccuggagaaaugggccuuugauacuuauccagaacuuccggcucguguagaccggaaggagaagguggauuucuggucaauccuggacguuuugaguaauaacaaagauauaaauaacgaacagagcuacauccucagaaagauuaggaaugccuucgaccacaacaauuaucccgacaaaggaaucgucgagauuaaggcacugccugaaaucgcuaugucgauuaaaaaggccuuuggugaguacgcgauuaugaaguga

SEQ ID NO: 11350 - RNA, 3438 nt, Artificial Sequence
  Cas13b variant__Psychroflexus torquis__WP_015024765.1__Cas13b
auggagagcaucauuggccuggggcucuccuucaaccccuacaagaccgccgacaaacacuauuuuggaucuuuccuuaaucugguggaaaacaauuugaacgcugucuuugcagaguucaaggaaagaauaucauacaaagccaaggaugagaauaucaguagcuuaauugaaaaacauuuuaucgacaacauguccauuguugauuaugagaagaagaucucuauacugaaugguuaccuaccuaucauugacuuccucgaugacgagcuggaaaacaaucuuaacacaagggugaaaaauuuuaagaaaaacuucaucauucuggcggaggcuaucgaaaaguugcgggauuauuacacucacuuuuaucaugacccaauaacguucgaggauaauaaagagccgcuccuggaacugcucgacgagguauuacugaagaccauucuugaugugaagaaaaaguacuugaaaacagacaagacuaaagaaauccugaaggauucgcuacgcgaggaaauggaccuccuggucauucgaaaaaccgacgagcuucgugagaagaagaaaacaaaccccaagauccagcacaccgauucaagccaaaucaaaaauaguauuuuuaacgacgccuuccagggccuguuguacgaagauaaggggaacaauaaaaagacucaggugucccauagagcaaagacaaggcucaacccuaaagacauacacaagcaggaggaacgggauuuugagaucccacugucuaccagcggauuaguuuuccugaugucccucuuccuuucaaagaaggaaauugaggacuuuaaaaguaauaucaagggcuucaaggguaaaguggucaaggaugagaaccacaauagccugaaauauauggccacgcaucgcguguacucuauauuggcuuuuaaggggcuaaaauauagaauuaagacugacaccuucuccaaggaaacacugaugaugcaaaugaucgaugagcucucaaaaguacccgacugcguuuaccagaaccugagcgaaacuaagcagaaagauuuuaucgaggacuggaaugaauauuucaaggacaacgaggagaauaccgaaaaccuugagaauaguagggugguccacccugugauucggaaacgcuacgaagauaaguuuaacuauuucgcaauccgauuucuggacgaguucgccaauuuuaaaacauugaaguuccagguguuuaugggauacuacauucaugaucaaagaaccaagacgauaggcacuacaaacaucaccacugagaggacagucaaagaaaagauuaauguuuucggcaaacucucuaagauggacaaccugaaaaagcacuucuuuucccaguuaagcgaugacgagaacaccgauugggaguucuuuccaaaucccucguauaacuuccugacgcaggcugacaauucuccugccaacaauaucccaaucuaccuagaacucaagaaccagcaaauuauaaaagaaaaggaugcgaucaaagcagaggugaaucagacccagaaccggaauccgaacaagcccuccaaacgugaccugcuuaauaagauuuugaagacauaugaggauuuucaccaaggggacccuacugccauccugucacucaacgaaauuccagcucugcuucaucuguucuugguaaaacccaauaacaagaccggacagcagaucgagaauauaauccgcauuaaaaucgaaaagcaguuuaaagccauuaaccacccuaguaagaacaauaaggguaucccaaaaagccucuucgcagauacaaacgugagagucaaugcuauaaagcugaaaaaggacuuagaggccgaacuggacaugcuaaacaaaaagcauauugcguuuaaagagaaucaaaaggccuccucuaacuacgauaagcuccugaaagagcaccaguucacucccaagaauaaaaggccggaacuucggaaguauguguuuuacaaaagcgagaagggcgaagaggcaaccugguuggcuaacgacaucaagcgauucaugccuaaagauuuuaagacaaaauggaaggggugucagcauucagaacugcagcgcaaacucgccuucuaugacagacacaccaagcaagauauuaaggagcuguuaaguggaugcgaguucgaccacucccugcuugauaucaaugcuuacuuucagaaagacaacuucgaagacuuuuucagcaaguacuuggagaauaggauagaaacucucgagggcguucugaaaaagcuacaugauuuuaaaaacgagcccacgccacugaaggguguguucaagaauuguuuuaaauuccucaagcggcagaacuaugucacagaaucuccugagaucauuaaaaagcgcauccuggccaaacccaccuuucuuccaagagggguguucgaugaaaggcccacuaugaagaagggcaaaaauccuuugaaggacaaaaacgaguuugcagaaugguucguagaguaccuggagaacaaggauuaucagaaauucuacaaugccgaagaguaucguaugcgggacgcugacuuuaagaaaaacgcgguuauuaagaagcaaaaauuaaaggauuucuacacccuccagauggugaauuaucugcuuaaagaagucuuuggaaaggacgagaugaaccugcaguugucagaacucuuccagacacgacaagagagacugaaacuacagggcaucgcaaagaagcagaugaauaaagagaccggggauaguagcgaaaacacuaggaaucaaacauacauauggaacaaggacgugccagucuccuuuuucaauggaaaagugacgauugauaagguuaaacugaagaacaucgguaaguacaaacgcuaugagcgggacgaaagagugaagaccuuuaucggcuacgagguagaugaaaaauggaugauguaucucccgcacaauuggaaggacagguacucugucaaacccauuaacgugaucgaucugcagauucaggaguaugaggaaauacgcucgcaugagcuuuugaaggaaauccagaaucuggagcaauacauuuaugaccacacuacagauaagaacaucuuacuccaggacgggaauccuaacuucaaaauguacguucugaauggacuucugauuggcaucaaacaggugaacauaccagacuuuaucguccuaaaacagaacaccaauuucgauaagauugacuuuacagguaucgccagcugcuccgagcucgagaaaaagacuauuauccugauagcuauucgaaacaaauucgcccacaaucaauugcccaacaagaugaucuacgaucuggcaaaugaauuuuuaaagaucgagaaaaacgaaaccuaugccaauuacuaucucaaggugcugaaaaagaugauuucagaccuugcuuga

SEQ ID NO: 11351 - RNA, 2847 nt, Artificial Sequence
  Cas13b variant__Riemerella anatipestifer__WP_049354263.1__Cas13b
auguucuuuagcuuccacaacgcccagagagugaucuuuaagcaucuguacaaggcuuucgacgcaucccucaggauggucaaggaggauuauaaagcccacuuuaccguuaaucuuacacgggacuucgcgcaucugaaccgcaagggcaaaaauaagcaagauaaccccgacuuuaaucgauaccguuucgaaaaggauggguuuuucacugagucuggauuguuauuuuucacgaaccuguuucuagacaaaagagaugcuuauuggaugcucaagaaagugucagguuucaaggccagucacaaacagagggaaaagaugaccacagagguauucugccggagccgcauucugcuuccuaagcugagauuggaauccagguacgaccauaaucagaugcuccuggauaugcugucugagcucucgcgguguccaaaauuacuguaugagaaacuuucagaagagaacaaaaagcacuuucagguggaagcagacggcuucuuggaugagauagaggaagaacaaaauccguuuaaagacacucugauccgccaccaggaucgauuccccuacuuugcccuaagauaucucgaccugaacgagagcuucaagaguauuagguuucaggucgaccuugggaccuaccauuacugcaucuaugauaaaaagauuggagacgagcaggaaaagcggcaccugacacguaccuugcucuccuucggccgccugcaagauuuuacugagaucaauagaccucaggaguggaaagcucugacaaaggaccuggauuacaaagaaaccucuaaccagccauucauaagcaagacgacuccccauuaucacaucaccgacaauaaaauugguuuuaggcucgggacauccaaggagcuuuacccuucacuggaaaucaaggauggagcaaaccggauugccaaauauccauacaauaguggcuucguggcucacgccuuuaucagcguucaugaguugcuaccccugauguucuaucagcaccucacuggcaagucugaagaccugcuuaaagagaccgugcgacauauacaacgcauuuacaaggauuucgaggaagagagaaucaacacaauugaagaccuggagaaagcgaaccaggggagguugccucucggagcauuuccaaagcagaugcuggguuuacugcaaaauaagcagccggaucuauccgaaaaagccaagaucaaaaucgagaagcucauugcugagaccaaacugcuuucacaccgguugaacacgaaguuaaagagcagucccaaacucggcaagcgcagagaaaaacugauaaagacugggguccuugccgacuggcuggugaaagacuucaugagguuucagccuguagcauacgaugcucagaaucaaccaaucaagucuuccaaagccaacagcacagaguucugguuuauucgucgggcguuggcccucuauggaggcgaaaagaaucgacuggaggguuacuucaagcagaccaacuuaaucgggaauacuaacccccauccuuuucugaauaaauucaacuggaaggcauguagaaaucuaguugacuuuuaucagcaguaccucgagcaaagggaaaaauuccuggaggcuauaaagaaccagccaugggaacccuaucaguacugccuuuugcugaaaauuccgaaggagaaucgcaagaaccucgugaaaggaugggaacagggcggcaucucgcugccucggggguuauuuacagaggccaucagagagacccugucugaagaucuuauguuguccaagcccauuaggaaagagaucaagaaacacggacgcgucgguuucauuucacgagcuauaacgcucuauuuuaaggaaaaguaccaagacaaacaccagaguuucuacaaucugagcuauaagcuagaggccaaagcaccacugcucaagcgggaggaacauuacgaguauuggcagcagaacaaaccucaaucccccaccgaaucucagcgucuggagcuucacacaagcgauagauggaaggacuacuugcuguauaagagguggcagcauuuagaaaagaagcuccgccuguaccggaaccaagaugugaugcuuuggcugaugacuuuggagcucaccaaaaaucacuucaaggaacugaaccuaaauuaucaccagcugaaacucgagaaccuggccgugaauguccaggaggcugacgcgaaacuuaacccauugaaucagacacugcccaugguuuuaccugugaaaguauacccagcaacugccuuuggcgaagugcaauaccauaagaccccgaucagaacagucuauauuagggaggaacacaccaaggcucucaaaauggggaacuucaaggcccuggugaaagaucgacgccuuaauggacuguuuucauucaucaaggaggagaacgacacucagaaacaucccaucagucagcuacggcucagaagggaacuggagauuuaccaguccuugcguguugaugcauuuaaggaaacgcugagcuuagaggaaaagcuccugaauaaacacacaucucuuucaagucuggagaacgaguuccgcgccuugcucgaagaguggaagaaagaauaugcugccagcuccauggugaccgacgagcauauagcauuuaucgcgucuguccggaaugcuuucugucacaaccaauacccuuuuuauaaggaagcccugcacgcaccaauuccccuauucacuguggcccagccuaccacagaggagaaagauggccuggguaucgcugaagcccuucucaagguacugagagaguacugcgaaauuguuaagucgcagaucuga

SEQ ID NO: 11352 - RNA, 3288 nt, Artificial Sequence
  Cas13b variant__Riemerella anatipestifer__WP_004919755.1__Cas13b
auggagaagccccugcucccuaacguguacacccuuaaacacaaguucuuuuggggcgccuuccugaauaucgcuagacauaacgcauuuauuacaauaugccacaucaaugaacaguugggguuaaaaacuccaagcaacgacgauaagauugucgacguugugugugagacguggaauaacauccugaauaacgaucaugaccuacucaaaaagucccaacugaccgaacuuauucugaagcacuucccguuuuugacagccaugugcuaucaucccccuaaaaaggagggaaagaagaaaggucaccagaaggaacagcagaaggagaaagagucugaagcgcaaucacaggcugaggcccucaauccaaguaagcugaucgaagcacuggagauacucguaaaccaguuacacagccugaggaauuacuauucccauuacaaacacaagaaacccgaugccgagaaggacaucuucaaacaucuuuauaaggcuuuugaugcaucuuugcggauggugaaggaagacuacaaagcccacuucacugucaaccugacccgcgauuuugcucaccuaaaucgaaagggcaaaaacaagcaggacaauccugauuucaaccguuauagauuugagaaagacggguucuuuacagaaucgggacuccuguucuucaccaaccuuuuucuggauaagagggacgccuacuggauguugaagaaagugucaggcuucaaggcgagccauaaacaacgggagaagaugacuacagaaguuuucugucgcaguaggauucuccugccaaaauuaagacuggagucccgguacgaccacaaucagaugcuccuugauaugcugucugaguugagccgcugccccaagcuacuguaugaaaagcucuccgaggaaaacaaaaagcauuuccagguggaggcagacgguuuucuggaugaaaucgaggaggaacagaauccuuucaaagacacccuuauucgacaccaagauagauuuccauacuucgcccugagguauuuggaccucaacgagucauuuaagaguauccgguuccaggucgaucuggggacguaccauuauuguauauacgacaaaaagauuggagaugaacaggagaagcgucacuuaacucgcacccugcuuagcuuuggcagacuccaagacuucacagaaaucaauaggccgcaggaguggaaagcucugacuaaggaucuugacuauaaagagaccucuaaccagcccuuuauuuccaagacaaccccucacuaccauaucacggacaauaaaaucggcuuccgguuggggacuucaaaggaacuguacccaagccucgagauuaaagauggagccaaccgaauagcaaaguaucccuacaauagugguuucguggcucacgccuuuaucucuguacaugaacugcuuccucugauguucuaucagcacuugacaggcaaguccgaggaccuccugaaagagaccguucgccacauucaaagaaucuacaaggauuuugaagaggaaaggauaaacacuauugaggacuuagaaaaagcgaaucaggggcggcugccacuaggagccuuccccaagcagaugcucggccugcuucagaacaaacaaccggauuugagcgagaaggcaaagaucaaaaucgagaagcugauugcugaaacaaaacuccugucgcaucgcuuaaauaccaagcugaaaucuuccccuaagcuagguaagagaagggagaaauugaucaagacgggggugcucgccgacuggcuggucaaagauuuuaugcguuuccagcccguggcuuaugacgcccagaaccagccaauuaagucaaguaaagcaaauagcaccgaauuuugguucauacggcgagcccuagcucuguacggaggcgagaagaacagacucgaaggcuauuuuaagcaaacaaaccugaucgggaauacuaacccucaccccuuccuuaauaaauuuaacuggaaggcgugcaggaauuugguggauuucuaccagcaguaccuggagcagcgcgagaaauuuuuagaagcaauuaagaaccaaccaugggagcccuaucaguacugucuccugcuuaaaaucccuaaggaaaaucggaaaaaccuggucaagggaugggagcaggguggcaucuccuugccaagagggcucuuuaccgaagccauuagggagacacugucugaggaccuaaugcugagcaagccgauacgcaaagaaaucaagaaacauggacgaguuggcuucauuucacgggcuaucacucucuauuuuaaggagaaauaccaagauaagcaccagaguuucuauaaucuguccuacaaacuugaagccaaagcacccuugcugaagcgugaggagcauuaugaauacuggcagcagaacaaaccucaaagcccaaccgagucucagagauuagaacuccacacaucagacagguggaaggauuaccugcuuuauaaacgcuggcagcaccuggagaagaagcuacggcucuacagaaaucaggacgugaugcugugguugaugacccuggaauuaacuaaaaaccauuuuaaggagcucaaucugaacuaucaccaacuuaaacuggagaauuuggccguaaacgugcaggaagcugacgccaagcucaacccccugaaucagacgcuaccuaugguccugccagugaaaguuuaccccgcaacagcguucggugaggugcaguaucauaagaccccgauuaggacugucuacauccgagaggaacacaccaaggcucuuaaaauggggaacuuuaaggcccucgugaaagaucgccggcugaauggcuuguucaguuuuauaaaggaagagaacgacacacaaaaacauccuaucagccagcugagauuaaggcgugagcucgaaauuuaucagucccugcgcguagaugcauucaaggagacccuuucucuggaagagaaguugcucaauaaacacacuucgcugagcucccuagaaaacgaguuucgggcccugcuugaggaauggaagaaagaguacgcugccucaaguaugguuacagacgaacacaucgcauucauugcuucugugagaaaugccuuuugccauaaccaauacccauucuauaaggaggcgcuccacgcccccaucccucuguucacggucgcucagcccaccacugaggaaaaagauggauugggcauagcagaggccuuacugaaggugcucagggaauacugugagauugucaaaagccagaucuga

SEQ ID NO: 11353 - RNA, 3288 nt, Artificial Sequence
  Cas13b variant__Riemerella anatipestifer__WP_064970887.1__Cas13b
auggagaagccccugccuccaaacguguacacccucaaacacaaguucuuuuggggcgccuuccuuaauaucgcuagacauaacgcauuuauuacaauaugccacaucaaugaacagcugggguugacuacgccgcccaacgacgauaaaauugccgacgucguuuguggaaccuggaauaacaucuuaaauaacgaucaugaccugcuaaagaaaagccaacucacagagcugauucuuaagcacuucccuuuucuggcggcuaugugcuaucauccacccaagaaagaagguaagaaaaagggcucccagaaagagcagcagaaggaaaaggagaaugaggcccaaucucaggcagaagccuugaacccuucagagcucaucaaagugcugaagacucugguaaaacagcucaggaccuuacggaauuacuauagucaccacagccauaagaaaccagaugcugaaaaggacauauucaaacaccuguacaaggcauuugaugccucccuucgcauggugaaggaggacuauaaagcucauuucacagucaacuugacccaggauuuugcccaccugaaucgaaaggggaaaaacaagcaagacaaucccgauuucgaccguuacagauuugagaaagauggauucuuuacugaaucuggccuacucuucuucacaaaccuguuucuugacaagagggacgcguauuggaugcugaagaaagugucggguuucaaggcaucacacaaacagagcgagaagaugaccacggaaguguuuugucggagucgcaucuugcucccuaaacugagauuagaguccagguacgaucauaaccagaugcugcucgacaugcuuucugaacugagccgguacccaaaguugcuauaugagaagcuguccgaggaagauaaaaagcgcuuccagguugaggccgacggguuucucgaugaaauugaggaagaacaaaauccguucaaagacacucugauccgacaccaggauagauuucccuacuucgcucuuagguaucuggacuugaacgagucauuuaagaguauucgguuccaggucgaucucggaaccuaccauuauugcaucuacgacaaaaagauaggcgaugaacaagagaagcgucaccugacacgcacuuuacugagcuuuggcagacuacaggacuucaccgaaauuaauaggccucaggaguggaaagcccucacaaaggaccuggauuauaaagaaaccucuaagcagccauuuaucuccaaaacgacuccccauuaccacauuacagacaacaagaucggguuccggcuuggaaccucaaaagaguuguacccuagccuggaggugaaggauggugcaaaucgaaucgcucaauauccauacaacagugacuucguagcccacgcguuuauuucuguucaugaacuccugccccuuauguucuaucagcaccugacuggcaaguccgaggauuugcucaaagaaacagugcgccauauacagagaaucuacaaggacuuugaggaggaaaggauuaauaccaucgaggaucuggaaaaagccaaccaggggcgguuaccgcugggagcauucccuaagcaaaugcuaggccuccugcagaauaaacagcccgaccuuagcgagaaggcuaagauaaaaauugaaaaguugaucgccgagacgaaacugcucucgcaccgccugaacaccaaguuaaaaucuuccccaaagcuggguaagagaagggagaaacuuaucaagacaggggucuuggcugauuggcucgugaaagacuuuaugcguuuccagccuguggccuaugaugcacaaaaucagcccauugaaucaaguaaggccaacagcacugaguuucagcugauccagcgggcucuagcgcuguacggaggcgagaaaaaucgacucgagggcuauuucaagcaaaccaaccugauugggaauacaaacccacaccccuuucuuaacaaguucaauuggaaagcauguagaaacuuggucgacuuuuaccagcaguaccuggaacaaagggagaaguucuuagaggccaucaaaaaucagccuugggaaccauaucaguacugccuccugcuuaagauaccgaaagagaaccgcaagaaucugguuaaaggaugggaacaggguggcauuuccuugccccgggggcucuuuacugaggcuaucagagaaacccugucuaaggaucuaacacugagcaagccuaucaggaaagagauuaagaaacauggacgcgugggcuucauaucacgagccaucacccucuauuuccgggagaaguaccaagacgaccaccagaguuuuuaugaucugccauacaaacuugaagcaaaggccucccccuugccuaagaaagagcauuaugaauacuggcagcagaacaagccacaaagccccacugagcugcagcguuuagagcuccacacgucugacagauggaaagauuaccugcuuuauaagagguggcagcaucuggagaaaaagcuacgccucuaccggaaucaggacguaaugcugugguugaugacacuggaauuaaccaagaaccacuucaaagaacucaaucugaacuaucaccaacuuaagcuggagaauuuggcugugaacguccaggaagccgaugcaaaacucaauccgcugaaccagacucuaccuauggugcugccaguuaagguguaccccgcgaccgcuuuuggugagguccaauaucaggagacaccuauuagaaccguguacaucagggaggaacagacuaaagcccuuaagauggggaauuucaaggcacucguaaaagaccgacgccugaacggcuuguuuucauucauuaaggaagagaacgauacacagaaacaucccaucagucaacugcgguuaagaagggaacucgagauauaucagagccugcguguugacgccuuuaaggagacgcuuaaucuggaagagaaauugcucaagaagcacaccucccugucuucgguggaaaacaaauuccgcauccuacuggaggaauggaagaaagaguacgcugccagcuccauggucacugaugagcauauugcauuuaucgcuucagugcggaaugccuucugucacaaccaguacccauuuuaugaagaggcgcuucaugccccuauuccccucuucacagucgcucagcaaaccacagaagagaaggacggacugggcaucgcagaggccuuguuaagagugcugagggaauacugcgagauaguuaaaagucagauuuga

SEQ ID NO: 11354 - RNA, 2853 nt, Artificial Sequence
  Cas13b variant__Riemerella anatipestifer__WP_061710138.1__Cas13b
auguucuuuagcuuccacaacgcccagagagugaucuuuaagcaucuguacaaggcuuucgacgcaucccucaggauggucaaggaggauuauaaagcccacuuuaccguuaaucuuacacgggacuucgcgcaucugaaccgcaagggcaaaaauaagcaagauaaccccgacuuuaaucgauaccguuucgaaaaggauggguuuuucacugagucuggauuguuauuuuucacgaaccuguuucuagacaaaagagaugcuuauuggaugcucaagaaagugucagguuucaaggccagucacaaacagagcgaaaagaugaccacagagguauucugcaggucccggauucugcuuccuaagcugcgcuuggaaucuagauacgaccauaaucagaugcuccuggauaugcugucggagcucucaagguguccaaaauuacuguaugagaaacuuagcgaaaaagacaagaaaugcuuucagguggaggcagauggcuucuuggacgaaauagaggaggaacaaaacccguuuaaggauacucugauccggcaccaggaccgcuuccccuacuuugcccuacgauaucucgaccugaaugagaguuucaaauccauuagauuucaggucgaucuugggaccuaccacuacuguaucuaugacaagaagauuggauacgaacaggagaaaaggcaucugacacggaccuugcucaacuucggccgucugcaagauuuuacugaaaucaaucgcccucaggaguggaaggcuuuaacaaaagaccuggauuauaacgagaccucuaaucagccauucauaagcaagacgacuccccacuaccauaucaccgacaacaaaauugguuuuagacucaggacauccaaggaacuuuauccuucacuggaggugaaggauggggcaaaucggaucgccaaauacccauauaacagugacuucguugcucacgccuuuauuagcaucucugugcacgaauugcuaccccugauguucuaccagcaucucacuggaaaguccgaggaucugcuuaaagaaaccguccgacacauacaacgcauuuacaaggacuucgaggaggaaagaaucaacacaauugaggaucuggaaaaagcgaaucagggcagguugccucucggcgcauuuccaaagcagaugcugggguuacugcaaaacaagcagccggaccuaucagagaaagccaagaucaaaaucgaaaagcucauugcugagaccaaacugcuuagccaucgguugaauacgaagcugaagaguucucccaaacucggaaagcgcagagagaaacugauaaagacuggugugcuugccgacuggcugguaaaagauuucaugagguuucagccuguuguguaugacgcacagaaccaaccaaucaaguccagcaaagcuaauucgacagaaucucguuugauucggcgagcccucgcgcuguacggcggggagaagaacagauuagaaggauauuucaagcagaccaaucugaucggcaacacuaauccccacccuuuucuaaacaaauucaauuggaaggccugcaggaaccucgucgauuuuuaccagcaguaucuggagcaacgcgagaaauuccuugaagcaauaaagcaucagccaugggagcccuaccaguauuguuugcugcucaaagugccgaaggaaaaucggaagaaccuggugaaagguugggagcaagggggaauuuccuuaccuagaggccuguuuacagaagcuaucagggagacccuuucaaaggacuugacgcucaguaaacccauccgcaaggagauuaaaaagcacggccgagucggguucaucagccgggccauuacccuguacuuuaaggaaaaauaccaggauaagcaccaguccuucuauaaucuaucuuacaaacuggaggcuaaggccccacuccugaaaaaggaagaacauuaugaauacuggcagcagaacaagccucaaagccccacagagucacagcgucuugaguugcacacaagugacagauggaaagauuaucuguuauacaagagguggcagcaucucgagaaaaagcugcgccuuuaucggaaccaagacauaaugcugugguugaugacccucgagcugacuaaaaaucacuuuaaggaacuaaaccugaauuaccaccagcucaaacuggagaaccuugcaguuaaugugcaggaagccgaugcuaaguugaacccacugaaucagacuuuacccaugguacucccugugaaggucuacccaaccacagcguucggagaggugcaauaucaugagaccccgaucagaacuguuuacauuagggaggaacagacgaaagcacugaagauggguaacuucaaagcccuugugaaggaccgacaccugaauggccuauuuuccuucaucaaagaagagaacgauacacagaagcaucccaucagccagcuccgccugcggagagaguuggaaauuuaucaaucucugagggucgacgcuuuuaaggagaccuuaucacucgaagagaaacugcuuaauaagcacgccagucugagcuccuuggaaaacgaguuccguacucuccuggaggaauggaaaaagaaauacgcagccucuucgauggugaccgauaagcauauagcuuuuaucgccagcguacgcaaugcauucugccacaaccaguauccuuuuuacaaggagacacuacacgcgccaauucugcuuuucaccguugcucagcccacuacagaagagaaagacgggcucggaaucgccgaagcacuguugcgggugcugagagaguauugugagauugucaagucccagaucuga

SEQ ID NO: 11355 - RNA, 2850 nt, Artificial Sequence
  ARMAN Cas9 variant__Candidatus Micrarchaeum acidiphilum__OJI07263.1__Cas9
augagagacagcaucaccgcccccagguacuccucugcucuggcagcccggauuaaggaguucaacucagcguuuaaacucggcauagaucuugggacaaagacuggagguguggcucuggucaaagacaauaagguuuuguuagccaaaacguuccuggauuaucacaagcagacccuagaagaacgccgaauccaucguagaaacaggcggagucgccucgcaagaaggaagcggauugcccgccugcgaagcuggauccuuagacaaaagauuuacggcaagcagcugccugacccauauaaaaucaagaaaaugcaguugccgaauggggugaggaagggagaaaacuggauagaucucguaguguccggccgggaccugucucccgaggcuuuuguccgugcaaucacacugauuuuccagaagcgcggucaaagauacgaagagguggccaaagagaucgaagagaugucguauaaggaauuuucaacucacauuaaagcucucaccagcguuacagaggaggaguucaccgccuuagcggcagagaucgaaaggcggcaggauguggucgacacugauaaggaggccgaacgauacacacagcugagugagcuuuuguccaaagugucugagagcaaguccgaaucaaaagaccgcgcucagagaaaggaggaucuggggaagguaguuaaugccuuuugcagugcacauaggauagaagacaaagauaagugguguaaagagcuaaugaagcuccuggaccggccugugcgccacgcuagauuccuuaacaaaguccugauuaggugcaauaucugugaccgugccaccccaaagaaaagccggcccgaugugcgagaauugcucuauuuugacacggugagaaacuuccugaaagcgggaagggucgagcaaaauccugauguuauuucuuacuacaagaaaaucuauauggacgccgaggugauccgcguaaagauuuuaaacaaagaaaagcugacugaugaggacaagaaacagaagcggaaacucgcauccgaacuuaauagauacaagaacaaagaguaugugaccgaugcucagaagaagaugcaggaacaacugaaaacauugcuauuuaugaagcugacuggcaggucacgcuacugcauggcccaucucaaagagcgagcugccggcaaggacgucgaggaagggcugcacggagugguucagaaacggcacgaucguaauauagcacagagaaaccaugaccuuagggugaucaaucugauugagagccucuuguucgaucaaaacaagagucugucugacgccauccgcaaaaacgguuuaauguaugucaccauagaagcuccagagcccaagacaaagcacgcgaaaaagggcgcagccgugguacgggacccuagaaaacugaaggagaaacuauuugaugaccagaaugggguuuguauuuacaccggacuccagcuggauaaacuugaaaucuccaaguaugagaaagaccauaucuucccagauagcagggacggcccgucgauucgagauaacuuggugcugacgacuaaggaaaucaauucugacaaaggugaucgcacacccugggaguggaugcacgacaacccugaaaaguggaaggcuuucgagcggagagucgccgaguuuuacaagaaggggaggauuaaugaacguaaacgcgagcuccugcuuaacaagggaaccgaauacccaggcgauaaucccacugagcuggcacggggcggggccagagugaacaauuucauaacagaauuuaacgacagguugaaaacccacggaguccaggagcuccaaacgaucuucgagcgaaauaagccuauugugcagguugugcggggugaagagacccagcgccugagaaggcaguggaacgcuuuaaaucaaaacuuuaucccacugaaagaucgggccauguccuucaaucaugcagaagacgcggcuaucgccgcaucaaugcccccgaaguuuuggcgagagcagauuuauagaacagccuggcacuucggcccuagugggaacgaacgccccgacuuugcucuagccgagcucgcaccacaguggaacgauuucuuuaugacuaagggaggcccuauaaucgcuguacuggguaaaaccaaguacagcuggaaacauuccauuaucgacgauacaauuuauaagcccuucucuaaaagcgccuacuaugucgggaucuacaagaaaccaaaugcgauaacuucaaacgccaucaaggugcuuaggcccaaguugcugaauggcgagcacaccaugaguaaaaacgcuaaguauuaccaucagaaaauuggaaaugaacguuuucucaugaagucccaaaaaggcgggagcaucauuacaguuaagccucacgacggaccagagaaggugcugcagaucucuccgaccuacgaaugcgcagucuuaacuaaacacgaugguaagauaauugugaaauucaagcccaucaaaccucugcgggacauguaugccagaggcguaauuaaggcuauggauaaggagcuugagacgucauugaguagcauguccaaacaugccaaguacaaagaacuccacacacaugacaucauauaucugccagcaaccaagaaacacguggauggguacuucaucauuacuaagcuaucugcgaagcacggaaucaaagcccugcccgagucgaugguuaaggucaaauauacccagauuggcagcgaaaacaauuccgaggugaagcucacaaaaccuaagccagaaaucacccuggacucagaggauauaacuaacauuuacaauuuuacaagguga

SEQ ID NO: 11356 - RNA, 2904 nt, Artificial Sequence
  ARMAN Cas9 variant__Candidatus Parvarchaeum acidiphilum__APG80630.1__Cas9
augcugggcagcuccagauaccucagguauaaccuuaccucuuucgaggggaaggaacccuuucugaucaugggauacuauaaagaguacaauaaggaauugucaaguaaagcccagaaggaguucaacgaccaaauuagcgaauuuaauuccuauuacaaauuagguauagaucugggcgacaagacagggaucgcuauugugaagggaaacaaaaucauucuagcaaagacucucaucgaucugcacucucagaaacuugacaagcggcgcgaggcccgacguaauagaaggacgcggcugucgcgcaaaaagagauuggcgaggcuccggucaugggucaugcgccagaagguuggcaaccagcgacugccugauccauauaaaauaaugcaugacaauaaguacuggagcaucuacaacaaaaguaauuccgcuaacaagaaaaauuggauugaucugcucauccacucuaacagcuuauccgccgacgauuucgugagaggucugaccauuaucuuuaggaagcggggguaucuugcauucaaauacuugucacgucugagugacaaggaguuugaaaaguauauagauaaucuaaaaccgcccauuagcaaguacgaguaugacgaagaucucgaggagcugucuucccgcguagaaaacggagagaucgaagagaaaaaguucgaaggccuuaaaaauaagcuggacaagauugacaaagagucaaaggauuuucaagugaaacagagagaggaagucaagaaagaguuggaagaccucguggaucuguucgccaagagcguugacaacaagaucgauaaagcuagguggaagcgggaguuaaacaaucugcucgacaaaaaggugcgaaaaauccgcuuugauaacagauucauucuuaagugcaagauaaaaggcuguaauaagaacacaccuaaaaaggaaaaagucagggacuuugagcugaagaugguguugaauaacgcacggagugauuaccagaucucugacgaggaucuaaauuccuuccgcaacgaaguaauuaauaucuuccagaaaaaggagaaccugaagaaaggggaacucaagggaguuacuauagaggaccugagaaaacaacuuaauaagaccuuuaacaaagccaagauuaagaaagguaucagggaacagauccguagcauuguguucgagaagaucucgggccggucuaaauuuugcaaggagcaucugaaagaguucuccgagaagccagcucccucagaccgaauuaauuauggggucaacagugccagagaacagcacgauuuuaggguguugaauuucauagacaagaaaaucuuuaaggauaaacucauugacccuagcaagcugcgcuacaucacaaucgaguccccagagcccgaaaccgagaaauuagaaaagggacagauuucugaaaagagcuucgaaacucugaaagagaagcuagcgaaagagacaggcgguauagauaucuacaccggggaaaagcucaaaaaggacuuugagauugaacauaucuucccucgggcaagaaugggaccaucaauuagggagaacgaaguggccaguaaccuggagacgaauaaagagaaggcugaucgcacuccgugggaaugguuuggccaagacgagaagcgaugguccgaguucgagaaacgggucaacagccuuuauucuaagaaaaagaucucagaacguaaaagagagauauugcugaauaagaguaacgaguaccccggccucaauccuaccgaacugagcaggaucccauccacacuuucugauuuuguugagucgauucgcaagauguucgugaaauauggguacgaagaaccccagacucugguacagaagggaaaaccuaucauucaagugguccgggguagagacacccaggccuugagguggcgauggcacgcacucgauagcaacaucauaccagagaaggaccgcaaauccucauucaaucacgcugaagaugccgugauugcggccuguaugcccccguauuaccugcggcagaagaucuuuagagaggaagcaaagauuaaaaggaagguuaguaacaaagagaaggaagugacacguccugacaugcccaccaaaaagaucgcuccaaauuggucugaguucaugaagacgcgcaacgagccugucauagaagugaucggcaaaguaaagcccagcuggaaaaauuccauuauggaccagacuuuuuauaaguacuuacugaaaccauucaaggauaaccuaaucaagauucccaauguuaaaaacacauacaaguggaucggggugaauggacaaaccgacucacucagccugccuucuaaaguccuuuccauaaguaacaagaaaguggauagcucuacugucuugcuggugcaugacaagaaaggcgguaagcggaacuggguuccaaaguccauugggggccuccugguguauaucacaccgaaagauggacccaagagaaucguacaggucaaaccugccacccagggcuuacugauuuacaggaaugaggacgggcgaguggaugcuguucgggaauuuaucaacccagugauugagauguauaauaacggaaaacuugccuucgucgaaaaggagaaugaggaagaguugcucaaguacuuuaaccugcuagaaaagggucagaaauucgagcgcauaagaagguaugacaugaucacguacaauucaaaguuuuauuacgugaccaaaauuaacaagaaucaccggguaacaauccaagaagagaguaaaauuaaggcagagagcgauaaggugaaaucguccucuggcaaggaauacacucgaaaagagaccgaggaacugagccuccagaagcuggccgagcuuaucucaauauga

SEQ ID NO: 11357 - RNA, 2850 nt, Artificial Sequence
  ARMAN Cas9 variant__Candidatus Micrarchaeum sp.__OJT94500.1__Cas9
augagagacagcaucaccgcccccagguacuccucugcucuggcagcccggauuaaggaguucaacucagcguuuaaacucggcauagaucuugggacaaagacuggagguguggcucuggucaaagacaauaagguuuuguuagccaaaacguuccuggauuaucacaagcagacccuagaagaacgccgaauccaucguagaaacaggcggagucgccucgcaagaaggaagcggauugcccgccugcgaagcuggauccuuagacaaaagauuuacggcaagcagcugccugacccauauaaaaucaagaaaaugcaguugccgaauggggugaggaagggagaaaacuggauagaucucguaguguccggccgggaccugucucccgaggcuuuuguccgugcaaucacacugauuuuccagaagcgcggucaaagauacgaagagguggccaaagagaucgaagagaugucguauaaggaauuuucaacucacauuaaagcucucaccagcguuacagaggaggaguucaccgccuuagcggcagagaucgaaaggcggcaggauguggucgacacugauaaggaggccgaacgauacacacagcugagugagcuuuuguccaaagugucugagagcaaguccgaaucaaaagaccgcgcucagagaaaggaggaucuggggaagguaguuaaugccuuuugcagugcacauaggauagaagacaaagauaagugguguaaagagcuaaugaagcuccuggaccggccugugcgccacgcuagauuccuuaacaaaguccugauuaggugcaauaucugugaccgugccaccccaaagaaaagccggcccgaugugcgagaauugcucuauuuugacacggugagaaacuuccugaaagcgggaagggucgagcaaaauccugauguuauuucuuacuacaagaaaaucuauauggacgccgaggugauccgcguaaagauuuuaaacaaagaaaagcugacugaugaggacaagaaacagaagcggaaacucgcauccgaacuuaauagauacaagaacaaagaguaugugaccgaugcucagaagaagaugcaggaacaacugaaaacauugcuauuuaugaagcugacuggcaggucacgcuacugcauggcccaucucaaagagcgagcugccggcaaggacgucgaggaagggcugcacggagugguucagaaacggcacgaucguaauauagcacagagaaaccaugaccuuagggugaucaaucugauugagagccucuuguucgauccaaacaagagucugucugacgccauccgcaaaaacgguuuaauguaugucaccauagaagcucccgagccuaagacaaagcacgcgaaaaagggcgcagccgugguacgggacccaagaaaacugaaggagaaacuauuugaugaccaaaaugggguuuguauuuacaccggacuccagcuggauaaacuugaaaucuccaaguaugagaaagaccauaucuucccggauagcagggacggccccucgauucgagauaacuuggugcugacgacuaaggaaaucaauucugacaaaggugaucgcacaccuugggaguggaugcacgacaacccagaaaaguggaaggcuuucgagcggagagucgccgaguuuuacaagaaggggaggauuaaugaacguaaacgcgagcuccugcuuaacaagggaaccgaauaccccggcgauaauccuacugagcuggcacggggcggggccagagugaacaauuucauaacagaauuuaacgacagguugaaaacccacggaguccaggagcuccagacgaucuucgagcgaaauaagccaauugugcaaguugugcggggugaagagacccagcgccugagaaggcaguggaacgcuuuaaaucagaacuuuaucccccugaaagaucgggccauguccuucaaucaugcagaagacgcggcuaucgccgcaucaaugccgccuaaguuuuggcgagagcaaauuuauagaacagccuggcacuucggccccagugggaacgaacgcccagacuuugcucuagccgagcucgcaccucaguggaacgauuucuuuaugacuaagggaggccccauaaucgcuguacuggguaaaaccaaguacagcuggaaacauuccauuaucgacgauacaauuuauaagccauucucuaaaagcgccuacuaugucgggaucuacaagaaacccaaugcgauaacuucaaacgccaucaaggugcuuaggccuaaguugcugaauggcgagcacaccaugaguaaaaacgcuaaguauuaccaucagaaaauuggaaaugaacguuuucucaugaagucccagaaaggcgggagcaucauuacaguuaagccacacgacggaccggagaaggugcugcaaaucucucccaccuacgaaugcgcagucuuaacuaaacacgaugguaagauaauugugaaauucaagccuaucaaaccacugcgggacauguaugccagaggcguaauuaaggcuauggauaaggagcuugagacgucauugaguagcauguccaaacaugccaaguacaaagaacuccacacacaugacaucauauaucugcccgcaaccaagaaacacguggauggguacuucaucauuacuaagcuaucugcgaagcacggaaucaaagcccugccugagucgaugguuaaggucaaauauacccagauuggcagcgaaaacaauuccgaggugaagcucacaaaaccaaagcccgaaaucacccuggacucagaggauauaacuaacauuuacaauuuuacaagguga

SEQ ID NO: 11358 - RNA, 2961 nt, Artificial Sequence
  CasX variant__Deltaproteobacteria bacterium__OGP07438.1__CasX
auggagaagagaaucaacaaaauuaggaagaaacugagcgccgacaaugcuaccaagcccgugucccggucuggcccuaugaaaacacuccuuguccgcguuaugacugaugaccugaagaagcgauuggaaaaacguagaaagaaaccagaggugaugccgcagguaauaucaaacaaugcagccaacaauuuaaggaugcugcuagaugacuacacgaagaugaaagaagcgauccuccaaguguauuggcaggaguucaaggaugaccacgucgggcugaugugcaaguuugcucagcccgccaguaaaaagauugaucagaacaaacuuaagccugaaauggacgagaaaggaaaucugaccacagcagguuucgccuguagccaaugcggccagccauuguuuguguacaagcucgagcagguuuccgaaaaagggaaggcuuauacuaacuacuucggacgguguaauguggcagagcaugaaaagcugauccugcucgcccaguuaaaacccgagaaggauucugacgaggcugucaccuauucgcugggcaaauuuggucaacgcgcccuugauuucuacucaauucacgugacaaaggaaagcacccauccuguaaaaccauuggcgcagaucgcagggaacagauaugccaguggacccguuggcaaggcucuguccgacgccugcaugggcacuauagcaucuuuucuaagcaaguaccaggauaucauuaucgagcaccagaaaguggucaaggggaaucagaaaaggcucgaaucccugcgggagcuugcuggaaaggaaaaccuggaguacccuucagugacauugccaccgcaaccccauaccaaagaggguguggacgccuauaaugaagucauugcgcgcguucgaaugugggugaaccucaaucuguggcagaaguuaaagcugaguagagacgaugccaaaccucuccuuaggcugaagggcuuccccagcuuuccaguaguggagcggcgugaaaacgaggucgacugguggaacacgaucaaugaagugaaaaaguugauagaugcaaaacgcgacauggggagaguuuucuggucuggagugacugcugagaagaggaacaccauucuagagggcuacaauuaucugccuaacgaaaaugaucacaagaaacgggaggguucccucgaaaacccaaagaaacccgccaagcgacaauuuggggaccugcuucuguacuuggagaaaaaguaugcuggagauuggggcaaagucuucgacgaagccugggagcgcaucgauaagaagauugcaggccucacaucacacaucgagagagaagaggccaggaaugcugaagacgcgcagagcaaagcagugcugacugauugguuacgggccaaggcuaguuuuguacuggagcgccuaaaagagauggacgaaaaggaguucuacgccugugaaauccagcuccagaaaugguauggggaccugagaggaaacccguucgcaguugaggccgaaaauaggguggucgauauuucugguuuuuccauaggcagcgacgggcauucgauccaauaccguaaccuuuuggcuuggaaguaccuggagaauggaaagcgggaguucuaucuccugaugaacuacggcaaaaagggucgaauuagauuuaccgaugggacagacaucaaaaagucuggcaaauggcagggacuucuguauggcgggggaaaggccaaggugauagauuugaccuucgacccugaugacgaacagcucauuauccugcccuuagcauuugguacgaggcagggccgcgaguucaucuggaaugaucugcuaucccucgaaacugggcugauuaaacuugcgaacggacgggucaucgagaagacaauuuacaauaaaaagauaggcagagacgaaccagcuuuguuuguggcccugaccuucgagaggcgcgagguuguggauccuucaaacaucaaacccguaaaccucauuggugucgaccgaggggaaaauaucccagcagugaucgcccugacugaucccgagggcugcccuuuaccagaauuuaaggacaguagcggaggcccgacagacauucugcggauaggggagggauauaaggaaaaacaacgugcuauccaggccgcaaaggagguugagcagagaagggcugguggcuacucccgcaaauucgccucuaagagccggaaccuugcggaugacauggugagaaauucagccagggauuuguuuuaucacgcugucacccaugacgcagugcucguauucgaaaaccugagucgaggguuuggacgccagggcaaacggacguucaugaccgagagacaauacacaaagauggaagauuggcuaacugccaaacuggcuuacgagggucucaccuccaagacauaucugagcaagacucuugcccaguacaccucuaaaacauguucaaauugcggguucaccauuacuacggcagacuaugauggcauguuggugaggcugaagaaaacaagugacggaugggcgaccacuuuaaacaauaaggagcucaaagccgaaggccagaucaccuacuauaaccguuacaagcgccagacaguugagaaggaacugagcgcugagcuugaucggcuguccgaagagucugggaauaacgacauuucgaaauggaccaagggaagaagggaugaggccuuguuucuccugaaaaagcgauucagccaccggcccguccaagaacaguuugugugucuagacugcggccacgaggugcaugcagaugaacaggcugcccugaauaucgcacgcuccuggcuguuccucaacucaaauaguacugaguuuaaaucuuauaagagcgguaagcaaccuuucgucggggccuggcaggcuuuuuacaaaagaaggcuuaaggaaguuuggaaaccaaacgcguga

SEQ ID NO: 11359 - RNA, 2937 nt, Artificial Sequence
  CasX variant__Planctomycetes bacterium__OHB99618.1__CasX
augcaggagaucaagagaauuaacaaaauaaggcggcgccuggugaaggacagcaauaccaaaaaggccggcaaaacagggcccaugaagacucuccuuguccgaguuaugacgccugaucugcgugaaagauuggagaacuuaaggaagaaaccagaaaauaucccgcaacccauuuccaacaccucucgggcuaaucugaacaagcuacucacagacuacacugagaugaaaaaggcaauccugcacguguauugggaagaguuccagaaagauccuguaggacuuaugucacgcguggcccagccagcgcccaagaauauugaccagagaaagcugaucccugucaaagaugguaacgagagguugaccaguagcggcuuugcuugcucccaauguugccagccacucuacguguauaagcuggaacagguuaaugacaaagggaagccccauacaaacuacuucggacgguguaaugugucugagcacgaacgccugauacucuuaucgccucauaaaccagaggccaacgaugagcuggucaccuauucacuuggcaaguuuggucagcgagcauuggacuucuacagcauccacgugacuagagaaaguaaucauccgguaaaaccccuggagcaaauugggggaaacuccugcgccucuggcccuguuggcaaggcucuaagcgaugcauguaugggggccguggcuuccuuucucacaaaguaucaggacaucauucuggaacaccagaaagucaucaagaaaaaugagaagaggcuugccaaccugaaagauauagcgucagcaaacggauuggccuucccaaagauuacccuucccccucagccacacacgaaggaagguaucgaggcuuacaauaacgugguggcccaaauugucaucuggguuaaucugaacuuauggcagaaacugaagaucggccgggacgaggcaaaaccccuccagcgucuuaagggguuuccgaguuucccucugguggaacgccaagcuaaugagguagauuggugggacauggugugcaacgucaaaaaguugauuaaugaaaagaaagaggacggaaagguguuuuggcagaaccuagccggcuacaaaagacaggaagcgcugcuccccuaucugagcucugaggaggauaggaagaaagguaagaaguucgcccgguaccaguuuggggaccuucuguugcaucucgaaaagaagcacggagaggauuggggcaaaguuuaugacgaagcaugggagcgaauagauaagaaaguggaaggccuguccaagcauaucaaauuagaggaggaacgcagaucagaggacgcucaaagcaaggccgcucugacugauuggcuaagggccaaggcaaguuucgucauugaagggcucaaagaggccgacaaggaugaguuuugucggugcgaacugaaacuucagaagugguacggagacuugcgcgguaaaccauucgcuaucgaggcggaaaauucuauacuggauauuuccggcuucagcaagcaguauaacugugcauuuaucuggcagaaggacggggugaaaaagcucaaucuguaccuuaucauuaacuauuucaaaggaggcaagcugagauuuaaaaagaucaagccugaggccuucgaagcuaauagguuuuacaccguaauuaacaaaaagucgggugagauaguucccauggaggugaauuucaacuuugacgauccaaacuugaucauucucccccuggccuucgggaaacgucaaggccgggaauuuaucuggaaugacuuacugucucuagagacaggaucccucaagcuggcaaacggccgagucaucgagaaaacucuuuacaauagaaggacccgccaggaugaaccugccuuguucguggcucugacauuugaacggagagagguccucgacucaaguaacauuaagccaaugaaucugauagggaucgauaggggagagaacauuccggccgugaucgcauuaaccgaccccgaagguugcccucugagccgcuucaaggauucccuuggcaauccaacgcacauuuugcgaaucggggagucuuauaaagaaaagcagcggacuauacaggcggcuaaagagguugaacaacguagagccggaggcuacagcaggaaguaugcaucaaaagccaagaaccucgcugacgauauggugcgcaauacagcccgggaccugcuauacuaugcaguaacccaggaugcuaugcugaucuuugagaaccucaguagagguuucgggaggcagggcaaacgaacuuucauggccgagcgccaguacacacggauggaagacuggcugaccgcgaaacuugccuaugagggauugcccuccaagacguaccugagcaaaaccuuagcucaauacacaucuaagacuuguucaaauugcggcuuuaccauuacaagugcagauuaugacagaguccucgaaaaacugaagaaaacugccaccggguggaugacaaccaucaacggaaaggagcuuaagguggagggucagauuacuuacuauaauagguacaaacgucagaacguugugaaggaccugagcgucgaauuggaucgccucuccgaggaaucugugaauaacgacaucucgagcuggacgaaaggccgguccggggaggcucugucacuacugaagaaaagauucagucacaggccuguacaagaaaaguuugugugccucaacuguggauucgagacacaugccgaugagcaggcagcgcugaauauagcccgaucuuggcucuuuuugcggagccaggaauauaagaaauaccagaccaacaagacuaccggcaauacagacaaacgcgcuuucguugagaccuggcaauccuuuuauagaaagaaacugaaggaagucuggaagccagccguguga

SEQ ID NO: 11360 - RNA, 3378 nt, Artificial Sequence
  CasY variant__Candidatus Katanobacteria bacterium__OJI08769.1__CasY
augagaaagaaacuguucaagggcuacauccuccacaacaaaaggcuuguguauaccgggaaggccgcuauucggagcauaaaauacccccuggucgcaccuaauaagacagccuugaacaauuuauccgagaagaucauuuaugacuacgaacaucuguuuggaccacuaaacguugcgucuuaugcucgcaauucaaaccgauacagucucguggauuucuggaucgacagccugcgugccgguguaauuuggcaguccaaaucuacuucgcuuaucgaucugauaucaaaguuggagggcagcaaaaguccguccgaaaagaucuuugagcaaauugacuucgaacucaaaaauaagcuggauaaggagcaguuuaaagacaucauucugcucaacacggggaucagaucuagcuccaaugugaggucauuacggggacgcuuccugaagugcuuuaaagaggaguucagagauaccgaggaagucauagcauguguggacaaguggaguaaagaucuuauuguugagggcaagagcaucuuggugucuaaacaguuucuguauugggaggaagaguucgguauuaagaucuuuccccacuucaaggacaaccaugaucuaccuaaacucacauuuuucgucgaaccaucccuggaguucucaccccaccuuccucuggccaauugcuuggaaaggcucaagaaauuugacaucagccgggagagucuguuagggcuggauaacaauuucucugcuuuuuccaacuacuucaaugagcucuuuaaccuucugagccgcggagaaauuaagaaaauagugacugcaguauuggccguuucgaagucuugggagaacgaaccagagcuagaaaagcgacugcauuuccucuccgagaaagcuaagcugcuuggcuaccccaaacugaccucaaguugggccgacuauagaaugaucauuggcgggaagaucaaaagcuggcacuccaauuacacagagcaguugauaaaggugagggaagaccucaagaaacaccaaauugcgcuggauaaguuacaggaggaccugaaaaaggucguggauucuagccuacgggaacagaucgaggcacagcgugaagcccuccugccucuuuuggacaccaugcugaaagagaaggauuuuucagacgaucucgagcuguaucgcuucauccuuagugacuuuaagucccuguugaacggaagcuaccaaagauauauucagacugaagaggaaaggaaagaggaucgggacgugacaaagaaauacaaggaucucuauucuaaucugcgaaacaucccacgcuucuuuggugagucaaagaaggaacaguucaauaaauuuauuaacaagaguuuaccgaccauagacgucggccugaagauccuagaggacauuagaaaugcucucgaaacgguuagcgugaggaaacccccuuccaucacugaggaauacguaaccaagcagcuggagaaacuuucucggaaguacaaaaucaacgccuucaauucgaaccgcuucaagcaaauuacagaacagguguugagaaaguauaauaacggggaacugccaaaaauaagcgaggucuuuuacagguauccccgugaaucccauguggcaauccggauucucccuguuaagaucucaaauccacgaaaagauauuaguuaccuguuagacaaguaucagaucucucccgauuggaaaaacagcaauccgggagagguggucgaccugauagaaaucuacaaacuuacuuugggcuggcuccuguccuguaacaaggauuucucaauggacuuuagcucuuaugaucuaaaacuguucccugaggcugccucccucauuaagaacuuugguaguugccugagcggguacuaccuuucuaaaaugaucuucaauuguauuaccuccgagaucaagggaaugauaacauuguauaccagagacaaauuugugguaagguacguuacgcaaaugauuggcucaaaccagaaguucccccuguuaugccucgugggcgaaaagcagacuaaaaauuuuagucgcaacuggggaguccugaucgaggaaaagggggaucuuggugaggaaaagaaucaggagaagugucugauuuucaaagacaagacagauuuugcgaaagccaaggagguggaaaucuucaagaacaauauauggcggaucagaaccagcaaauaucaaauucaguuuuugaaccgccucuucaagaaaacuaaggagugggaccugaugaaucuaguccugucggaaccaucccucgugcuggaggaggaauggggcguuucuugggauaaagacaaacuuuugccucuguuaaagaaagaaaagagcugcgaggagaggcucuacuauucacugccccuuaaccuggugccagcaacagacuacaaagaacagagugcugagaucgagcagcgaaauaccuaucuagggcucgauguaggagaguucggcgucgccuacgcugugguucggauugugcgugacagaaucgaacuguuguccugggguuuucugaaggaucccgccuuaaggaaaauacgcgaacggguccaagacaugaagaagaaacaggugauggcaguauucucuagcuccucaacggccguggcuagaguuagggagauggcgauucacagccuccgaaaccagauccauaguaucgcacuggccuacaaggcuaaaauuaucuaugaaauuucuauauccaauuuugagaccgggggcaaccgcauggccaagaucuaccggagcauuaaagucucggauguguauagagagucaggagcagacacacuugugucugaaaugaucuggggcaagaagaauaaacagauggggaaccacauuaguuccuacgccacuagcuauaccuguugcaacugugcuaggacaccuuucgagcuggucaucgauaaugacaaggaauacgagaaaggaggugaugaauuuauauucaacguuggcgacgagaagaaagugcguggguuuuugcaaaagucucuccugggaaagacuaucaaaggcaaggaggugcuaaaaagcauuaaggaauaugcccgcccaccgauccgggagguacugcuugaaggugaggaugucgagcagcuccugaaaagaaggggcaauuccuacauuuaccgaugccccuucugcggguauaagaccgacgcagauauccaggcggcuuugaacauagccugucggggauacauuucagacaaugcaaaagacgccgugaaggaaggcgagcgcaagcuggauuauaucuuagaaguuagaaaacucugggagaagaacggggcugugcugaggagugccaaauuucuuuga

SEQ ID NO: 11361 - RNA, 3864 nt, Artificial Sequence
  CasY variant__Candidatus Kerfeldbacteria bacterium__OGY82221.1__CasY
augaagagaauccugaacagccucaaaguggccgcucuuaggcuguuguuccggggcaagggguccgaguuagucaaaaccguuaaguacccccuggugucuccuguacagggagcaguggaagaacuagccgaagcgauucgccacgacaaucuccaucuguuuggucaaaaagagauagucgaucuuauggaaaaggacgagggcacacagguguauucaguuguggauuucuggcuggacacuuugcgacucgggauguuuuucaguccaagcgcuaacgcccugaagaucacgcugggaaaauuuaauuccgaucaggucucuccguuccguaaggugcucgagcagucgcccuuuuucuuagcaggcagacugaaaguagaaccugccgagaggauucuuucaguugaaauccggaagauugguaaacgcgagaacagaguggagaauuacgcugcagacgucgaaaccugcuuuaucgggcaauugagcagugaugagaagcaguccauacagaagcuggccaacgacaucugggauucuaaagaccacgaggagcagaggaugcuaaaggcugauuucuuugccauuccacucaucaaagaccccaaggcggugacagaagaggauccugagaaugaaacugcaggaaaacaaaagccacuggagcuuugugugugccugguccccgaauuguauacccggggcuucggcagcauugccgacuuucucguucagcgccugacauuacugcgagacaaaauguccaccgauacugcugaggacugucucgaauacguggggaucgaggaggaaaagggaaacgguaugaacucacuucugggcacauucuugaagaaucuacagggggauggauucgagcagauauuucaauucaugcugggcaguuauguagguuggcaggggaaagaagacgugcucagagagaggcuggaucuucuggccgaaaaggucaaacgguugccuaagccaaaauuugcaggagaguggagcggccaucguauguuccuccacggccagcugaagucuugguccucaaacuuuuuccgcuuauuuaaugagaccagagaacugcuagagagcauuaagagugacauccaacaugcuacgaugcucauuucuuacguggaagagaaagggggauaucacccgcagcugcuuucccaguacaggaaguugauggagcagcugcccgcccuccggacuaaaguucuggauccugaaaucgagaugacccacaugagcgaagcggugcgaucguacaucaugauucauaagucugucgccgguuuccuuccagaccuguuggagucccucgaucgcgacaaagauagagaauuucuguuaucaauauuccccaggaucccuaagauugacaagaaaacaaaggagaucguggcaugggagcugccaggcgaacccgaggaaggguaucuauuuacugcuaauaaccucuuccggaauuuucuggagaacccgaaacacguaccucgcuucauggccgaaagaauacccgaggacuggaccaggcuucguagugcuccaguuugguucgauggaauggugaagcaauggcagaaagucgugaaccaguuggucgagagcccuggcgcccuguaccaguuuaaugaauccuuccuccggcaacgacugcaggcaauguuaacaguguauaagagagaccugcagaccgagaaguuucuuaaauugcucgccgauguuugcaggccccugguggacuucuuuggucuagggggcaacgauauuaucuucaagucuugucaggacccacgcaaacaauggcagacgguaaucccccugagcgucccugcugauguguacacugcgugcgaaggacucgcaauucggcugagagagacacuuggcuuugaauggaagaauuugaaagggcaugagagggaggacuuccugcgcuuacaccagcuccugggaaaccuucuguuuuggauccgagaugccaaguugguugugaaacucgaagacuggaugaauaacccauguguccaggaguauguggaagcucggaaggccauugaucugccgcuagagauauucgguuuugagguacccaucuuccugaauggcuaccucuuuucagaacugcgucaacuugaguugcuguuaagaaggaagagugugaugaccuccuauagcguuaaaacuacagggucuccuaaccgccucuuccagcuggucuaccuuccacugaaucccucagacccugaaaagaaaaacaguaauaacuuccaggagcggcuagauaccccaacgggacucagcagaagguuucuggacuugacccuggacgcauucgccggcaaguuacucacagaucccgugacucaagaacugaaaaccauggcugguuuuuacgaccaccuuuucggguuuaagcugccgugcaaguuggccgcaauguccaaucauccuggaucuucgagcaaaauggugguccucgcgaagcccaaaaagggaguugcuuccaacauuggcuucgagccaaucccugaucccgcccacccaguguuucgagugcgcucaaguuggccugagcugaaauaucuagaagggcugcuuuaccuccccgaggacacaccacugacuaucgaauuggcagagaccucuguaagcugucaguccgucucaagcguggccuucgaucugaagaauuuaacaaccauucucggacggguuggugaauuuagagugacugcugaccagccguucaagcugacgccuauaauccccgagaaagaggaaucuuuuauuggcaagacauaucuugggcuggaugccggagagagguccggcgucgguuucgcaaucgugaccguugacggggauggcuacgaagugcagcguuugggaguacaugaggacacucaacucauggcucugcagcaggucgccaguaaaagccuaaaggaaccaguguuccagccccugcgcaaaggcaccuuucggcaacaggagagaauuaggaagucucuucgagggugcuauuggaacuucuaccacgcgcucaugaucaaguaucgggccaaagugguccaugaggaauccguuggaucaaguggccuggugggucagugguugcgcgcuuuucagaaggaucugaaaaaggcagacguauuaccuaaaaagggcggcaaaaacgggguggauaagaagaaaagagagagcucggcccaagacacacucugggguggcgcuuucuccaagaaagaggaacagcagauagccuuugagguccaagcagcggggucuagccaguucugucugaagugcggauggugguuucagcuuggcaugagggaagugaaucggguucaggagucaggggugguccuggacuggaaccgaaguaucgugaccuucuugauugaauccucuggagagaaaguuuacggcuuuagcccacaacagcuagaaaaggguuucagacccgauaucgagacuuuuaagaaaauggugcgcgacuucaugaggccuccgauguuugaucguaaggggcggccagccgcugccuacgagagauucguccugggaaggcgccaccgaagauaucgguucgacaaaguauuugaagagagguucggccgcuccgcacucuuuauuugcccccguguggguuguggcaauuucgaucacucaagcgaacagagugcuguugugcuggcccuuaucggguacauagcagacaaggagggaaugucuggcaaaaaguuagucuaugugagacuggccgaacucauggcugaguggaaguugaaaaagcuggagcgguccaggguagaggaacagagcucggcgcaauga

SEQ ID NO: 11362 - RNA, 3579 nt, Artificial Sequence
  CasY variant__Candidatus Komeilibacteria bacterium__OJI06454.1__CasY
auggccgagagcaagcagaugcaaugcagaaaauguggcgcuuccaugaaguacgaagugaucgggcuggggaaaaagucuugcagguauaugugucccgacugcgguaaccacaccucagcacggaaaauucagaauaagaagaaacgcgauaagaaauacggcagugccagcaaggcgcagucccagcgaauagcugucgccggggcacucuauccugacaaaaagguucaaacaaucaagacuuacaaauauccagccgaucuuaacggagaggugcaugaccguggcguagcugaaaagauugagcaggcaauccaggaagaugagauuggucuguuggggccgucuucggaguacgccuguuggaucgcuucacagaaacaaagcgaacccuauaguguggucgacuucugguuugaugccgugugcgcgggaggcguuuucgcauacuccggcgccagauuacugucuacggugcuacagcucagcggggaggaauccguccugagggcugcccuugcaucaaguccuuuuguggacgauauaaaucuggcucaggccgagaaguucuuggcgguaagccggcgcaccggacaggacaaacucgguaagagaaucggcgaguguuuugccgaagggaggcuggaggcacugggaauuaaagaucggaugcgcgaauuuguucaagcuaucgacguggcccagacagcuggccagcgauuugccgcaaagcucaagauuuucgguaucucucaaaugccagaggccaaacaguggaacaaugauuccggguuaacugucugcauacugcccgacuacuaugugccugaagagaacagagcugaccagcuuguggucuugcugaggcggcuacgugagauugcguacuguaugggaaucgaagaugaggcaggcuuugaacaccucggcauugacccaggggcccugucaaauuucagcaacggaaaucccaagcgcgguuuucuuggcagacuguugaacaaugauaucaucgcucucgccaacaauaugagugcaaugaccccuuauugggaggggaggaaaggagaacugauugagcgguuagccuggcugaagcaucgagcugagggccucuaccuuaaagaaccacacuucgguaacucuugggccgaccaucgcuccagaauauuuagcaggaucgcaggguggcugucgggcugcgcgggaaaguugaagauugcuaaagaucagaucucuggcguucggacagaccuauuccugcucaagcgccugcuugaugccgugccgcaauccgcacccucaccugacuucauagccaguauuagcgcucuggauagauuuuuggaggccgcagaauccucucaggacccagcugagcagguaagggcccucuaugcguuccaccugaaugcccccgcugugcguagcaucgcaaacaaagccguccagcggucagauagucaagaaugguuaaucaaggagcuggacgcuguggaccaccuagaguuuaacaaagccuucccuuucuucuccgauaccgggaagaagaaaaagaaaggagcaaauagcaacggugcgccaucugaagaggaauacacugagacagagucaauucagcagcccgaagacgccgagcaggaaguuaauggccaagaggggaacggagcuaguaagaaucagaaaaaguuucagcgaaucccgagauucuuuggcgaagguagcagguccgaguaucgcauucucaccgaggccccucaguacuucgauauguuuuguaacaauaugcgggcaauauucaugcaacuggaaucucagcccagaaaggcuccaagggacuuuaaaugcuuccuucagaaccgcuugcaaaagcuguacaaacagacguuccucaaugcccgaucgaacaagugccgggcacugcuugagagcgugcugaucuccuggggagaauuuuauacuuacggcgccaaugagaaaaaguuccguuugagacaugaggcuucagaaaggaguucugauccugacuaugucgugcagcaggcgcucgagauugcccgccggcuguuuuuauucggauuugaauggagagauuguagcgcaggcgagaggguagaccugguugaaauccacaaaaaggcuaucuccuuccuacucgccauuacccaagccgaggugucagucgggagcuacaacuggcugggaaauucuacagugucccgauaucuuagugucgcugguacugauaccuuguacggcacacagcuggaagaguuucucaacgcaaccgugcugagccagaugcgcggguuagccauacggcugucuucccaggagcuuaaggacggauucgauguucaauuggaaucaaguugccaggacaaucuccagcaucugcuaguguauagagcgagcagggaucuggcugccuguaaacgugcaacgugccccgccgagcucgacccaaagauccugguacuucccgcuggcgcauuuauugccucggucaugaaaaugaucgaacgcggugacgagccuuuggcgggggcuuaccugcggcacagaccacacuccuucggcuggcagauuagggugcgaggaguugccgaggugggcauggaucaagggacugcauuagccuuucagaagccgacagaaucugagcccuucaaaaucaagccuuuuagcgcucaguacggaccaguccucuggcugaacucaaguuccuauucucaaagccaguaccuugacggcuuccugucccagcccaagaacuggucaaugcggguguugccucaggccgguagcguacgcguggaacaaagaguugcacucauauggaaucugcaggcugggaaaaugaggcuagagcggaguggagcccgagcguucuuuaugccaguccccuucucuuuuagaccguccggcagcggugaugaagccgugcuggcaccuaaccgcuaucucggccuguucccacauucagggggaaucgaguacgcuguggucgacguucuugauucggccggcuuuaagauuuuggagagggggaccaucgcugugaauggauucucucagaaacguggcgaacggcaggaggaagcacacagagagaagcaaaggcgcgguauuagugacaucgggcgaaagaagcccgugcaggccgaaguagaugccgcuaacgagcugcauagaaaguauacugacgucgcgacacgguuaggauguaggauagugguucagugggcaccucagcccaaaccaggcaccgccccuacggcucaaaccguguacgcccgcgcaguccguacagaggcccccagauccgguaaucaggaagaucacgcucggaugaaaagcucuuggggcuauacuuggagcaccuacugggagaaaaggaagccagaagacauucucgggaucuccacacagguguacuggacuggaggcauuggggagucaugcccggcgguugccguggcacugcuuggacauauccgcgcuaccaguacacagaccgaaugggagaaagaggaaguagucuuuggccgacugaagaaguucuuuccuagcuga

SEQ ID NO: 11363 - RNA, 3633 nt, Artificial Sequence
  CasY variant__Candidatus Parcubacteria bacterium__APG80656.1__CasY
augagcaagagacaccccaggaucuccggcgugaaaggguaccggcugcaugcccagcgccucgaguauaccggaaagucuggugcuaugcgaacaauuaaauacccucuuuauucaaguccaagcggcgggcguacugucccgagagaaauaguuuccgcaaucaacgacgauuacgugggacuguauggcuugucuaauuucgacgauuuauacaacgccgagaagaggaaugaagagaaaguauauucggugcuggacuuuugguacgauugcguccaauacggugcgguguucucauauacggcucccgggcuacucaagaacguugccgaagugcggggaggcagcuacgagcugaccaagacacuuaaaggcagucaccuguaugacgaguugcagauugauaaggucaucaaauuucucaauaagaaagaaauuucccgcgcaaacgggucucuggacaagcugaagaaagauaucauagacuguuucaaggccgaguacagagaaaggcauaaagaucagugcaauaagcucgcugacgauaucaaaaacgcaaagaaagacgccggagcuagcuuaggugagcggcagaagaagcuguuucgcgacuucuuuggcauuuccgagcaaucagaaaaugauaaaccuaguuucacuaacccacuuaauuugaccuguugccugcuacccuuugacacagugaacaauaaccgaaauagaggggagguacucuucaacaagcugaaagaauaugcccagaaacuugauaaaaacgagggaagccuggaaaugugggaguacaucggcauugguaauucugggaccgcguuuuccaacuucuugggagagggcuuucucggcaggcugcgggaaaauaagaucacugaguuaaagaaagcaaugauggacauaacagaugccuggcgugggcaggaacaggaggaggaacuggagaagcgccucaggauucuugcugcccugaccaucaaauugagagaaccuaaguucgacaaccacuggggagguuaucggucagauauuaauggcaaacuaagcaguuggcugcaaaacuacaucaaucagacgguuaagaucaaggaggaccucaaagggcauaagaaagaucugaagaaagcaaaggaaaugauuaaccgauucggagagucugacacuaaggaagaggcuguggucuccagccuucuggagucgauagaaaagaucgugccagaugacucugccgacgaugagaagcccgacauuccugcgaucgccauauaccgcagauuuuuguccgauggcaggcucacccugaaucgguucgugcagcgcgaagacguccaggaggcauuaauuaaagagagacuggaagcugagaagaaaaagaaaccaaagaagaggaaaaagaaaucagaugccgaagacgagaaggaaacaaucgauuuuaaagagcuauucccgcaccucgcuaagccccugaaacuuguuccuaacuuuuauggugacaguaaacgugaguuguacaagaaauauaagaaugccgcaaucuacacugaugcccuguggaaagcuguggaaaagauuuauaagagcgcguucuccucuagccucaaaaacucauuuuucgacaccgauuuugacaaggauuucuuuaucaaacggcugcaaaagauuuucaguguauaccgaagauuuaauacagacaaauggaagccaauagugaagaacuccuucgcacccuauugugacaucgucagccuugccgagaaugaagugcuguacaaaccuaagcagucuaggucacgcaaaagugcugccauugauaagaaccggguuagauugccaagcaccgagaacaucgcaaaagccgggaucgcucucgccagggaacuguccguggcaggcuucgacuggaaggauuuacugaaaaaggaggagcacgaagaguacauugaccuaauagaacuccauaagacggcgcuggcucuuuugcuggccgucacugagacacagcucgauaucucugcacuggacuuuguggaaaauggaaccguaaaagauuucaugaagacucgcgacggcaacuuaguucuggaggggcgauuucuugagauguucucgcaaagcauuguguuuuccgaauugcggggacucgccggucugaugucacguaaagaguucaucacaagaagugcuauucagaccaugaauggcaagcaggccgaacuacuguauaucccccacgaguuucagucugcaaaaauaacgaccccgaaggagaugagcagggcuuuccucgaucuggccccugcggaauuugccacaucccuugagcccgaaucauugagcgagaagucucuguuaaaacucaagcaaaugcgcuacuauccacauuacuucggguaugaacugacucggaccggacagggcaucgacgguggggucgcugagaacgcacuuagacuggagaaauccccugugaagaaaagggaaauuaagugcaagcaguacaaaacauugggccgaggacagaauaagaucguccucuaugugcgcaguagcuacuaccaaacucaguuucuggagugguuccuacaccggcccaaaaacguucagaccgauguggccguaucuggcuccuuucugauugacgaaaagaaagucaagacaagauggaauuaugaugcucucaccguggcccuggagccaguuucagggagugaaaggguguucgucagccagcccuucacuaucuuuccugagaagucggcagaggaagagggacaacguuaccuugguauagacauuggcgaauaugggaucgcguacacggccuuggagauuacaggagacuccgcuaaaauccuggaucagaacuucauaucugacccacaguuaaagacccuccgcgaagaggugaaaggccugaaacuugaucagcggagagguacuuuugccaugccgagcaccaagaucgcaaggauucgagagucacugguacacagucuacggaaucgcauccaucaccucgcucugaagcauaaggccaaaauuguguaugaauuggagguuuccagauucgaagaggggaagcaaaagaucaagaaagucuacgcaacacugaagaaagccgacguguauucugagauagaugcugacaagaacuuacagaccacuguguggggcaagcucgcggucgccagcgaaauuuccgcaucauacacaagccaguuuuguggagcuugcaaaaagcuguggagggccgagaugcaaguugaugaaacgaucaccacucaggagcuuaucggcacagugcgggugauuaaagggggaacccugaucgacgccauuaaggauuucaugcgacccccuauauuugacgaaaaugauacaccauuccccaaauacagagacuuuugugacaagcaccauaucaguaagaaaaugcgcggcaacucuugcuuguucauuuguccuuuuugcagggcuaaugcagaugccgacauccaggcgucccagacuauugcucuccugcguuauguaaaggaggagaaaaaggucgaagauuacuucgagcgguucagaaaacuaaagaacaucaaggugcugggucaaaugaaaaagauauga

SEQ ID NO: 11364 - RNA, 3681 nt, Artificial Sequence
  CasY variant__Candidatus Vogelbacteria bacterium__OJI07455.1__CasY
augcagaaggugagaaaaacccugagcgagguccacaagaaccccuacggcacaaaaguuaggaaugccaagacuggguauucccuccaaaucgaacggcuuucuuacacgggaaaagaggguaugcgcucauucaagauuccucuggaaaacaagaauaaagagguguuugacgaguucguaaagaaaauacgaaacgauuauaucagucaggugggcuuguuaaaucugagcgacugguacgaacauuaucaggagaagcaggaacacuacucccuagcugauuuuuggcucgacucucugcgugcaggggucauuuucgcccauaaagagaccgaaaucaagaaccuuauuucgaagaucagaggagauaaaucaauaguggacaaguuuaaugcgagcaucaaaaagaaacacgcugaucuguaugccuugguugacauuaaggcacucuacgauuuccugacaagugacgccaggcggggccugaaaacugaggaggaauuuuucaacuccaagcgcaauacccucuuuccaaaguucagaaagaaggauaacaaagcuguggacuuaugggucaagaaauuuaucggucuggauaauaaggacaaacuuaacuucaccaaaaaguuuauuggguucgacccgaauccccaaaucaaauacgaucauacauucuuuuuccaccaggacauaaacuuugauuuggagaggauuacuacaccuaaggaacugaucucuaccuauaaaaaguuccuaggaaagaauaaagaccucuacggcagcgaugagacgacugaagaccagcugaagauggugcuuggcuuucacaacaaccauggggcauucuccaaauauuuuaaugccucacuggaggcuuuccggggacgcgauaacaguuugguagagcagauuaucaauaacagcccauacuggaacucucaccgaaaggaacucgagaaaagaaucauuuuucugcaaguucaguccaagaagauaaaagaaaccgaguuagguaagccccaugaauaucuggccucauucggcgggaaauuugagagcugggugaguaauuaccucaggcaggaggaagaggucaagcggcagcuuuucggauaugaagagaauaaaaagggccagaaaaaguuuaucguggguaacaagcaagaacuggacaaaauuauccgugggacagaugaguacgagauaaaggcgauuucuaaagaaacuaucggauugacccagaagugccuaaaacugcucgagcaacugaaggacuccguggaugacuacacacuuagccuguaucgccaguugaucgucgaacucagaauuaggcugaauguugaguuccaggagaccuacccugaauuaaucggcaagucggagaaagacaaggaaaaagaugcaaagaacaaacgggccgacaagcgauauccacagauuuucaaggauauaaaacugauccccaauuuucuaggcgagacgaagcaaaugguguacaaaaaguucauucgcucugcugacauccucuaugaagggaucaacuuuauugaucagauagacaaacagaucacucagaaucugcuuccuuguuucaagaacgauaaggagagaauugaguuuacagaaaaacaauucgagaccuugaggcggaaguacuaucugaugaacuccucacgcuuucaccacguaaucgaaggaauuaucaauaacagaaaacucauagagaugaagaaaagggaaaauagugagcugaagacuuucagcgacuccaaauuugugcuuucuaagcuguucuugaagaaagguaagaaauacgagaacgaagucuacuauacauuuuacaucaauccaaaggcccgugaucagcggcgaauuaaaaucgugcucgacauuaacggcaauaacagcguugggauccugcaggauuuagugcagaagcugaagccgaaaugggacgauauaauuaagaaaaaugacaugggagagcuaaucgacgcaauugaaaucgagaaggucagacucggcauacugaucgcucuuuauugcgaacauaaauucaagauuaagaaagaguugcugucacucgaucuguuugccagugcguaccaauauuuagagcuggaagacgaucccgaggaacuuuccgguaccaacuuggggagguuccuccagagccugguguguucugagaucaagggcgccauuaauaaaaucucacgcacggaguacauagaacgguauaccguacagccuaugaacacagagaagaauuacccacuacugauuaacaaagaaggaaaggcaacuuggcacaucgcugccaaggacgaucucaguaaaaagaaaggcgggggaaccguugcuaugaaucagaagaucgguaaaaacuucuuuggcaagcaagacuacaagacaguguucaugcugcaggauaaaagauuugaccuuuugacuagcaaguaucaucugcaguucuuauccaaaacccucgauacagggggaggcucuugguggaagaauaaaaacauugaccugaaccuuucgagcuacuccuuuaucuucgagcaaaaggucaaaguggaaugggaucugaccaauuuggaccaccccauuaagauaaagccuucagagaacagugaugacaggcgccucuuugucucuaucccauucgugauuaaacccaagcagacuaaacgaaaggaccugcagacgcggguuaauuauauggguaucgauauuggggaguacggccuagccuggacaaucauaaacaucgaccugaaaaauaagaagauuaacaaaaucagcaagcagggauuuauuuaugaaccgcucacccauaaagugcgugauuacguagcaacuaucaaggacaaucaagucagaggcaccuucgggaugccugauacaaaacuggccaggcuucgcgagaacgcuauaaccuccuugcggaaucaggugcacgacauugcgaugagauaugaugcaaagcccguuuacgaauuugagaucucaaacuucgaaacuggaagcaauaaggugaaagucaucuacgacucugugaagagggccgauauuggucgaggccagaacaauacagaggcugacaacacggagguaaaucuggugugggggaaaaccuccaagcaguucggaagucaaauaggcgccuaugcaacuagcuacaucugcucuuuuugugguuauuccccauacuaugaguucgaaaacucaaaaaguggggaugaagagggcgcccgcgacaacuuauaccagaugaagaagcucagccggccuucgcuggaagacuuucuucagggaaaucccguuuauaaaacauucagagauuuugacaaguacaaaaacgaucagaggcugcaaaagaccggcgacaaagauggggaguggaagacacaccguggaaauacugcuauuuacgccugccagaaaugucgccauaucuccgacgcagauauucaggcgucuuauuggaucgcucuaaagcaagucgugcgggacuucuacaaggauaaagagauggacggcgaucucauacagggugacaacaaggauaaaagaaaggugaaugaacugaacagguugaucgggguccacaaagacguuccaauuaucaauaagaaccugauuaccagcuuagacaucaaucuccuguga

SEQ ID NO: 11365 - RNA, 3603 nt, Artificial Sequence
  CasY variant__Candidatus Vogelbacteria bacterium__OJI09436.1__CasY
augaaggccaaaaagagcuucuacaaccagaaaagaaaguuuggcaaaaggggguaucggcugcacgacgagcgcaucgcuuacuccggagguauuggcucuaugcgaucaauaaaguaugaacucaaggauaguuacgggaucgcaggacuucguaauagaauugccgacgcgaccaucagcgauaacaaauggcuguauggcaauauuaacuugaaugacuacuuagaguggagguccucuaagacagauaaacaaaucgaagacggugaucgggagucgucacugcuaggguucuggcucgaagcucugcgccuuggauuuguguucagcaagcagagucaugcccccaacgacuuuaaugagacugcacugcaggauuuguucgagacgcucgacgaugaccugaaacacguccuggauagaaagaaguggugcgacuuuauaaaaaucggcaccccuaagacaaacgaccagggcaggcucaaaaagcaaauuaaaaauuuacugaaggggaacaaacgggaagagaucgaaaagacucuuaaugaguccgaugacgaguugaaggaaaagauuaaccgcaucgccgauguuuucgcuaagaauaaaucugacaaguauaccauauuuaaacuggauaagccaaacacagagaaguacccgcgaauuaaugacgugcagguagcauucuuuugucaucccgauuucgaagagaucaccgaaagagacaggacuaaaacacuagaucucauuaucaaccgguuuaacaagcguuacgagaucaccgagaauaaaaaggacgauaaaacgagcaaccgcauggcccuguauucccuuaaucagggauacauuccuagagugcugaacgacuuguuccucuucgucaaggacaaugaagaugacuuuucacaguuccugagugauuuagagaacuuuuucagcuuuucuaaugaacaaauaaagaucauuaaagagaggcugaagaaacucaagaaauaugcugaaccaauccccgguaagccucagcuugccgacaagugggaugacuacgcguccgauuucggcgggaaacuggagucaugguauagcaaccggauagagaaguugaaaaagauuccagaaagugugucugaccuacgaaauaaccuggagaaaauccgcaauguucucaagaaacagaacaaugcauccaagauccuggaacuuagccagaagauuaucgaguacauuagagauuauggagugucguuugaaaaacccgagauaaucaaguucucuuggauuaacaaaacuaaggacggccagaaaaaggucuuuuacguggccaagauggcugauagggaguucaucgaaaaacuggacuuguggauggccgaucuccggucccaacugaaugaguacaaccaggacaacaagguaucauuuaaaaagaaagguaagaagaucgaagaguuagggguucuggacuucgcacuaaauaaagcuaagaaaaacaagaguaccaaaaaugagaacggauggcaacagaagcucagcgaauccauucagucugccccucuguuuuucggcgagggcaaucgcgugagaaacgaagaggucuauaaucuuaaggauuugcuguucagcgaaauuaaaaacguggagaauauccucaugucaagugaggcggaagaccugaagaacauuaaaaucgaguacaaggaagauggggccaaaaagggaaauuaugugcuuaacguccuggcaagguuuuacgcucguuucaaugaggacgguuauggcggguggaacaaaguuaagacaguguuggaaaauauugcccgggaggcuggaacugauuuuuccaaguacggcaacaacaauaaccgaaaugccgguagauucuaucucaacgggagggagcgccagguauuuacccugaucaaauucgaaaagagcauaacaguggagaaaaucuuagaacuggucaagcuaccaucucuccuggacgaggcauaccgggaucuugugaaugaaaacaaaaaucacaaguugagagacguuauucaacugucaaagaccaucauggcccucgugcugagucauagcgauaaagagaagcagauuggcggaaacuacauccacuccaaauuaucuggcuauaaugcucugauaucgaagagggacuuuauuagccgcuacuccguccagacgacuaacgggacacagugcaaacuugcgaucggaaaggguaagaguaaaaagggcaaugagauugaucgauauuucuacgcauuucaauucuuuaaaaacgacgauucaaagaucaauuugaaagugauaaagaacaauucucacaagaacaucgacuucaacgacaaugaaaacaaaauuaaugcccuccagguauauagcuccaacuaccagauccaguuucuggauugguucuucgagaagcaucaagggaaaaagaccucacuagaaguuggaggcagcuuuacuauugcugagaaaucucugacaaucgacugguccgguaguaauccgcgggugggguucaagcguagcgauaccgaggaaaagagagucuuugugucucagcccuucacgcucauaccugacgaugaggacaaagaaaggcgcaaggagcggaugauuaaaaccaagaacagauuuaucggcaucgauauuggagaauauggccuggccuggucccuuaucgaggucgacaauggggauaaaaacaauaggggaauacgacaguuggagucagguuucauaacagacaaccagcaacaggugcugaagaaaaauguuaagaguuggcgccagaaccaaauccggcagacuuuuaccagcccagauacaaagauugcaagauuaagggaaucgcucaucggcuccuacaaaaaucagcuggagucucuuaugguggccaagaaagcuaaccugagcuucgaauacgagguaucaggguuugaagucggaggcaagcguguggccaaaauuuaugacaguaucaagcgcgguuccguucggaagaaagacaauaacucucagaaugaucaaagcugggggaagaaaggcauaaacgagugguccuucgagacuaccgcagcgggaacaucacaguuuuguacccacugcaagagauggagcaguuuggcuaucguggacauugaagaguacgaacucaaagauuauaacgacaaucuguucaaggucaagaucaacgauggcgaggugaggcuacuggggaaaaagggauggcgaucuggcgagaaaauuaaggguaaagaacucuucgggcccguaaaggacgccaugcggccuaauguggauggacugggcaugaagaucguuaaacgcaaguaccuuaaauuggaccugagagauugggucuccagguaugguaacauggcaauauuuauuuguccauacguggacugccaucacaucagccacgccgauaagcaggcugccuucaauaucgcagugcggggcuauuuaaaaucggucaaccccgaccgagcuauuaagcauggggauaaaggacucucaagagacuuucugugucaggaggaaggcaaacuuaauuucgagcaaauagggcugcuauga

SEQ ID NO: 11366 - RNA, 3462 nt, Artificial Sequence
  CasY variant__Candidatus Vogelbacteria bacterium__PIP58309.1__CasY
augcagaaggugagaaaaacccugagcgagguccacaagaaccccuacggcacaaaaguuaggaaugccaagacuggguauucccuccaaaucgaacggcuuucuuacacgggaaaagaggguaugcgcucauucaagauuccucuggaaaacaagaauaaagagguguuugacgaguucguaaagaaaauacgaaacgauuauaucagucaggugggcuuguuaaaucugagcgacugguacgaacauuaucaggagaagcaggaacacuacucccuagcugauuuuuggcucgacucucugcgugcaggggucauuuucgcccauaaagagaccgaaaucaagaaccuuauuucgaagaucagaggagauaaaucaauaguggacaaguuuaaugcgagcaucaaaaagaaacacgcugaucuguaugccuugguugacauuaaggcacucuacgauuuccugacaagugacgccaggcggggccugaaaacugaggaggaauuuuucaacuccaagcgcaauacccucuuuccaaaguucagaaagaaggauaacaaagcuguggacuuaugggucaagaaauuuaucggucuggauaauaaggacaaacuuaacuucaccaaaaaguuuauuggguucgacccgaauccccaaaucaaauacgaucauacauucuuuuuccaccaggacauaaacuuugauuuggagaggauuacuacaccuaaggaacugaucucuaccuauaaaaaguuccuaggaaagaauaaagaccucuacggcagcgaugagacgacugaagaccagcugaagauggugcuuggcuuucacaacaaccauggggcauucuccaaauauuuuaaugccucacuggaggcuuuccggggacgcgauaacaguuugguagagcagauuaucaauaacagcccauacuggaacucucaccgaaaggaacucgagaaaagaaucauuuuucugcaaguucaguccaagaagauaaaagaaaccgaguuagguaagccccaugaauaucuggccucauucggcgggaaauuugagagcugggugaguaauuaccucaggcaggaggaagaggucaagcggcagcuuuucggauaugaagagaauaaaaagggccagaaaaaguuuaucguggguaacaagcaagaacuggacaaaauuauccgugggacagaugaguacgagauaaaggcgauuucuaaagaaacuaucggauugacccagaagugccuaaaacugcucgagcaacugaaggacuccguggaugacuacacacuuagccuguaucgccaguugaucgucgaacucagaauuaggcugaauguugaguuccaggagaccuacccugaauuaaucggcaagucggagaaagacaaggaaaaagaugcaaagaacaaacgggccgacaagcgauauccacagauuuucaaggauauaaaacugauccccaauuuucuaggcgagacgaagcaaaugguguacaaaaaguucauucgcucugcugacauccucuaugaagggaucaacuuuauugaucagauagacaaacagaucacucagaaucugcuuccuuguuucaagaacgauaaggagagaauugaguuuacagaaaaacaauucgagaccuugaggcggaaguacuaucugaugaacuccucacgcuuucaccacguaaucgaaggaauuaucaauaacagaaaacucauagagaugaagaaaagggaaaauagugagcugaagacuuucagcgacuccaaauuugugcuuucuaagcuguucuugaagaaagguaagaaauacgagaacgaagucuacuauacauuuuacaucaauccaaaggcccgugaucagcggcgaauuaaaaucgugcucgacauuaacggcaauaacagcguugggauccugcaggauuuagugcagaagcugaagccgaaaugggacgauauaauuaagaaaaaugacaugggagagcuaaucgacgcaauugaaaucgagaaggucagacucggcauacugaucgcucuuuauugcgaacauaaauucaagauuaagaaagaguugcugucacucgaucuguuugccagugcguaccaauauuuagagcuggaagacgaucccgaggaacuuuccgguaccaacuuggggagguuccuccagagccugguguguucugagaucaagggcgccauuaauaaaaucucacgcacggaguacauagaacgguauaccguacagccuaugaacacagagaagaauuacccacuacugauuaacaaagaaggaaaggcaacuuggcacaucgcugccaaggacgaucucaguaaaaagaaaggcgggggaaccguugcuaugaaucagaagaucgguaaaaacuucuuuggcaagcaagacuacaagacaguguucaugcugcaggauaaaagauuugaccuuuugacuagcaaguaucaucugcaguucuuauccaaaacccucgauacagggggaggcucuugguggaagaauaaaaacauugaccugaaccuuucgagcuacuccuuuaucuucgagcaaaaggucaaaguggaaugggaucugaccaauuuggaccaccccauuaagauaaagccuucagagaacagugaugacaggcgccucuuugucucuaucccauucgugauuaaacccaagcagacuaaacgaaaggaccugcagacgcggguuaauuauauggguaucgauauuggggaguacggccuagccuggacaaucauaaacaucgaccugaaaaauaagaagauuaacaaaaucagcaagcagggauuuauuuaugaaccgcucacccauaaagugcgugauuacguagcaacuaucaaggacaaucaagucagaggcaccuucgggaugccugauacaaaacuggccaggcuucgcgagaacgcuauaaccuccuugcggaaucaggugcacgacauugcgaugagauaugaugcaaagcccguuuacgaauuugagaucucaaacuucgaaacuggaagcaauaaggugaaagucaucuacgacucugugaagagggccgauauuggucgaggccagaacaauacagaggcugacaacacggagguaaaucuggugugggggaaaaccuccaagcaguucggaagucaaauaggcgccuaugcaacuagcuacaucugcucuuuuugugguuauuccccauacuaugaguucgaaaacucaaaaaguggggaugaagagggcgcccgcgacaacuuauaccagaugaagaagcucagccggccuucgcuggaagacuuucuucagggaaaucccguuuauaaaacauucagagauuuugacaaguacaaaaacgaucagaggcugcaaaagaccggcgacaaagauggggaguggaagacacaccguggaaauacugcuauuuacgccugccagaaauguuga

SEQ ID NO: 11367 - RNA, 3480 nt, Artificial Sequence
  Cas13a variant__Leptotrichia buccalis__WP_015770004.1__Cas13a
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaguacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaucgcaagcugaaaaacgccgugaugaagucugucguggacauccuuaaagaauauggcuucguggccacauucaagauuggggcugauaagaaaaucggcauucagacccuggaguccgaaaagaucguucaccucaaaaaucugaagaaaaagaagcucaugaccgacagaaacagcgaggagcugugcaaacuugucaagaucauguuugaauacaaaauggaggaaaagaaaucugagaacuga

SEQ ID NO: 11368 - RNA, 3480 nt, Artificial Sequence
  Cas13a variant__Leptotrichia buccalis__WP_015770004.1__Cas13a(R472A,H477A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauugcucaugggaucgucgccuucaaucuggagcucgaaggaaaggauaucuuugcguucaaaaacauugccccgagcgagaucuccaagaaaauguuucagaaugaaauuaacgagaagaagcugaaacuuaagaucuuccggcaacucaauucugcuaacguguuuagauaccuggagaaauauaagauucugaauuaccugaaacgcacccgguucgaauuuguuaacaagaauauccccuucgugccuagcuuuacaaaacucuauuccagaaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcgcaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggccaauaacggacggcuuucucugaucuacauuggcuccgaugaagagaccaauacaagccucgcugaaaagaaacaagaguucgacaaguuucugaaaaaguaugaacagaacaauaacaucaagauucccuacgagaucaaugaguuccugagagaaauuaaacuugggaacauccucaaguauacggagcgccugaauauguuuuaccugauccucaaacugcuuaaccacaaggaacugaccaaccucaaaggaucccuggagaaguaucagucugcgaauaaggaagaggccuucagcgaucagcuggagcuuauuaaccuccugaaucuggacaacaaucgggucacagaagauuuugagcucgaagcugacgagaucggcaaauuccuggacuucaacgggaauaaggugaaagauaacaaggagcuuaaaaaguuugacaccaauaaaauuuacuucgauggagaaaacaucauuaagcauagagccuuuuauaauaucaagaaauacggcaugcugaaccuccuggagaagaucgccgacaaagcuggcuacaagauuuccaucgaggaacugaaaaaguauucuaauaagaaaaacgaaauugagaagaaucacaaaaugcaagagaaccuucaccgcaaguacgcccggccuagaaaagaugaaaaguucacagacgaggauuaugaaagcuacaagcaggcgaucgagaacauugaagaguauacccaucucaaaaauaaggucgaguuuaacgaacugaaucugcuccaggggcugcuucugcggauccuccaccgccuggugggauacacguccaucugggagagagaccugcgguucagacuuaaaggcgaauuuccggagaaccaguauauugaagagaucuucaauuuugagaacaagaaaaauguuaaguacaaagggggacaaauuguggaaaaguacaucaaguucuauaaagagcugcaucagaacgaugaagucaagauuaauaaauacagcucugcuaacaucaaggugcucaaacaggagaagaaggaccuguauauucgcaauuacaucgcccacuuuaacuauaucccccacgccgagauuucccuccuggaaguucuugagaaucugcggaaacuccugagcuacgauagaaagcugaaaaacgcugugaugaagucugucguggacauccuuaaagaauauggcuucguggccacauucaagauuggggcugauaagaaaaucggcauucagacccuggaguccgaaaagaucguucaucucaaaaaucugaagaaaaagaagcucaugaccgaccgcaacagcgaggagcugugcaaacuugucaagaucauguuugaauacaaaauggaggaaaagaaaucugagaacuga

SEQ ID NO: 11369 - RNA, 3480 nt, Artificial Sequence
  Cas13a variant__Leptotrichia buccalis__WP_015770004.1__Cas13a(R1048A,H1053A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaguacaucaaguucuauaaagagcugcaccagaacgaugaagucaagauuaauaaauacagcucugccaacaucaaggugcucaaacaggagaagaaggaccuguauauugcgaauuacaucgcugccuuuaacuauaucccccacgccgagauuucccuccuggaaguucuugagaaucugcggaaacuccugagcuacgauagaaagcugaaaaacgcugugaugaagucugucguggacauccuuaaagaauauggcuucguggccacauucaagauuggggcugauaagaaaaucggcauucagacccuggaguccgaaaagaucguucaucucaaaaaucugaagaaaaagaagcucaugaccgaccgcaacagcgaggagcugugcaaacuugucaagaucauguuugaauacaaaauggaggaaaagaaaucugagaacuga

SEQ ID NO: 11370 - RNA, 3480 nt, Artificial Sequence
  Cas13a variant__Leptotrichia buccalis__WP_015770004.1__Cas13a(R472A,H477A,R1048A,H1053A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauugcucaugggaucgucgccuucaaucuggagcucgaaggaaaggauaucuuugcguucaaaaacauugccccgagcgagaucuccaagaaaauguuucagaaugaaauuaacgagaagaagcugaaacuuaagaucuuccggcaacucaauucugcuaacguguuuagauaccuggagaaauauaagauucugaauuaccugaaacgcacccgguucgaauuuguuaacaagaauauccccuucgugccuagcuuuacaaaacucuauuccagaaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcgcaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggccaauaacggacggcuuucucugaucuacauuggcuccgaugaagagaccaauacaagccucgcugaaaagaaacaagaguucgacaaguuucugaaaaaguaugaacagaacaauaacaucaagauucccuacgagaucaaugaguuccugagagaaauuaaacuugggaacauccucaaguauacggagcgccugaauauguuuuaccugauccucaaacugcuuaaccacaaggaacugaccaaccucaaaggaucccuggagaaguaucagucugcgaauaaggaagaggccuucagcgaucagcuggagcuuauuaaccuccugaaucuggacaacaaucgggucacagaagauuuugagcucgaagcugacgagaucggcaaauuccuggacuucaacgggaauaaggugaaagauaacaaggagcuuaaaaaguuugacaccaauaaaauuuacuucgauggagaaaacaucauuaagcauagagccuuuuauaauaucaagaaauacggcaugcugaaccuccuggagaagaucgccgacaaagcuggcuacaagauuuccaucgaggaacugaaaaaguauucuaauaagaaaaacgaaauugagaagaaucacaaaaugcaagagaaccuucaccgcaaguacgcccggccuagaaaagaugaaaaguucacagacgaggauuaugaaagcuacaagcaggcgaucgagaacauugaagaguauacccaucucaaaaauaaggucgaguuuaacgaacugaaucugcuccaggggcugcuucugcggauccuccaccgccuggugggauacacguccaucugggagagagaccugcgguucagacuuaaaggcgaauuuccggagaaccaguauauugaagagaucuucaauuuugagaacaagaaaaauguuaaguacaaagggggacaaauuguggaaaaguacaucaaguucuauaaagagcugcaucagaacgaugaagucaagauuaauaaauacagcucugcuaacaucaaggugcucaaacaggagaagaaggaccuguauauugccaauuacaucgccgcuuuuaacuauaucccccacgccgagauuucccuccuggaaguucuugagaaucugcgcaaacuccugagcuacgaucggaagcugaaaaacgcugugaugaagucugucguggacauccuuaaagaauauggcuucguggccacauucaagauuggggcggauaagaaaaucggcauucagacccuggaguccgaaaagaucguucaccucaaaaaucugaagaaaaagaagcucaugaccgacagaaacagcgaggagcugugcaaacuugucaagaucauguuugaauacaaaauggaggaaaagaaaucugagaacuga

SEQ ID NO: 11371 - RNA, 3480 nt, Artificial Sequence
  Cas13a variant__Leptotrichia buccalis__WP_015770004.1__Cas13a(R1079A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaguacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaugccaagcugaaaaacgccgugaugaagucugucguggacauccuuaaagaauauggcuucguggcuacauucaagauuggggccgauaagaaaaucggcauucagacccuggaguccgaaaagaucguucaccucaaaaaucugaagaaaaagaagcucaugaccgaccgcaacagcgaggagcugugcaaacuugucaagaucauguuugaauacaaaauggaggaaaagaaaucugagaacuga

SEQ ID NO: 11372 - RNA, 3480 nt, Artificial Sequence
  Cas13a variant__Leptotrichia buccalis__WP_015770004.1__Cas13a(E299A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgcuaugucccagcugcuuaagaauuaugucuacaaacggcugagcaacaucuccaaugauaagauuaagcgcaucuuugaguaucaaaaccucaaaaagcugauugagaacaaacuucugaauaagcucgacacauacguuagaaacugugggaaauauaauuacuaucugcaggauggagaaaucgccaccucugacuucauugcgcggaaccgccagaaugaggccuuucugagaaacaucaucggcgugagcuccguggcuuacuucagccuccggaauauucuggaaacggagaacgaaaaugauaucaccggcagaaugcgcgggaagacagucaagaacaauaaaggagaggagaaguacgugucuggcgaaguugacaaaauuuauaacgagaauaagaaaaacgaagugaaggagaaucuuaagauguucuacuccuaugauuuuaacauggacaacaaaaaugaaaucgaggauuucuuugccaacauugacgaggcuaucagcucuauucggcaugggaucguccacuucaaucuggaacucgagggaaaggauaucuuugccuucaaaaacauugcgccgagcgaaaucuccaagaaaauguuucagaaugagauuaacgaaaagaagcugaaacuuaagaucuucagacaacucaauucugccaacguguuucgcuaccuggagaaauauaagauucugaauuaccugaaacggaccagauucgaguuuguuaacaagaauauccccuucgugccuagcuuuacaaaacucuauucccgcaucgacgaccugaagaacagccuuggcauuuacuggaagacccccaaaacgaaugaugacaacaagacaaaagaaaucauugaugcucagaucuaccugcucaagaauauuuauuacggggaguuccugaacuauuucaugucuaacaauggaaacuuuuucgaaaucuccaaagagaucauugagcugaauaagaacgacaagcggaaucuuaaaaccggcuuuuacaagcuccagaaauucgaagauauccaggagaagauuccuaaagaauaucuggccaacauccaaagccuguacaugauuaaugcuggcaaccaggacgaggaagagaaggauacauauaucgacuuuauccagaagauuuuccucaaaggguuuaugaccuaccuggccaauaacggaagacuuucucugaucuacauuggcuccgaugaggaaaccaauacaagccucgccgagaagaaacaagaguucgacaaguuucugaaaaaguaugagcagaacaauaacaucaagauucccuacgaaaucaaugaguuccugcgcgagauuaaacuugggaacauccucaaguauacggaacggcugaauauguuuuaccugauccucaaacugcuuaaccauaaggagcugaccaaccucaaaggaucccuggaaaaguaucagucugcuaauaaggaggaagcguucagcgaucagcuggagcuuauuaaccuccugaaucuggacaacaauagagucacagaggauuuugaacucgaggccgacgaaaucggcaaauuccuggacuucaacgggaauaaggugaaagauaacaaggagcuuaaaaaguuugacaccaauaaaauuuacuucgauggagagaacaucauuaagcaccgcgcuuuuuauaauaucaagaaauacggcaugcugaaccuccuggaaaagaucgccgacaaagccggcuacaagauuuccaucgaggaacugaaaaaguauucuaauaagaaaaacgagauugaaaagaaucacaaaaugcaagagaaccuucaucggaaguacgcuagaccucggaaagaugagaaguucacagacgaagauuaugagagcuacaagcaggccaucgaaaacauugaggaauauacccaccucaaaaauaaggucgaguuuaacgagcugaaucugcuccaggggcugcuucugcgcauccuccauagacuggugggauacacguccaucugggaacgggaccugagauuccgccuuaaaggcgaguuuccggaaaaccaguauauugaggaaaucuucaauuuugagaacaagaaaaauguuaaguacaaagggggacaaauuguggagaaguacaucaaguucuauaaagaacugcaccagaacgaugaggucaagauuaauaaauacagcucugcgaacaucaaggugcucaaacaggaaaagaaggaccuguauauucggaauuacaucgcucacuuuaacuauaucccccaugccgagauuucccuccuggagguucuugaaaaucugagaaaacuccugagcuacgaucgcaagcugaaaaacgccgugaugaagucugucguggacauccuuaaagaguauggcuucguggcuacauucaagauuggggccgauaagaaaaucggcauucagacccuggaauccgagaagaucguucaccucaaaaaucugaagaaaaagaagcucaugaccgacagaaacagcgaggaacugugcaaacuugucaagaucauguuugaguacaaaauggaagagaagaaaucugaaaacuga

SEQ ID NO: 11373 - RNA, 3480 nt, Artificial Sequence
  Cas13a variant__Leptotrichia buccalis__WP_015770004.1__Cas13a(K310A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaggaacucaaugacaagaacauuaaauacgccuuuugccacuucguggaaaucgagaugucccagcugcuuaagaauuaugucuacgcucggcugagcaacaucuccaaugauaaaauuaagcgcaucuuugaguaucaaaaccucaagaaacugauugaaaacaagcugcugaauaaacucgacacauacguuagaaacugugggaaguauaauuacuaucugcaggauggagagaucgccaccucugacuucauugcgcggaaccgccagaaugaagccuuucugagaaacaucaucggcgugagcuccguggcuuacuucagccuccggaauauucuggagacggaaaacgagaaugauaucaccggcagaaugcgcgggaaaacagucaagaacaauaagggagaggaaaaauacgugucuggcgagguugacaagauuuauaacgaaaauaaaaagaacgaggugaaagaaaaucuuaagauguucuacuccuaugauuuuaacauggacaacaagaaugagaucgaggauuucuuugccaacauugacgaagcuaucagcucuauucggcaugggaucguccacuucaaucuggagcucgaaggaaaagauaucuuugccuucaagaacauugcgccgagcgagaucuccaaaaagauguuucagaaugaaauuaacgagaaaaagcugaaacuuaaaaucuucagacaacuuaauucugccaacguguuucgcuaccucgagaaguauaaaauucugaauuaccugaagcggaccagauucgaauuuguuaacaaaaauauccccuucgugccuagcuuuacaaagcucuauucccgcaucgacgaccugaaaaacagccuuggcauuuacuggaagacccccaagacgaaugaugacaacaaaacaaaggagaucauugaugcucagaucuaccugcucaaaaauauuuauuacggggaguuccugaacuauuucaugucuaacaauggaaacuuuuucgaaaucuccaaggagaucauugaacugaauaaaaacgacaagcggaaucuuaagaccggcuuuuacaaacuccagaaguucgaggauauccaggaaaagauuccuaaggaguaucuggccaacauccaaagccuguacaugauuaaugcuggcaaccaggacgaagaggagaaagauacauauaucgacuuuauccagaagauuuuccucaagggguuuaugaccuaccuggccaauaacggaagacuuucucugaucuacauuggcuccgaugaagagaccaauacaagccucgccgaaaagaagcaagaguucgacaaauuucugaagaaauaugaacagaacaauaacaucaagauucccuacgagaucaaugaguuccugcgcgaaauuaaacuugggaacauccucaaauauacggagcggcugaauauguuuuaccugauccucaagcugcuuaaccauaaagaacugaccaaccucaagggaucccuggagaaauaucagucugcuaauaaggaagaggcguucagcgaucagcuggagcuuauuaaccuccugaaucuggacaacaauagagucacagaagauuuugagcucgaagccgacgagaucggcaaguuccuggacuucaacgggaauaaagugaaggauaacaaagagcuuaagaaauuugacaccaauaagauuuacuucgauggagaaaacaucauuaaacaccgcgcuuuuuauaauaucaagaaguacggcaugcugaaccuccuggagaaaaucgccgacaaggccggcuacaaaauuuccaucgaggaacugaagaaauauucuaauaagaagaacgaaauugagaaaaaucacaagaugcaagagaaccuucaucggaaauacgcuagaccucggaaggaugaaaaauucacagacgaggauuaugaaagcuacaagcaggccaucgagaacauugaagaguauacccaccucaagaauaaagucgaguuuaacgaacugaaucugcuccaggggcugcuucugcgcauccuccauagacuggugggauacacguccaucugggagcgggaccugagauuccgccuuaagggcgaauuuccggagaaccaguauauugaagagaucuucaauuuugagaacaaaaagaauguuaaauacaaagggggacaaauuguggaaaaguacaucaaauucuauaaggagcugcaccagaacgaugaagucaaaauuaauaaguacagcucugcgaacaucaaagugcucaagcaggagaaaaaggaccuguauauucggaauuacaucgcucacuuuaacuauaucccccaugccgagauuucccuccuggaaguucuugagaaucugagaaagcuccugagcuacgaucgcaaacugaagaacgccgugaugaaaucugucguggacauccuuaaggaauauggcuucguggcuacauucaaaauuggggccgauaagaagaucggcauucagacccuggaguccgaaaagaucguucaccucaagaaucugaaaaagaaaaagcucaugaccgacagaaacagcgaggagcugugcaaacuugucaaaaucauguuugaauacaagauggaggaaaagaagucugagaacuga

SEQ ID NO: 11374 - RNA, 3480 nt, Artificial Sequence
  Cas13a variant__Leptotrichia buccalis__WP_015770004.1__Cas13a(N314A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcgcuaucuccaacgauaagauuaagcgcaucuuugaguaucaaaaucucaaaaagcugauugaaaacaaacuucugaacaagcucgacacauacguuagaaauugugggaaauauaacuacuaucugcaggauggagagaucgccaccucugacuucauugcgcggaaucgccagaacgaagccuuucugagaaauaucaucggcgugagcuccguggcuuacuucagccuccggaacauucuggagacggaaaaugagaacgauaucaccggcagaaugcgcgggaagacagucaagaauaacaaaggagaggaaaaguacgugucuggcgagguugacaaaauuuauaaugaaaacaagaaaaaugaggugaaggaaaaccuuaagauguucuacuccuaugauuuuaauauggacaacaaaaacgagaucgaggauuucuuugccaauauugacgaagcuaucagcucuauucggcaugggaucguccacuucaaccuggagcucgaaggaaaggauaucuuugccuucaaaaauauugcgccgagcgagaucuccaagaaaauguuucagaacgaaauuaaugagaagaagcugaaacuuaagaucuucagacaacugaacucugccaauguguuucgcuaccucgagaaauauaagauucugaacuaccugaaacggaccagauucgaauuuguuaauaagaacauccccuucgugccuagcuuuacaaaacucuauucccgcaucgacgaccugaagaauagccuuggcauuuacuggaagacccccaaaacgaacgaugacaauaagacaaaagagaucauugaugcucagaucuaccugcucaagaacauuuauuacggggaauuucugaauuauuucaugucuaacaacggaaauuucuucgagaucuccaaagagaucauugaacugaacaagaaugacaagcggaaccuuaaaaccggcuuuuacaagcuccagaaauucgaggauauccaggaaaagauuccuaaagaguaucuggccaauauccaaagccuguacaugauuaacgcuggcaaucaggacgaagaggagaaggauacauauaucgacuuuauccagaagauuuuccucaaaggguuuaugaccuaccuggccaacaauggaagacuuucucugaucuacauuggcuccgaugaagagaccaacacaagccucgccgaaaagaaacaagaguucgacaaguuucugaaaaaguaugaacagaauaacaauaucaagauucccuacgagaucaacgaguuccugcgcgaaauuaaacuugggaauauccucaaguauacggagcggcugaacauguuuuaccugauccucaaacugcuuaaucauaaggaacugaccaaccucaaaggaucccuggagaaguaucagucugcuaacaaggaagaggcguucagcgaucagcuggagcuuauuaaucuccugaaccuggacaauaacagagucacagaagauuuugagcucgaagccgacgagaucggcaaauuccuggacuucaaugggaacaaggugaaagauaauaaggagcuuaaaaaguuugacaccaacaaaauuuacuucgauggagaaaauaucauuaagcaccgcgcuuuuuauaacaucaagaaauacggcaugcugaaucuccuggagaagaucgccgacaaagccggcuacaagauuuccaucgaggagcugaaaaaguauucuaacaagaaaaaugaaauugagaagaaccacaaaaugcaagagaaucuucaucggaaguacgcuagaccucggaaagaugaaaaguucacagacgaggauuaugaaagcuacaagcaggccaucgagaacauugaagaguauacccaccucaaaaacaaggucgaguuuaaugaacugaaccugcuccaggggcugcuucugcgcauccuccauagacuggugggauacacguccaucugggagcgggaccugagauuccgccuuaaaggcgaauuuccggagaaucaguauauugaagagaucuucaacuuugagaauaagaaaaacguuaaguacaaagggggacaaauuguggaaaaguacaucaaguucuauaaagagcugcaccagaaugaugaagucaagauuaacaaauacagcucugcgaauaucaaggugcucaaacaggagaagaaggaccuguauauucggaacuacaucgcucacuuuaauuauaucccccaugccgagauuucccuccuggaaguucuugagaaccugagaaaacuccugagcuacgaucgcaagcugaaaaaugccgugaugaagucugucguggacauccuuaaagaauauggcuucguggcuacauucaagauuggggccgauaagaaaaucggcauucagacccuggaguccgaaaagaucguucaccucaaaaaccugaagaaaaagaagcucaugaccgacagaaauagcgaggagcugugcaaacuugucaagaucauguuugaauacaaaauggaggaaaagaaaucugagaacuga

SEQ ID NO: 11375 - RNA, 3480 nt, Artificial Sequence
  Cas13a variant__Leptotrichia buccalis__WP_015770004.1__Cas13a(R1072A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaguacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucuggccaaacuccugagcuacgauagaaagcugaaaaacgccgugaugaagucugucguggacauccuuaaagaauauggcuucguggcuacauucaagauuggggccgauaagaaaaucggcauucagacccuggaguccgaaaagaucguucaccucaaaaaucugaagaaaaagaagcucaugaccgaccgcaacagcgaggagcugugcaaacuugucaagaucauguuugaauacaaaauggaggaaaagaaaucugagaacuga

SEQ ID NO: 11376 - RNA, 3480 nt, Artificial Sequence
  Cas13a variant__Leptotrichia buccalis__WP_015770004.1__Cas13a(D1078A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaguacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgcccgcaagcugaaaaacgccgugaugaagucugucguggauauccuuaaagaauauggcuucguggcuacauucaagauuggggccgacaagaaaaucggcauucagacccuggaguccgaaaagaucguucaccucaaaaaucugaagaaaaagaagcucaugaccgauagaaacagcgaggagcugugcaaacuugucaagaucauguuugaauacaaaauggaggaaaagaaaucugagaacuga

SEQ ID NO: 11377 - RNA, 3480 nt, Artificial Sequence
  Cas13a variant__Leptotrichia buccalis__WP_015770004.1__Cas13a(R1079A,K1080A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaauacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaugccgcccugaagaacgcugugaugaaaucugucguggacauccuuaaggaauauggcuucguggccacauucaaaauuggggcugauaagaagaucggcauucagacccuggaguccgaaaagaucguucaccucaagaaucugaaaaagaaaaagcucaugaccgaccgcaacagcgaggagcugugcaaacuugucaaaaucauguuugaauacaagauggaggaaaagaagucugagaacuga

SEQ ID NO: 11378 - RNA, 3480 nt, Artificial Sequence
  Cas13a variant__Leptotrichia buccalis__WP_015770004.1__Cas13a(K1080A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaauacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaucgcgcccugaagaacgccgugaugaaaucugucguggacauccuuaaggaauauggcuucguggcuacauucaaaauuggggccgauaagaagaucggcauucagacccuggaguccgaaaagaucguucaccucaagaaucugaaaaagaaaaagcucaugaccgacagaaacagcgaggagcugugcaaacuugucaaaaucauguuugaauacaagauggaggaaaagaagucugagaacuga

SEQ ID NO: 11379 - RNA, 3480 nt, Artificial Sequence
  Cas13a variant__Leptotrichia buccalis__WP_015770004.1__Cas13a(K1082A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaauacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaucgcaagcuggccaacgccgugaugaaaucugucguggacauccuuaaggaauauggcuucguggcuacauucaaaauuggggccgauaagaagaucggcauucagacccuggaguccgaaaagaucguucaccucaagaaucugaaaaagaaaaagcucaugaccgacagaaacagcgaggagcugugcaaacuugucaaaaucauguuugaauacaagauggaggaaaagaagucugagaacuga

SEQ ID NO: 11380 - RNA, 3480 nt, Artificial Sequence
  Cas13a variant__Leptotrichia buccalis__WP_015770004.1__Cas13a(K1087A)
augaaggugaccaaagucggcgggaucagccacaagaaauacacauccgagggaagacugguuaagucugaaagcgaggaaaaccggacggacgagcgccucuccgcccugcuuaauaugagacuggauauguauauuaaaaaccccucuagcaccgaaacaaaggagaaucagaagcggaucggcaaacucaagaaauucuuuuccaacaagaugguguaccugaaagacaauacccuuucucugaagaacgggaagaaagagaauauugaucgcgaauauagcgagacagacauccucgaauccgaugugagagacaagaaaaacuucgcuguccugaagaaaauuuaccugaaugagaacgugaauagcgaggaacucgagguuuuucggaacgauaucaagaaaaagcugaauaagaucaacucucuuaaauauuccuucgaaaagaauaaagccaacuaccaaaagauuaacgagaauaacaucgaaaaaguggagggaaagagcaagcgcaauauuaucuaugacuacuacagagagucugcgaaacgggaugcuuaugucuccaacgugaaggaagccuuugacaaacuguacaaggaggaagauauugccaaacucguucuggagaucgaaaaucuuaccaagcuggagaaguauaaaauucgcgaguucuaccaugaaaucaucggcagaaagaacgacaaagagaauuuugcuaagauuaucuaugaagagauucagaacgugaauaacaugaaagaacucaucgagaaggucccugauaugagcgagcugaagaaaucucagguguucuacaaguauuaccuggacaaagaagaacucaaugacaagaacauuaaauacgccuuuugccacuucguggaaaucgagaugucccagcugcuuaagaauuaugucuacaaacggcugagcaacaucuccaaugauaagauuaagcgcaucuuugaguaucaaaaccucaaaaagcugauugaaaacaaacuucugaauaagcucgacacauacguuagaaacugugggaaauauaauuacuaucugcaggauggagagaucgcuaccucugacuucauugcccggaaccgccagaaugaagcguuucugagaaacaucaucggcgugagcuccguggccuacuucagccuccggaauauucuggagacggaaaacgagaaugauaucaccggcagaaugcgcgggaagacagucaagaacaauaaaggagaggaaaaguacgugucuggcgagguugacaaaauuuauaacgaaaauaagaaaaacgaggugaaggaaaaucuuaagauguucuacuccuaugauuuuaacauggacaacaaaaaugagaucgaggauuucuuugcuaacauugacgaagccaucagcucuauucggcaugggaucguccacuucaaucuggagcucgaaggaaaggauaucuuugcuuucaaaaacauugccccgagcgagaucuccaagaaaauguuucagaaugaaauuaacgagaagaagcugaaacuuaagaucuucagacaacucaauucugcgaacguguuucgcuaccuggagaaauauaagauucugaauuaccugaaacggaccagauucgaauuuguuaacaagaauauccccuucgugccuagcuuuacaaaacucuauucccgcaucgacgaccugaagaacagccuuggcauuuacuggaagacccccaaaacgaaugaugacaacaagacaaaagagaucauugaugcccagaucuaccugcucaagaauauuuauuacggggaguuccugaacuauuucaugucuaacaauggaaacuuuuucgagaucuccaaagagaucauugaacugaauaagaacgacaagcggaaucuuaaaaccggcuuuuacaagcuccagaaauucgaggauauccaggaaaagauuccuaaagaguaucuggcuaacauccaaagccuguacaugauuaaugccggcaaccaggacgaagaggagaaggauacauauaucgacuuuauccagaagauuuuccucaaaggguuuaugaccuaccuggcuaauaacggaagacuuucucugaucuacauuggcuccgaugaagagaccaauacaagccucgccgaaaagaaacaagaguucgacaaguuucugaaaaaguaugaacagaacaauaacaucaagauucccuacgagaucaaugaguuccugcgcgaaauuaaacuugggaacauccucaaguauacggagcggcugaauauguuuuaccugauccucaaacugcuuaaccauaaggaacugaccaaccucaaaggaucccuggagaaguaucagucugccaauaaggaagaggcuuucagcgaucagcuggagcuuauuaaccuccugaaucuggacaacaauagagucacagaagauuuugagcucgaagcggacgagaucggcaaauuccuggacuucaacgggaauaaggugaaagauaacaaggagcuuaaaaaguuugacaccaauaaaauuuacuucgauggagaaaacaucauuaagcaccgcgccuuuuauaauaucaagaaauacggcaugcugaaccuccuggagaagaucgcugacaaagccggcuacaagauuuccaucgaggaacugaaaaaguauucuaauaagaaaaacgaaauugagaagaaucacaaaaugcaagagaaccuucaucggaaguacgccagaccucggaaagaugaaaaguucacagacgaggauuaugaaagcuacaagcaggcuaucgagaacauugaagaguauacccaccucaaaaauaaggucgaguuuaacgaacugaaucugcuccaggggcugcuucugcgcauccuccauagacuggugggauacacguccaucugggagcgggaccugagauuccgccuuaaaggcgaauuuccggagaaccaguauauugaagagaucuucaauuuugagaacaagaaaaauguuaaguacaaagggggacaaauuguggaaaaauacaucaaguucuauaaagagcugcaccagaacgaugaagucaagauuaauaaauacagcucugccaacaucaaggugcucaaacaggagaagaaggaccuguauauucggaauuacaucgcgcacuuuaacuauaucccccaugcugagauuucccuccuggaaguucuugagaaucugagaaaacuccugagcuacgaucgcaagcugaaaaacgccgugauggccucugucguggacauccuuaaggaauauggcuucguggcuacauucaaaauuggggccgauaagaagaucggcauucagacccuggaguccgaaaagaucguucaccucaagaaucugaaaaagaaaaagcucaugaccgacagaaacagcgaggagcugugcaaacuugucaaaaucauguuugaauacaagauggaggaaaagaagucugagaacuga

SEQ ID NO: 11381 - RNA, 4170 nt, Artificial Sequence
  Cas13a variant__Leptotrichia shahii__WP_018451595.1__Cas13a
augggcaaccuguucgggcacaagagaugguacgaggugcgggacaaaaaggauuuuaaaaucaagcgcaaagucaagguuaagagaaauuaugacggaaacaaauacauucucaauaucaacgaaaauaacaauaaggagaaaauugauaacaauaaguucauccggaaauauauuaacuacaagaagaaugacaacauccugaaagaauuuacccgcaaguuccaugccggcaauauccuuuuuaaacugaaggggaaagagggaauuaucagaauugaaaacaaugaugacuuccucgagacagaggaaguggugcuguauaucgaggcuuacggcaagagcgaaaaacuuaaggcccuggggauuacgaagaaaaagaucauugaugaggcgauccggcagggaaucaccaaagacgauaagaaaauugagaucaagcgccaagaaaacgaggaagagauugaaaucgacauuagagaugaguauacaaacaagacccucaaugacugcuccaucauccugcggauuaucgagaacgaugaacuggagaccaaaaagucuauuuacgaaaucuuuaaaaauauuaacaugagccucuacaagaucaucgagaaaauuaucgaaaaugagacagagaaggucuucgaaaaccgcuauuacgaggaacaccugagagagaaacuucugaaagacgacaagauugaugugauccucacaaauuuuauggaaauucgggagaaaaucaaguccaaccuggagauucuuggcuucguuaaauuuuaucugaaugugggcggggacaagaagaaaucuaagaacaaaaagaugcucgucgagaaaauccugaauaucaacguggaucugaccguugaagacauugcugauuucgugaucaaggaacucgaguuuuggaauauuacgaaacgcaucgagaaggucaagaaagugaacaaugaguuccuggaaaagagacggaaccgcaccuacauuaaaagcuaugugcuucuggacaagcaugaaaaauucaagaucgagagagaaaacaagaaagauaagaucgucaaauuuuucguugagaauauuaagaacaauuccaucaaagagaagauugaaaagauccucgccgaguuuaaaauugacgaacugaucaagaaacuugagaaggaacugaaaaagggaaacugugauacagagaucuucggcauuuuuaagaaacacuacaaggugaauuucgacucuaaaaaguuuagcaaaaaguccgaugaggaaaaagagcucuauaagaucauuuaccgguaccugaaggggagaaucgagaaaauucuggugaacgaacagaagguccgccucaaaaagauggagaaaaucgaaaucgagaagauucugaaugaaagcauccuuucugagaagauucugaaacgggugaagcaguauacccucgaacauaucauguaccugggaaaacuuagacacaacgacauugacaugacaaccguuaauacggaugacuucucccgccugcacgccaaggaggagcucgaucuggaacugaucacauuuuucgcuagcaccaacauggagcucaauaaaaucuuuucucgggaaaacauuaauaacgacgagaauaucgauuucuuuggcggggacagagaaaagaacuaugugcuggauaagaaaauucuuaacuccaagaucaaaauuauccgcgaccuggauuucauugacaauaagaacaauaucacaaacaauuucauccggaaauuuaccaagauuggaaccaacgagagaaaucgcauccuccaugccauuagcaaggagcgggaucugcagggcacacaagacgauuacaacaaagucaucaauauuauccagaaccugaagaucucugacgaagagguguccaaagcucuuaaucucgacguuguguucaaggauaaaaagaacauuaucacgaagauuaaugacaucaaaauuagcgaagagaacaauaacgauaucaaguaucugcccuccuuuucuaaaguccugccugaaauucucaaccuguacagaaauaacccgaagaaugagcccuucgacaccaucgagacagagaaaaucgugcuuaacgcccugauuuaugucaauaaggaacucuacaaaaagcugauccuggaagaugaccuugaggaaaacgagagcaagaauauuuuucuccaggagcugaaaaagacccugggcaacaucgaugaaauugacgagaauaucaucgaaaacuacuauaaaaaugcgcagauuuccgccagcaaggggaacaauaaagcuaucaagaaguaccagaaaaaggugauugagugcuauaucggauaccuccgcaaaaacuaugaggaacuguucgauuuuucugacuucaagaugaauauucaagagaucaaaaagcagaucaaggauauuaacgacaauaaaacauacgaacggaucaccguuaagacguccgauaaaacaauugugaucaacgacgacuuugaguauauuaucagcauuuucgcccuucugaacucuaaugcugucaucaacaagaucagaaaucgguuuuucgccaccagcguguggcucaacaccuccgaauaccagaauauuaucgauauucuggacgagaucaugcaacugaacacacuucgcaaugaguguauuaccgaaaacuggaaucucaaccuggaggaauuuauccagaaaaugaaggagaucgaaaaggauuucgacgauuucaaaauucagacaaagaaagagaucuuuaauaacuacuaugaggacauuaagaauaacauccugacggaguucaaagaugacauuaauggcugcgauguucucgaaaagaaacuggaaaagaucgugaucuuugacgaugagaccaaguucgaaauugacaaaaagucuaacauccuucaagacgagcagagaaaacugagcaacauuaauaagaaagaucucaagaagaaagucgaccaguacaucaaggauaaagaccaggagauuaaguccaaaauccugugucggauuaucuuuaacagcgauuuccugaagaaguauaaaaaggaaaucgacaaucuuauugaggauauggaaucugagaacgagaauaaauuucaagaaaucuacuauccuaaggagagaaagaacgaacucuacauuuauaagaagaaucuguuccugaacaucgggaaucccaacuuugacaaaauuuacggacucaucuccaaugauaucaagauggcggacgccaaauuccuguuuaacauugauggcaagaauauccgcaaaaacaagauuagcgagaucgacgcuauucuuaaaaaucugaacgauaagcucaacggguacucuaaggaauauaaagagaaguacaucaaaaagcugaaagagaaugacgacuucuucgccaagaacauccagaauaagaacuauaaauccuuugaaaaggauuacaaucgggugagcgaguauaaaaagauuagagaccugguggaguucaacuaccuuaauaaaaucgaauccuaucugauugauaucaacuggaagcucgcuauucagauggcccgcuuugaaagagacaugcacuacaucguuaauggacugcgggagcucggcauuaucaagcugucuggcuacaacacagggaucagccgcgccuauccuaaaagaaauggauccgauggcuucuacaccacaaccgcuuauuacaaguuuuucgacgaggaaucuuauaaaaaguuugagaaaauuugcuacggguucggaaucgaucuuagcgaaaacuccgagauuaauaagcccgaaaacgagagcauccggaauuauauuucucauuuuuacaucguccgcaacccuuucgcggacuacuccaucgccgagcagauugauagagugagcaaccugcucucuuauuccacgcgguacaauaacagcaccuaugcuucuguguuugaagucuucaagaaagacgugaaucuggauuacgacgagcugaagaaaaaguuuaaacuuaucggcaacaaugauauucuggaacgccucaugaagccgaagaaaguuagcgugcuggagcucgaguccuauaacagcgacuacaucaagaaucugauuaucgaacuucugacaaaaaucgagaacaccaaugacacacucuga

SEQ ID NO: 11382 - RNA, 4170 nt, Artificial Sequence; identical to SEQ ID NO: 11381
  Cas13a variant__Leptotrichia shahii__WP_018451595.1__Cas13a

SEQ ID NO: 11383 - RNA, 4305 nt, Artificial Sequence
  Cas13a variant__Leptotrichia shahii__WP_018451595.1__Cas13a(long)
augggcaaccuguucgggcacaagagaugguacgaggugcgggacaaaaaggauuuuaaaaucaagcgcaaagucaagguuaagagaaauuaugacggaaacaaauacauucucaauaucaacgaaaauaacaauaaggagaaaauugauaacaauaaguucauccggaaauauauuaacuacaagaagaaugacaacauccugaaagaauuuacccgcaaguuccaugccggcaauauccuuuuuaaacugaaggggaaagagggaauuaucagaauugaaaacaaugaugacuuccucgagacagaggaaguggugcuguauaucgaggcuuacggcaagagcgaaaaacuuaaggcccuggggauuacgaagaaaaagaucauugaugaggcgauccggcagggaaucaccaaagacgauaagaaaauugagaucaagcgccaagaaaacgaggaagagauugaaaucgacauuagagaugaguauacaaacaagacccucaaugacugcuccaucauccugcggauuaucgagaacgaugaacuggagaccaaaaagucuauuuacgaaaucuuuaaaaauauuaacaugagccucuacaagaucaucgagaaaauuaucgaaaaugagacagagaaggucuucgaaaaccgcuauuacgaggaacaccugagagagaaacuucugaaagacgacaagauugaugugauccucacaaauuuuauggaaauucgggagaaaaucaaguccaaccuggagauucuuggcuucguuaaauuuuaucugaaugugggcggggacaagaagaaaucuaagaacaaaaagaugcucgucgagaaaauccugaauaucaacguggaucugaccguugaagacauugcugauuucgugaucaaggaacucgaguuuuggaauauuacgaaacgcaucgagaaggucaagaaagugaacaaugaguuccuggaaaagagacggaaccgcaccuacauuaaaagcuaugugcuucuggacaagcaugaaaaauucaagaucgagagagaaaacaagaaagauaagaucgucaaauuuuucguugagaauauuaagaacaauuccaucaaagagaagauugaaaagauccucgccgaguuuaaaauugacgaacugaucaagaaacuugagaaggaacugaaaaagggaaacugugauacagagaucuucggcauuuuuaagaaacacuacaaggugaauuucgacucuaaaaaguuuagcaaaaaguccgaugaggaaaaagagcucuauaagaucauuuaccgguaccugaaggggagaaucgagaaaauucuggugaacgaacagaagguccgccucaaaaagauggagaaaaucgaaaucgagaagauucugaaugaaagcauccuuucugagaagauucugaaacgggugaagcaguauacccucgaacauaucauguaccugggaaaacuuagacacaacgacauugacaugacaaccguuaauacggaugacuucucccgccugcacgccaaggaggagcucgaucuggaacugaucacauuuuucgcuagcaccaacauggagcucaauaaaaucuuuucucgggaaaacauuaauaacgacgagaauaucgauuucuuuggcggggacagagaaaagaacuaugugcuggauaagaaaauucuuaacuccaagaucaaaauuauccgcgaccuggauuucauugacaauaagaacaauaucacaaacaauuucauccggaaauuuaccaagauuggaaccaacgagagaaaucgcauccuccaugccauuagcaaggagcgggaucugcagggcacacaagacgauuacaacaaagucaucaauauuauccagaaccugaagaucucugacgaagagguguccaaagcucuuaaucucgacguuguguucaaggauaaaaagaacauuaucacgaagauuaaugacaucaaaauuagcgaagagaacaauaacgauaucaaguaucugcccuccuuuucuaaaguccugccugaaauucucaaccuguacagaaauaacccgaagaaugagcccuucgacaccaucgagacagagaaaaucgugcuuaacgcccugauuuaugucaauaaggaacucuacaaaaagcugauccuggaagaugaccuugaggaaaacgagagcaagaauauuuuucuccaggagcugaaaaagacccugggcaacaucgaugaaauugacgagaauaucaucgaaaacuacuauaaaaaugcgcagauuuccgccagcaaggggaacaauaaagcuaucaagaaguaccagaaaaaggugauugagugcuauaucggauaccuccgcaaaaacuaugaggaacuguucgauuuuucugacuucaagaugaauauucaagagaucaaaaagcagaucaaggauauuaacgacaauaaaacauacgaacggaucaccguuaagacguccgauaaaacaauugugaucaacgacgacuuugaguauauuaucagcauuuucgcccuucugaacucuaaugcugucaucaacaagaucagaaaucgguuuuucgccaccagcguguggcucaacaccuccgaauaccagaauauuaucgauauucuggacgagaucaugcaacugaacacacuucgcaaugaguguauuaccgaaaacuggaaucucaaccuggaggaauuuauccagaaaaugaaggagaucgaaaaggauuucgacgauuucaaaauucagacaaagaaagagaucuuuaauaacuacuaugaggacauuaagaauaacauccugacggaguucaaagaugacauuaauggcugcgauguucucgaaaagaaacuggaaaagaucgugaucuuugacgaugagaccaaguucgaaauugacaaaaagucuaacauccuucaagacgagcagagaaaacugagcaacauuaauaagaaagaucucaagaagaaagucgaccaguacaucaaggauaaagaccaggagauuaaguccaaaauccugugucggauuaucuuuaacagcgauuuccugaagaaguauaaaaaggaaaucgacaaucuuauugaggauauggaaucugagaacgagaauaaauuucaagaaaucuacuauccuaaggagagaaagaacgaacucuacauuuauaagaagaaucuguuccugaacaucgggaaucccaacuuugacaaaauuuacggacucaucuccaaugauaucaagauggcggacgccaaauuccuguuuaacauugauggcaagaauauccgcaaaaacaagauuagcgagaucgacgcuauucuuaaaaaucugaacgauaagcucaacggguacucuaaggaauauaaagagaaguacaucaaaaagcugaaagagaaugacgacuucuucgccaagaacauccagaauaagaacuauaaauccuuugaaaaggauuacaaucgggugagcgaguauaaaaagauuagagaccugguggaguucaacuaccuuaauaaaaucgaauccuaucugauugauaucaacuggaagcucgcuauucagauggcccgcuuugaaagagacaugcacuacaucguuaauggacugcgggagcucggcauuaucaagcugucuggcuacaacacagggaucagccgcgccuauccuaaaagaaauggauccgauggcuucuacaccacaaccgcuuauuacaaguuuuucgacgaggaaucuuauaaaaaguuugagaaaauuugcuacggguucggaaucgaucuuagcgaaaacuccgagauuaauaagcccgaaaacgagagcauccggaauuauauuucucauuuuuacaucguccgcaacccuuucgcggacuacuccaucgccgagcagauugauagagugagcaaccugcucucuuauuccacgcgguacaauaacagcaccuaugcuucuguguuugaagucuucaagaaagacgugaaucuggauuacgacgagcugaagaaaaaguuuaaacuuaucggcaacaaugauauucuggaacgccucaugaagccgaagaaaguuagcgugcuggagcucgaguccuauaacagcgacuacaucaagaaucugauuaucgaacuucugacaaaaaucgagaacaccaaugacacacucaagagacccgccgccaccaaaaaggcugggcaagccaaaaagaagaaaggcucuuauccuuacgauguccccgacuacgcguauccuuacgaugugcccgacuaugcuuacccguaugauguuccugacuacgccuga

SEQ ID NO: 11384 - RNA, 4158 nt, Artificial Sequence
  Cas13a variant__Leptotrichia sp. oral__WP_021744063.1__Cas13a
augggcaaccuguucgggcacaagagaugguacgaggugcgggacaaaaaggauuuuaaaaucaagcgcaaagucaagguuaagagaaauuaugacggaaacaaauacauucucaauaucaacgaaaauaacaauaaggagaaaauugauaacaauaaguucaucggcgaauuugugaacuauaaaaagaauaacaaugugcugaaggaguucaaacggaaguuucaugccgggaacauucuuuucaaacugaagggaaaagaagagaucauccgcauugagaauaacgacgauuuucucgaaaccgaggaagucgugcuguacaucgagguuuauggcaagagcgagaaacuuaaggcucuggaaauuacaaagaaaaagaucauugacgaggccaucagacaggggauuacgaaagaugacaagaaaaucgaaaucaagcggcaagagaacgaagaggagauugaaaucgauauucgcgacgaguacaccaauaagacacucaacgauugcuccaucauucugagaaucaucgaaaaugacgagcuggaaaccaaaaagucuauuuaugagaucuucaaaaacauuaauaugagccucuacaagaucauugagaaaaucaucgaaaacgagacagaaaagguguuugagaaucgguacuaugaggagcaucugcgcgagaaacuucugaaagauaacaagauugacgucauccucaccaauuucauggaaauuagagagaaaaucaaguccaaccuggaaauuaugggauuugugaaauucuaccuuaauguuucuggcgacaagaagaaaagcgagaacaagaaaauguuuguggagaagauccugaauacaaacgucgaucucaccguggaagacauuguggauuucaucgucaaagagcugaaguucuggaauaucacgaaacggauugaaaagguuaagaaauuuaacaacgaguuccuggaaaaucgcagaaaccggaccuauaucaaguccuacgugcuccuggacaaacacgagaaguuuaaaauugagcgcgaaaauaagaaggauaaaaucgugaaguucuuugucgagaacauuaaaaauaacucuaucaaggaaaagaucgagaagauucuugcggaauuuaagaucaaugagcugauuaaaaagcucgagaaagaacugaagaaaggcaacugugacacagagaucuuugggauuuucaagaagcacuauaaagugaauuuugauagcaagaaauucuccaacaagagcgacgaagagaaagaacuuuacaagaucaucuauagauaccugaaaggacggauugagaagauccucguuaaugagcagaaggugagacugaaaaagauggaaaagauugagaucgaaaagauucugaacgagucuauccucuccgagaaaauccugaagcgcgucaagcaguacacccuugaacauauuauguaucugggcaaacuccggcacaaugauaucgugaagaugacaguuaacaccgacgauuuuagcagacugcacgcuaaagaggaacuugaccuggagcucauuacguucuuugccucuacaaauauggaacugaacaagaucuucaacgggaaagagaaggugaccgacuucuuuggauucaaucugaacggccagaagauuacacucaaagagaagguccccuccuuuaaacugaauauccuuaagaaacugaacuucauuaauaacgaaaauaacaucgaugagaagcucagccauuuuuacucuuuccaaaaggaaggguaucugcugcgcaauaaaauccuucacaacuccuacggaaauauucaggagaccaagaaccucaaaggcgaauaugagaauguggagaagcugaucaaagaacugaaggucagcgacgaggaaauuuccaagucucucagccuggaugugaucuuugagggcaaaguugacauuaucaacaagaucaauucccuuaaaauuggggaauacaaggauaaaaaguaucugccuagcuucucuaaaaucgugcucgagauuacccggaaguuuagagagaucaacaaggacaaacuguucgauauugaauccgagaagaucauccugaacgccgucaaauacgugaauaagauucuuuacgagaaaaucacaagcaacgaagagaaugaauuucucaagacgcugccggacaagcugguuaaaaagucuaacaauaaaaaggagaacaaaaaucuccugagcauugaagaguauuacaagaacgcucagguguccucuagcaagggagauaaaaaggccaucaaaaaguaucagaauaaagucaccaacgcuuaccuugaauaucuggagaauacauucaccgagauuaucgacuuuuccaaguucaaccucaauuacgaugaaauuaagacaaaaaucgaggaacgcaaggacaacaaaagcaagaucauuaucgauucuauuuccaccaauaucaacauuacgaaugacaucgaguauaucauuagcaucuucgcccugcugaacucuaacacauacauuaauaaaauccggaacagauuuuucgcgaccuccguguggcuugaaaagcaaaauggcaccaaagaguacgacuaugagaacauuaucagcauccucgaugaagugcugcugauuaaucuccugcgcgagaacaauaucacagacauucuugaucugaagaacgccaucauugacgcuaagaucguugaaaaugaugagaccuacauuaaaaacuauaucuuugaauccaaugaggagaagcucaaaaagcggcuguucugcgaggaacuggucgacaaagaagauaucagaaagauuuuugaggacgagaacuucaaguuuaaaucuuucaucaagaaaaaugaaauugggaacuuuaagaucaauuucggaauccuuagcaaccucgaguguaacuccgaaguggaggccaaaaagauuaucggcaaaaauucuaaaaagcuggagagcuuuauucagaacaucauugaugaauacaaauccaauauccgcacacuguucagcucugaguuccucgaaaaguauaaagaggaaauugacaaccugguggaggauacggaauccgagaauaagaacaaguuugagaaaaucuacuaucccaaggaacauaaaaaugagcuuuacaucuacaagaaaaaccuguuccucaauauugggaacccuaauuuugacaagaucuauggacugauuagcaaagauaucaagaacgucgacaccaagauucuguucgacgaugacaucaaaaagaauaaaauuucugaaaucgaugcuauccuuaagaaccugaaugacaaacucaacggcuacuccaacgauuauaaggccaaguacgugaauaaacugaaggagaacgacgauuucuucgcgaaaaauauucagaacgaaaauuauagcucuuuuggcgaguucgagaaggacuacaacaaaguuagcgaauauaagaagauccgggaucucguggaguuuaauuaccugaacaaaauugaauccuaccuuaucgacauuaauuggaagcuggccauccagauggcuagauucgagcgggauaugcacuauaucgucaacgggcuccgcgagcugggaauuaucaaacugagcggcuacaauacagggauuucuagagccuaucccaagcggaacggauccgacggcuuuuacaccacaaccgcuuauuacaaauucuuugacgaagagagcuauaagaaguucgagaaaaucugcuacggguucggcauugaucuuuccgaaaauucugaaaucaacaagccugaaaaugagagcaucagaaacuacauuucccacuuuuauaucgugcgcaaccccuucgccgacuacucuauugccgaacaaaucgaucggguuagcaaucugcucuccuauucuacgagauacaacaauagcaccuaugcuuccguguuugaggucuucaaaaaggacgugaaccuggauuacgacgaacucaaaaagaaguuucgccugauuggaaauaacgauauccuugagagacugaugaaaccuaagaaaguuagcgugcucgaacuggagucuuauaauuccgacuacauuaagaaccugaucaucgagcuucugacaaaaauugaaaauaccaacgauacacucuga

SEQ ID NO: 11385 - RNA, 3459 nt, Artificial Sequence
  Cas13a variant__Leptotrichia wadei__WP_021746774.1__Cas13a
augaaggugaccaaagucgacggcaucagccacaagaaauacauugaggaagggaagcugguuaaauccacaucugaggaaaacagaacgagcgagcggcucuccgaacugcuuucuauccgccuggauauuuauaucaagaaucccgacaacgccagcgaggaggaaaaucggauuagacgcgagaaccucaagaaauucuuuuccaauaaggugcugcaucuuaaagauucugugcuguaccucaagaacagaaaagaaaagaaugcuguccaggacaagaacuauagcgaggaggauaucuccgaauacgaccugaaaaauaagaacagcuucucugugcugaaaaagauccuccugaaugaggauguuaacuccgaggaacuugaaauuuuucggaaagacguggaggccaagcugaauaaaaucaacagccucaaguauucuuucgaggaaaauaaggcgaacuaccaaaagauuaacgagaauaacgucgaaaaggugggaggcaaauccaagcgcaauaucauuuaugauuacuacagagagagcgcuaaacggaacgacuauaucaauaacguucaggaagccuuugauaagcuguacaagaaagaggacauugagaagcuguucuuucugaucgaaaauucuaaaaagcacgagaaauauaagauccgcgaauacuaucauaagauuaucgggagaaagaacgauaaggagaauuucgccaaaauuaucuacgaagagauucagaacgugaauaacaucaaggagcucaucgaaaagauuccugacauguccgagcugaaaaagagccaggucuuuuauaaauacuaccuggacaaggaggaacucaaugauaaaaacaucaaguaugcuuucugccacuuuguggagauugaaaugucccaacugcuuaaaaauuacguguauaagcggcugucuaacaucagcaacgacaaaauuaagcgcaucuucgaguaccagaaucucaagaaacugaucgaaaacaaacuucugaauaaacucgauaccuaugucagaaacuguggaaaguacaauuauuaccugcagguuggcgagauugccacauccgacuuuaucgcucggaaccgccagaaugaagccuuccugagaaacauuaucggggugagcucuguggcguacuucucccuccggaauauucuggagaccgagaacgaaaauggaaucacaggcagaaugcgcggcaaaaccgucaagaacaauaagggggaggaaaaauaugugagcggagagguugauaagauuuacaacgaaaauaaacaaaacgaggugaaggagaaccuuaaaauguuuuauucuuacgacuucaauauggauaacaagaaugaaaucgaggacuuuuucgccaacaucgaugaagcuauuagcuccauccggcauggcauuguccacuuuaaucuggagcucgaagggaaggacaucuucgccuuuaaaaacauugcuccgucugagaucagcaagaaaauguuccagaaugagaucaacgaaaagaaacugaaacuuaagauuuuuaaacagcuuaauuccgccaacguguucaauuauuacgagaaggauguuaucauuaaauaucucaagaacacaaaauuuaauuucgugaacaagaauauccccuuugucccuagcuucaccaaacuguacaacaagauugaagaccugagaaacacgcucaaguucuuuuggucugugcccaaagacaaggaggagaaagaugcgcagaucuaccugcuuaagaauaucuauuacggagaguuccugaacaaauuugucaaaaauuccaagguguucuuuaaaauuaccaacgaaguuaucaagauuaauaaacaacgcaaccagaagacaggccacuauaaauaccagaaguucgaaaauaucgagaagaccgugccugucgaauaucucgccauuauccaaagccgggagaugaucaacaaucaggacaaagaggaaaagaacacauacauugauuuuauccagcagauuuuccugaaaggguuuaucgacuaucugaauaagaacaaucuuaaauacauugagucuaacaauaacaaugauaacaacgacaucuucuccaagauuaagaucaaaaaggauaauaaagaaaaguacgacaaaauccucaagaacuaugagaagcauaauagaaacaaagaaauuccccacgagaucaaugaguuugugcgcgaaauuaagcugggaaaaauccugaaguacaccgagaaccucaauauguucuaucugauucuuaaacugcucaaccauaaggaacugacgaaucugaaaggcagccuugagaaguaccaauccgcuaacaaggaagagacauuuucugaugagcucgaacugaucaaucugcucaaccuggacaauaaccggguuaccgaggauuucgaacuugaggccaaugagaucggcaaauuccuggacuuuaacgaaaacaagauuaaagauagaaaggagcucaaaaaguucgacacaaauaagaucuauuuugacggggaaaacauuaucaaacaccgcgcuuucuacaauauuaagaaauauggaaugcugaaccugcuugagaagaucgccgauaaagccaaguacaagaucagccucaaagaacugaaggaguacuccaauaaaaagaacgagauugaaaagaauuauaccaugcagcagaaccugcaccggaaguacgcuagaccuaagaaagacgagaaguuuaaugaugaagacuauaaagaguacgaaaaggcgaucggcaacauucagaaauauacccaucucaagaauaaaguggaguucaacgagcugaaucuucugcaagggcuccugcugaagauccuucaccgccucgucggauacacaucuauuugggaacgggaucugagauuucggcugaagggcgaguucccggaaaaccauuauaucgaggaaauuuuuaauuucgacaacagcaaaaacgugaaguacaaauccgggcagaucguggagaaguacaucaauuuuuauaaagagcucuacaaggauaacguugaaaagcgcagcauuuauucugacaaaaaggucaaaaagcugaaacaggagaagaaggaucuuuacaucagaaauuauauugcccacuucaacuacaucccccaugcugaaauuucccugcucgaggugcuggagaaucugcggaaacuucugagcuaugacagaaagcucaaaaacgccaucaugaagucuaucguggauauucugaaagaauacggauucgucgccacguuuaagaucggcgcugacaagaaaauugagauccagacccucgaauccgagaagauugugcaccugaaaaaucuuaagaaaaagaaacugaugacagaucgcaacagcgaggaacucugcgagcugguuaaggugauguucgaauacaaggcccuggaguga

SEQ ID NO: 11386 - RNA, 3459 nt, Artificial Sequence
  Cas13a variant__Leptotrichia wadei__WP_021746774.1__Cas13a(G403D)
augaaggugaccaaagucgacggcaucagccacaagaaauacauugaggaagggaagcugguuaaauccacaucugaggaaaacagaacgagcgagcggcucuccgaacugcuuucuauccgccuggauauuuauaucaagaaucccgacaacgccagcgaggaggaaaaucggauuagacgcgagaaccucaagaaauucuuuuccaauaaggugcugcaucuuaaagauucugugcuguaccucaagaacagaaaagaaaagaaugcuguccaggacaagaacuauagcgaggaggauaucuccgaauacgaccugaaaaauaagaacagcuucucugugcugaaaaagauccuccugaaugaggauguuaacuccgaggaacuugaaauuuuucggaaagacguggaggccaagcugaauaaaaucaacagccucaaguauucuuucgaggaaaauaaggcgaacuaccaaaagauuaacgagaauaacgucgaaaaggugggaggcaaauccaagcgcaauaucauuuaugauuacuacagagagagcgcuaaacggaacgacuauaucaauaacguucaggaagccuuugauaagcuguacaagaaagaggacauugagaagcuguucuuucugaucgaaaauucuaaaaagcacgagaaauauaagauccgcgaauacuaucauaagauuaucgggagaaagaacgauaaggagaauuucgccaaaauuaucuacgaagagauucagaacgugaauaacaucaaggagcucaucgaaaagauuccugacauguccgagcugaaaaagagccaggucuuuuauaaauacuaccuggacaaggaggaacucaaugauaaaaacaucaaguaugcuuucugccacuuuguggagauugaaaugucccaacugcuuaaaaauuacguguauaagcggcugucuaacaucagcaacgacaaaauuaagcgcaucuucgaguaccagaaucucaagaaacugaucgaaaacaaacuucugaauaaacucgauaccuaugucagaaacuguggaaaguacaauuauuaccugcagguuggcgagauugccacauccgacuuuaucgcucggaaccgccagaaugaagccuuccugagaaacauuaucggggugagcucuguggcguacuucucccuccggaauauucuggagaccgagaacgaaaaugauaucacaggaagaaugcgcggcaaaaccgucaagaacaauaagggcgaggaaaaauaugugagcggggagguugacaagauuuacaacgaaaauaaacaaaacgaggugaaggagaaccuuaaaauguuuuauucuuacgauuucaauauggacaacaagaaugaaaucgaggacuuuuucgccaacaucgaugaagcuauuagcuccauccggcauggaauuguccacuuuaaucuggagcucgaaggcaaggauaucuucgccuuuaaaaacauugcuccgucugagaucagcaagaaaauguuccagaaugagaucaacgaaaagaaacugaaacuuaagauuuuuaaacagcuuaauuccgccaacguguucaauuauuacgagaaggacguuaucauuaaauaucucaagaacacaaaauuuaauuucgugaacaagaauauccccuuugucccuagcuucaccaaacuguacaacaagauugaagaccugagaaacacgcucaaguucuuuuggucugugcccaaagauaaggaggagaaagacgcgcagaucuaccugcuuaagaauaucuauuacggggaguuccugaacaaauuugucaaaaauuccaagguguucuuuaaaauuaccaacgaaguuaucaagauuaauaaacaacgcaaccagaagacaggacacuauaaauaccagaaguucgaaaauaucgagaagaccgugccugucgaauaucucgccauuauccaaagccgggagaugaucaacaaucaggauaaagaggaaaagaacacauacauugacuuuauccagcagauuuuccugaaaggcuuuaucgauuaucugaauaagaacaaucuuaaauacauugagucuaacaauaacaaugacaacaacgauaucuucuccaagauuaagaucaaaaaggacaauaaagaaaaguacgauaaaauccucaagaacuaugagaagcauaauagaaacaaagaaauuccccacgagaucaaugaguuugugcgcgaaauuaagcuggggaaaauccugaaguacaccgagaaccucaauauguucuaucugauucuuaaacugcucaaccauaaggaacugacgaaucugaaaggaagccuugagaaguaccaauccgcuaacaaggaagagacauuuucugacgagcucgaacugaucaaucugcucaaccuggauaauaaccggguuaccgaggacuucgaacuugaggccaaugagaucggcaaauuccuggauuuuaacgaaaacaagauuaaagacagaaaggagcucaaaaaguucgacacaaauaagaucuauuuugauggcgaaaacauuaucaaacaccgcgcuuucuacaauauuaagaaauaugggaugcugaaccugcuugagaagaucgccgacaaagccaaguacaagaucagccucaaagaacugaaggaguacuccaauaaaaagaacgagauugaaaagaauuauaccaugcagcagaaccugcaccggaaguacgcuagaccuaagaaagaugagaaguuuaaugacgaagauuauaaagaguacgaaaaggcgaucggaaacauucagaaauauacccaucucaagaauaaaguggaguucaacgagcugaaucuucugcaaggccuccugcugaagauccuucaccgccucgucggguacacaucuauuugggaacgggaccugagauuucggcugaagggagaguucccggaaaaccauuauaucgaggaaauuuuuaauuucgauaacagcaaaaacgugaaguacaaauccggccagaucguggagaaguacaucaauuuuuauaaagagcucuacaaggacaacguugaaaagcgcagcauuuauucugauaaaaaggucaaaaagcugaaacaggagaagaaggaccuuuacaucagaaauuauauugcccacuucaacuacaucccccaugcugaaauuucccugcucgaggugcuggagaaucugcggaaacuucugagcuaugauagaaagcucaaaaacgccaucaugaagucuaucguggacauucugaaagaauacggguucgucgccacguuuaagaucggagcugauaagaaaauugagauccagacccucgaauccgagaagauugugcaccugaaaaaucuuaagaaaaagaaacugaugacagaccgcaacagcgaggaacucugcgagcugguuaaggugauguucgaauacaaggcccuggaguga

SEQ ID NO: 11387 - RNA, 3909 nt, Artificial Sequence
  Cas13a variant__Leptotrichia wadei__WP_021746774.1__6xHis-Tag/Twin-Strep/SUMO_Cas13a(G403D)
augggcagcucccaccaucaccaucaccauucuagcgggcuggugcccagaggaucccacauggccucuuggagccacccucaguucgagaagggcgggggauccggcgggggaucuggcggcagcgcuuggucccauccgcaauuugaaaagaugagcgacucugaggucaaccaggaagccaagcccgagguuaaaccugaagugaagcccgagacccacaucaaucucaaaguguccgaugggagcucugagauuuucuuuaagaucaagaaaacaacgccucugcggcgccuuauggaagcguucgcuaagagacagggaaaagagauggacucccugcgguuucucuacgauggcauucgcauccaggccgaccaaacccccgaagaucuggacauggaggauaacgacauuaucgaggcccauagagaacagaucgggggaagcaugaaggucacaaaaguggauggcauuucucacaagaaguauaucgaggaagggaaacuuguuaaguccaccagcgaggaaaaucggacauccgagcgccugucugagcuccugagcauuagacuggacaucuacauuaaaaacccugauaaugcuuccgaagaggaaaaccggauccgcagagagaaucucaagaaauucuuuagcaacaaggugcugcaccuuaaagacucuguccuguaucucaagaaucggaaggaaaagaacgccgugcaggauaagaauuacuccgaggaggacauuagcgaauaugaccugaaaaacaaaaauucuuucagcguucuuaaaaagauccugcucaacgaggaugucaauuccgaggaacuggaaaucuuucgcaaggacguggaggcuaaacugaacaagauuaacucucucaaauacagcuucgaggaaaauaaggccaacuaucagaaaaucaaugagaacaauguggaaaaggugggaggcaaguccaaaagaaacauuaucuacgauuacuaucgggagagcgcgaagcgcaaugacuacauuaacaauguccaagaggccuuugauaaacuguauaagaaagaagacaucgagaaacuuuucuuucugaucgaaaacucuaagaaacaugagaaguacaaaauuagagaauauuaccacaagaucauuggccggaaaaaugauaaggagaacuucgcuaaaaucauuuaugaggaaauccagaauguuaacaauaucaaggagcucauugaaaagaucccggacauguccgagcugaaaaagagccagguguucuacaaauacuaucuugauaaggaggaacugaacgacaaaaacauuaaguacgccuuuugccauuucguggagaucgaaaugucucagcuccugaagaauuaugucuacaaaagacuguccaacauuagcaaugauaagaucaaacgcauuuuugaguaucaaaaccucaagaaacugaucgaaaauaaacuucugaacaagcucgacaccuacgugcggaauugugggaaguauaacuacuaccugcagguuggagagaucgcuacauccgacuucauugccagaaaucgccagaacgaagcguuucuucggaauaucauuggcgugucuagcgucgccuauuucucccugagaaacauccucgagaccgagaaugaaaacgauauuacggggcgcaugcggggaaagaccgugaaaaauaacaagggcgaggaaaaauacguuucuggggagguggacaagaucuauaacgagaauaagcaaaacgaagucaaagagaaucugaagauguuuuacagcuaugauuucaacauggacaauaaaaacgaaaucgaggacuuuuucgcuaauauugaugaagccaucuccagcauuagacacggaaucgugcauuuuaaccuggagcucgagggcaaggauauuuucgcuuuuaaaaauaucgcccccucugaaaucuccaagaaaauguuccagaacgagauuaaugaaaagaagcugaaacuuaagaucuucaaacagcugaacagcgccaaugucuuuaacuacuaugagaaggacgugauuaucaaauaccucaagaauacaaaguucaacuuuguuaacaaaaauauuccuuucgugcccucuuuuaccaagcuguacaacaaaaucgaagaucugcgcaauacacuuaaguucuuuugguccgucccuaaagacaaggaggagaaggaugcucagaucuaucuccugaaaaacauuuacuauggcgaguuccugaauaaguuugugaaaaacagcaagguuuucuuuaaaaucaccaaugaagugauuaagaucaacaagcaacggaaucagaaaacggggcacuacaaguaucagaaauucgaaaacauugagaagacaguccccguggaauaccucgcgaucauucagucuagagagaugaucaauaaccaagacaaagaggaaaagaauaccuauaucgauuuuauucagcagaucuuccugaagggauucauugacuaccuuaacaaaaauaaccugaaguacaucgagagcaauaacaacaaugacaacaaugauaucuuuuccaaaauuaagaucaaaaaggacaacaaagaaaaguaugauaagauucucaaaaauuacgagaagcacaaccgcaauaaagagaucccgcaugaaauuaacgaguucgugcgggaaaucaagcugggcaaaauucugaaguauacagagaaucuuaacauguuuuaccucauccugaagcugcucaaucacaaagaacugaccaaccuuaaggggagccuggagaaauaucagucugccaauaaggaggaaaccuucuccgacgagcucgaacugaucaaccugcuuaaucucgauaacaacagaguuacagaggacuuugaacuggaggcuaaugagauuggaaaauuccuggauuuuaacgaaaauaagaucaaggaccggaaagagcucaagaaauucgauacgaacaagauuuacuuugacggcgaaaauaucauuaaacaucgcgccuucuauaacaucaagaaguacgggaugcugaaucuucuggagaaaauugccgauaaggcuaaauacaagaucagccucaaagaacugaaggaguauuccaacaaaaagaaugagaucgaaaagaacuacaccaugcaacagaaucugcacagaaaauaugcccggccuaagaaagacgagaaguuuaacgaugaagacuacaaagaguaugagaaggcgauuggcaauauccagaaguacacacaccuuaaaaacaaggucgaguucaaugaacucaaccugcugcagggacuccugcuuaaaauucugcauagacucgugggcuauaccucuaucugggaacgcgaccugcgguucagacugaagggggaguuucccgaaaaccacuacauugaggagaucuucaauuuugauaacagcaaaaaugugaaguacaaguccggacaaaucgucgaaaaauauauuaacuucuacaaggagcuuuauaaagacaauguggaaaagcgcucuaucuacagcgauaaaaagguuaagaaacugaagcaggagaaaaaggaccucuauauuagaaacuacaucgcucauuuuaauuauauuccucacgccgaaaucucccugcucgaggugcuggagaaccuucggaaacugcucucuuacgaucgcaagcugaaaaaugccaucaugaaaagcauugucgacauccugaaggaauacggcuucguggcuacauuuaagauuggggccgauaagaaaaucgagauucagacccuugaauccgagaagaucguucaucugaaaaaccucaagaagaaaaagcugaugacggacagaaauagcgaggaacucugcgagcuggugaaagucauguucgaauauaaggcucuugaguga

SEQ ID NO: 11388 - RNA, 3459 nt, Artificial Sequence
  Cas13a variant__Leptotrichia wadei__WP_021746774.1__Cas13a(R474A,R1046A)
augaaggugaccaaagucgacggcaucagccacaagaaauacauugaggaagggaagcugguuaaauccacaucugaggaaaacagaacgagcgagcggcucuccgaacugcuuucuauccgccuggauauuuauaucaagaaucccgacaacgccagcgaggaggaaaaucggauuagacgcgagaaccucaagaaauucuuuuccaauaaggugcugcaucuuaaagauucugugcuguaccucaagaacagaaaagaaaagaaugcuguccaggacaagaacuauagcgaggaggauaucuccgaauacgaccugaaaaauaagaacagcuucucugugcugaaaaagauccuccugaaugaggauguuaacuccgaggaacuugaaauuuuucggaaagacguggaggccaagcugaauaaaaucaacagccucaaguauucuuucgaggaaaauaaggcgaacuaccaaaagauuaacgagaauaacgucgaaaaggugggaggcaaauccaagcgcaauaucauuuaugauuacuacagagagagcgcuaaacggaacgacuauaucaauaacguucaggaagccuuugauaagcuguacaagaaagaggacauugagaagcuguucuuucugaucgaaaauucuaaaaagcacgagaaauauaagauccgcgaauacuaucauaagauuaucgggagaaagaacgauaaggagaauuucgccaaaauuaucuacgaagagauucagaacgugaauaacaucaaggagcucaucgaaaagauuccugacauguccgagcugaaaaagagccaggucuuuuauaaauacuaccuggacaaggaggaacucaaugauaaaaacaucaaguaugcuuucugccacuuuguggagauugaaaugucccaacugcuuaaaaauuacguguauaagcggcugucuaacaucagcaacgacaaaauuaagcgcaucuucgaguaccagaaucucaagaaacugaucgaaaacaaacuucugaauaaacucgauaccuaugucagaaacuguggaaaguacaauuauuaccugcagguuggcgagauugccacauccgacuuuaucgcucggaaccgccagaaugaagccuuccugagaaacauuaucggggugagcucuguggcguacuucucccuccggaauauucuggagaccgagaacgaaaauggaaucacaggcagaaugcgcggcaaaaccgucaagaacaauaagggggaggaaaaauaugugagcggagagguugauaagauuuacaacgaaaauaaacaaaacgaggugaaggagaaccuuaaaauguuuuauucuuacgacuucaauauggauaacaagaaugaaaucgaggacuuuuucgccaacaucgaugaagcuauuagcuccaucgcccauggcauuguccacuuuaaucuggagcucgaagggaaggacaucuucgcuuuuaaaaacauugccccgucugagaucagcaagaaaauguuccagaaugagaucaacgaaaagaaacugaaacuuaagauuuuuaaacagcuuaauuccgcgaacguguucaauuauuacgagaaggauguuaucauuaaauaucucaagaacacaaaauuuaauuucgugaacaagaauauccccuuugucccuagcuucaccaaacuguacaacaagauugaagaccugcggaacacgcucaaguucuuuuggucugugcccaaagacaaggaggagaaagaugcccagaucuaccugcuuaagaauaucuauuacggagaguuccugaacaaauuugucaaaaauuccaagguguucuuuaaaauuaccaacgaaguuaucaagauuaauaaacaaagaaaccagaagacaggccacuauaaauaccagaaguucgaaaauaucgagaagaccgugccugucgaauaucucgcuauuauccaaagccgcgagaugaucaacaaucaggacaaagaggaaaagaacacauacauugauuuuauccagcagauuuuccugaaaggguuuaucgacuaucugaauaagaacaaucuuaaauacauugagucuaacaauaacaaugauaacaacgacaucuucuccaagauuaagaucaaaaaggauaauaaagaaaaguacgacaaaauccucaagaacuaugagaagcauaaucggaacaaagaaauuccccacgagaucaaugaguuugugagagaaauuaagcugggaaaaauccugaaguacaccgagaaccucaauauguucuaucugauucuuaaacugcucaaccauaaggaacugacgaaucugaaaggcagccuugagaaguaccaauccgccaacaaggaagagacauuuucugaugagcucgaacugaucaaucugcucaaccuggacaauaaccgcguuaccgaggauuucgaacuugaggcuaaugagaucggcaaauuccuggacuuuaacgaaaacaagauuaaagaucggaaggagcucaaaaaguucgacacaaauaagaucuauuuugacggggaaaacauuaucaaacacagagccuucuacaauauuaagaaauauggaaugcugaaccugcuugagaagaucgccgauaaagcuaaguacaagaucagccucaaagaacugaaggaguacuccaauaaaaagaacgagauugaaaagaauuauaccaugcagcagaaccugcaccgcaaguacgcgcggccuaagaaagacgagaaguuuaaugaugaagacuauaaagaguacgaaaaggccaucggcaacauucagaaauauacccaucucaagaauaaaguggaguucaacgagcugaaucuucugcaagggcuccugcugaagauccuucacagacucgucggauacacaucuauuugggaacgcgaucugcgguuuagacugaagggcgaguucccggaaaaccauuauaucgaggaaauuuuuaauuucgacaacagcaaaaacgugaaguacaaauccgggcagaucguggagaaguacaucaauuuuuauaaagagcucuacaaggauaacguugaaaagcggagcauuuauucugacaaaaaggucaaaaagcugaaacaggagaagaaggaucuuuacaucgcuaauuauauugcccacuucaacuacaucccccaugccgaaauuucccugcucgaggugcuggagaaucugcgcaaacuucugagcuaugacagaaagcucaaaaacgcuaucaugaagucuaucguggauauucugaaagaauacggauucgucgccacguuuaagaucggcgcggacaagaaaauugagauccagacccucgaauccgagaagauugugcaccugaaaaaucuuaagaaaaagaaacugaugacagaucggaacagcgaggaacucugcgagcugguuaaggugauguucgaauacaaggcucuggaguga

SEQ ID NO: 11389 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggggagggacugagagccagcccccggcgcagaccucuccugccgcuucagccccggggcugcccucgcggggacggaugucugagaggcgggcggggacgcgcuggcuucggcuuuuggagagugaccgggggaucccgggccucugcgaaccacguccaugcuuucuuuuucuuucuccaacugcuuggcaauguucuggugaucgugcucagccaccauuucgggaaggaauuuggaacagccggccccggggccacgaugaaagucaccaagguggauggaauuucccacaaaaaguacaucgaggaaggcaaacugguuaagucuacaagcgaggaaaaccgcaccuccgagagacugucugagcuccugagcauucggcuugacaucuauauuaagaauccugauaacgcuuccgaagaggaaaaucgcaucagacgggagaaccugaaaaaguucuuuagcaauaaagugcuccaucugaaggacucuguccuuuaccugaaaaaccgcaaggagaagaaugccgugcaggauaaaaacuauuccgaagaggacaucagcgaauacgaucucaagaauaaaaacucuuucuccguucugaagaaaauucugcucaaugaggacgugaacagcgaggaacuggagaucuuuagaaaggaugucgaagcuaaacuuaauaagauuaacucucugaaguauuccuucgaggaaaacaaagccaauuaccagaagaucaacgagaauaacguggaaaaagugggcggaaagagcaaacggaauauuaucuaugacuacuacagagaguccgcgaagcgcaacgauuauauuaauaacguccaggaggccuuugacaagcucuacaaaaaggaagauaucgagaaacuguucuuccuuaucgaaaauucuaagaaacacgagaaguauaagauucgggaauacuaucacaaaaucauugggagaaagaacgacaaagagaauuuugcuaagaucauuuacgaggaaauccaaaacguuaauaacaucaaagagcugauugaaaagauccccgacaugagcgagcucaagaaaucccagguguucuauaaguacuaccuggauaaagaggaacugaaugacaagaacauuaaauaugccuuuugccauuucguggagaucgaaaugagccagcuccugaagaacuacgucuauaaacgccuuucuaauauuuccaacgauaagaucaagcggaucuuugaguaccagaaucugaaaaagcucauugaaaacaaacugcuuaauaagcuggacacauaugugagaaacuguggcaaauacaauuauuaccuccaaguuggggagaucgcuaccagcgauuucauugcccgcaaccggcagaaugaggcguuucugagaaacaucauuggagugucuagcgucgccuacuucucccugcgcaauauccucgaaacagagaacgaaaauggcauuaccgggcggaugagaggaaagacggugaagaacaauaaaggcgaggaaaaguauguuucuggcgagguggacaaaaucuacaacgagaacaagcagaaugaagucaaagagaaccugaagauguuuuauagcuacgauuucaauauggacaacaagaaugaaaucgaggacuuuuucgcuaacauugaugaagccaucuccagcauugcucacgggaucgugcauuuuaaucuugagcuggagggaaaagauauuuucgccuucaagaacaucgccccuucugaaaucuccaaaaagauguuucagaaugagauuaacgaaaagaagcucaagcugaaaaucuucaagcaacugaauagcgcuaacgucuuuaauuauuacgagaaagacgugauuaucaaguaucuuaaaaacaccaaguucaauuuuguuaacaaaaacauuccguucgugcccucuuuuacaaagcucuacaauaagaucgaggaccugcgcaacacccugaaauucuuuugguccgucccuaaggauaaagaagagaaggacgcgcagaucuaccuccugaaaaauauuuauuacggcgaguuccuuaacaaguuugugaagaauagcaaaguuuucuuuaagaucacaaacgaagugauuaaaaucaauaagcagcggaaccagaaaaccgggcacuauaaguaccaaaaguucgaaaauauugagaaaacgguccccguggaguaucuggccaucauccaguccagagaaaugauuaacaaucaggauaaggaggagaaaaacacauacaucgacuucauucaacagaucuuucucaagggauucauugauuaucugaauaaaaacaaucugaaguacaucgaaucuaacaauaacaacgacaauaacgauauuuuuagcaagaucaaaaucaagaaagacaauaaggaaaaauacgauaagauucuuaagaacuaugagaaacacaaucggaacaaggagaucccucaugaaauuaaugaguucgugcgcgaaaucaaacucggcaagauucugaaauacaccgagaaccugaauauguuuuaucucauccugaaacuucugaaccacaaagaacucacaaaucugaaggggucccuggagaaguaccagucugcuaacaaagaggaaaccuucagcgacgagcuugaacucaucaaucugcugaaccucgauaauaacagaguuaccgaggacuuugagcuggaagccaacgagauuggcaaguuccuugauuuuaaugaaaacaaaaucaaggaccggaaagagcugaagaaguucgacacaaauaaaauuuauuuugauggagaaaacaucauuaagcauagagccuucuacaauaucaaaaaguauggcaugcucaaccugcuggagaaaaucgcugacaaggccaaguacaaaauuucccuuaaggagcucaaagaauacagcaauaagaaaaacgagaucgaaaagaauuauacgaugcagcaaaaccugcaccgcaaguacgcgcggcccaaaaaggaugagaaauucaaugacgaagauuauaaggaguacgagaaagcuauugggaacauccagaaguauacccaucugaaaaauaaggucgaauuuaacgagcucaaucugcuucagggacugcuccugaagauucugcacagacuugugggcuacacaucuaucugggaacgcgaccugagauuccggcucaaaggggaguuuccggaaaaccacuauauugaggagaucuucaacuuugauaauuccaagaacgugaaauacaagagcggacagaucgucgaaaaauacauuaauuucuauaaggagcuguacaaggacaacguggaaaaacgcucuaucuauuccgauaagaaaguuaagaaacucaagcaagagaagaaagaccuguacauugccaauuauaucgcccauuuuaacuacauuccucacgcugagaucagccuucuggaagugcucgagaaucugagaaagcugcuuucuuaugaucggaaacugaagaacgccaucaugaaaagcauugucgacauccucaaggaauacggcuucguggcuaccuuuaagauuggggccgauaaaaagaucgagauucagacacuggaauccgagaaaaucguucaucucaagaaucugaaaaagaaaaagcugaugaccgaccgcaacagcgaggaacuuugcgagcucgugaaggucauguucgaauacaaagcgcuggagggcggaggcgggucuggaggcgggggauccggcgggggcggaagcguguccaagggcgaggaacuguuuacggggguugugcccauccuugucgagcuggacggagaugugaauggccacaaauucucugugagcggggaaggagagggcgacgccacauaugggaagcucacccugaaauuuauuuguaccacaggcaagcucccuguccccuggcccacccugguuacaacgcuuaccuacggagugcagugcuucuccagauauccugaucacaugaagcagcaugacuucuuuaaaucugcuaugccggaaggcuacgugcaagagcggacaaucuucuuuaaggaugacgggaacuauaaaacccgcgccgaagucaaguucgagggagauacacuggugaauagaauugagcugaaaggcaucgacuuuaaggaagaugggaacauucucggacacaagcuggaguacaauuauaacagccauaacguuuacaucauggcugacaaacagaagaauggcauuaaagugaacuucaagauccggcacaauaucgaagauggcuccguccagcuugccgaccauuaccaacagaacacccccauuggggacggaccugugcugcuccccgauaaucacuaucugucuacgcagagcgcgcucuccaaagacccuaacgagaagcgcgaucacaugguucugcuugaguuugugaccgccgcuggcaucacacuggggauggacgaacuguacagcagaggagccggcgcuggggccggagccggcgcuggcucucgguuccaguguagaauuugcaugcgcaauuuuuccgaucggagcaaccucucuagacauauccgcacccacacaggggagaagcccuucgcgugugacauuugcggacggaaauuugccaucuccagcaaucugaacucucauaccaagauccacacgggcucccaaaaaccguuccaguguagaauuugcaugcgcaauuuuagccgguccgauaaccuugcuagacauauccgcacacacaccggggaaaagccuuucgccugcgacauuuguggacggaaauucgccacaagcggcaaucugaccagacacaccaagauccaucuccgggggucucagcugagcauugucgaugcucccgagcagcgcgaaggagccucccaagugucuguuagcgugacauuugaggacgucgcgguccucuucacgagagaugaguggaagaaacuggaccuuucccagcggucucuguaucgcgaagugaugcuggagaacuacagcaaucucgcuuccauggccggcucuccuaagaaaaagagaaaaguguga

SEQ ID NO: 11390 - RNA, 3549 nt, Artificial Sequence
  Cas13a variant__Leptotrichia wadei__ERK53440.1__Cas13a
auguacaugaagaucaccaaaauugacggcgugagccacuauaagaaacaggauaaggggauccugaaaaagaaguggaaagaccucgaugagagaaagcaacgggaaaagauugaggcccgcuacaacaagcagaucgaauccaaaauuuauaaggaguucuuuagacugaagaauaaaaagcggaucgaaaaagaggaggaccagaacaucaagucucuuuacuucuuuauuaaagaacuguaucucaaugagaagaacgaagagugggagcugaaaaauaucaaccuugaaauucuggaugacaaggagcgcgucaucaagggauacaaauucaaggaagauguuuacuuuuucaaagagggcuauaaggaauacuaucuccggauucuguuuaauaaccugaucgagaaagugcagaaugagaaccgggaaaaggugcgcaagaauaaagaguuccucgaccugaaggaaauuuuuaaaaaguacaaaaacagaaagaucgaucuucugcucaagagcaucaauaacaauaaaauuaaccuggaguauaagaaagaaaacgucaaugaggagaucuacgggauuaaccccacaaaugaccgggaaaugacguucuaugagcuucugaaggaaaucauugagaaaaaggaugaacaaaaguccauccucgaggagaaacuggacaacuuugauaucaccaauuuccuggaaaacauugagaagaucuuuaaugaagagacagagauuaacaucauuaaaggaaaggugcucaaugaacugcgcgaguacaucaaagaaaaggaggaaaacaauucugacaacaaacuuaagcagaucuauaaucuggagcucaagaaauacauugagaacaauuucagcuacaagaaacagaaguccaaaucuaagaacggcaagaacgacuaucuguaccuuaauuuccugaaaaagaucauguuuauugaagagguugaugagaaaaaggaaaucaacaaagaaaaguucaagaauaaaauuaacagcaauuuuaagaaccucuucgugcagcauauccuggacuaugggaaacugcucuacuauaaggagaaugaugaguacauuaaaaacaccggacaacuggaaacaaaggaccuugaguauaucaagaccaaagaaacacugaucagaaagauggcuguccucguguccuuugccgcgaauagcuacuacaaccuguucggccggguuucuggcgauauucuugggaccgagguggucaaauccagcaagacgaaugugaucaaagugggaucucacauuuuuaaggagaaaaugcugaacuauuucuuugacuucgaaaucuuugaugcuaauaagauugucgagauccucgaauccaucagcuacucuauuuauaacguucgcaauggcguggggcauuucaacaagcugauccugggaaaauacaagaaaaaggacauuaacaccaauaaaagaaucgaggaagaucucaacaauaacgaggagauuaagggcuauuuuaucaagaaaagaggggaaaucgagcgcaaggugaaagaaaaguuccuguccaauaaccuucaguacuauuacagcaaagagaagauugaaaauuacuucgaggucuaugaguuugaaauccugaagagaaaaauuccuuucgccccgaacuuuaagcggaucauuaaaaagggagaggaccucuucaauaacaaaaauaacaagaaguacgaauauuuuaaaaauuucgauaagaacuccgccgaggagaaaaaggaauuucugaaaacaagaaauuuccugcuuaaggagcucuacuauaacaacuuuuacaaggaguuccugucuaaaaaggaagaauuugagaaaaucgugcuggaaguuaaggaggagaaaaagagccgcggcaauaucaacaauaaaaaguccggcgugagcuuccagucuauugacgacuaugauaccaagaucaacauuuccgacuacaucgcuagcauucacaaaaaggaaauggagcgggucgaaaaauacaaugaggagaagcagaaagauacagccaaguauaucagagacuuuguggaagagauuuuccucaccggguucaucaacuaccuggaaaaggauaaacgccuucauuuucugaaggaggaguucucuauccucugcaauaacaauaacaauguuguggacuuuaacauuaauaucaacgaagagaaaauuaaggaguuccugaaagaaaaugauagcaagacgcugaaccuuuaucucuuuuucaauaugaucgacuccaagcggauuucugaauuuagaaacgagcuggucaaauacaagcaauucaccaaaaagcgccuggaugaagagaaagaguuucucggaaucaagaucgaacuguaugagacacuuauugaguucgugauccugacacgggaaaagcucgacaccaaaaagagcgaagagauugaugcuuggcuggucgacaaacuguacgugaaggauuccaacgaguauaaagaauacgaggaaauccuuaagcucuuuguugacgagaaaauucugagcucuaaggaggcccccuacuaugcgaccgacaauaagacaccuauccugcucuccaacuucgagaaaacgagaaaguacggcacccagagcuuccugucugaaauccaguccaauuauaaauacagcaagguggaaaaagagaacauugaagauuauaauaagaaggaggagaucgaacagaaaaagaaauccaacauugagaaacuucaagaccugaaagucgaacuccacaagaagugggagcagaauaaaaucacagaaaaggagauugagaaauacaacaauaccacacgcaagaucaacgaauauaauuaccugaaaaacaaggaggaacugcagaauguguaccuucuccacgagaugcugucugaucugcucgcccggaacguugccuuuuucaauaagugggaaagagacuuuaaauucauugugaucgcuaucaagcaauuucugcgcgagaacgauaaagagaaggucaacgaguuccuuaaucccccugacaacagcaaagggaagaaaguguauuuuuccgugucuaaguacaagaauaccguugaaaacauugauggaauccauaaaaauuucaugaaccugauuuuucucaauaacaaguucaugaaucggaaaaucgacaagaugaacugugcuauuugggucuauuuuagaaauuacaucgcccacuuccugcaucugcacacgaaaaacgaaaagaucagccuuauuucccagaugaaucugcucaucaagcuguuuagcuaugauaaaaaggugcagaaccacauucucaaaucuacaaagacccugcuugagaaauacaauauccagauuaacuucgagaucuccaacgacaagaaugaaguguucaaguauaaaaucaagaaccggcuguacagcaaaaagggcaaaaugcucgggaagaauaacaaguuugagauucuggaaaaugaguuccuggaaaacgucaaagcgaugcuugaguacucugaguga

SEQ ID NO: 11391 - RNA, 4158 nt, Artificial Sequence
  Cas13a variant__Clostridium aminophilum__WP_031473346.1__Cas13a
augaaguucagcaaaguggaccacaccagauccgccgucggcauccagaaggcuacagauucuguucaugggaugcuguacacggaccccaaaaagcaagaagugaacgaucucgacaaacgguuugaucagcugaaugugaaggccaagcgccuuuauaacgucuucaaucagagcaaagcggaagaggacgaugacgaaaagagauuuggaaaagugguuaagaaacugaaccgggagcucaaggaucugcuuuuccaccgcgaaguguccagauacaauucuauuggcaacgcuaaguauaauuacuaugggaucaaaagcaacccugaggagauugucuccaaucugggaaugguggaaucucucaagggcgagcgggacccgcagaaaguuaucagcaagcugcugcucuacuaucugcgcaaagggcuuaagcccggaaccgauggccugagaaugauucucgaagccuccugcggccugcggaaacuuagcggggacgagaaggagcugaagguguuucuccaaacacuggaugaagacuucgagaaaaagaccuuuaaaaagaaccugauccgcucuaucgaaaaucagaacauggccguccagccuuccaaugagggagaccccauuaucggcauuacacaggggagauucaacagccaaaagaaugaagagaagucugcuaucgagcggaugauguccauguacgccgaucucaacgaagaccaucgcgaggaugugcugagaaaacuucggcgccugaacgugcucuacuuuaaugucgacaccgaaaagacagaggaaccuacccugcccggagagguugauacgaacccuguguucgagguguggcacgaccaugaaaagggcaaagagaaugauagacaguuugcuaccuucgccaagauucuuacagaagaccgggagacccgcaaaaaggaaaagcuggcggucaaagaggcccucaacgaucucaagagcgcuauccgcgaccacaauauuauggccuaucgguguucuaucaaagugacagagcaggauaaggacgggcuguuuuucgaagaccagagaaucaaccgcuucuggauucaccauaucgaguccgcuguugaacggauucuggccagcaucaauccggagaaacuguacaaacuuagaauuggauaucugggcgagaagguguggaaagaucuccugaacuaccuuuccaucaaguauaucgcggucggcaaagccguguuucacuucgcuauggaagaccuggggaagaccggacaagauauugagcucggcaaacugucuaauagcguuuccgggggacugacgagcuuugacuacgaacagauccgcgccgaugagacacuccagcggcaacugucuguggaagucgcuuucgccgccaacaaucuuuuuagagcuguggucggccagaccgggaagaaaauugagcaguccaagagcgaggaaaacgaggaagacuuccugcucuggaaggcggagaaaaucgccgaaucuauuaagaaagagggagagggcaauacacuuaagagcauccugcaguuuuucggcggggcuuccucuugggaucugaaccauuuuugcgccgccuauggaaaugaaagcuccgcucucggcuacgagaccaaauucgccgacgaucugcgcaaggcgaucuacagccugcggaacgaaaccuuucacuucacaacgcucaacaaggggucuuuugacuggaaugcuaaacugauuggagauauguucucccacgaggccgccaccggcaucgcuguggaaagaacacgcuucuauagcaacaaucuucccauguuuuaccgggagucugaccugaagagaauuauggaucaucucuauaacaccuaccacccucgggccucccaaguucccagcuucaauuccguguuuguccgcaaaaacuucagacuguuucugucuaauacacuuaacaccaauacgagcuucgacacagagguguaucagaagugggaauccgggguuuacuaucucuuuaaagagaucuacuacaacucuuuccugccuagcggcgacgcucaucaccuguuuuucgaaggacuccggagaauuagaaaggaggccgauaaucugcccaucgugggcaaggaggcgaaaaagcggaacgccguccaggacuuugggagacgcugugaugaacuuaaaaaucugucccucagcgcuauuugccagaugaucaugaccgaguauaacgaacaaaauaacggaaacagaaaggugaaaucuacccgggaggacaagcgcaagccggauaucuuccagcauuacaaaaugcugcugcuuagaacacuccaggaagccuuugcuauuuauauccggcgcgaggaguucaaguucauuuuugaccugccuaaaacccuguacgugaugaagcccguugaagaguuccucccuaauuggaaauccggcauguuugauagccuggucgaaagagugaagcagucucccgaccuucaacggugguaugugcuguguaaauuccucaacgggcgccugcugaaucagcuuuccggagucaucagaagcuacauucaguuugccggcgauauccagcggcgcgcgaaggccaaccacaauagacucuauauggacaacacacaacggguggaguacuacucuaauguucuggaaguggucgauuucugcaucaaggggacgagcagauuuuccaacguguucagcgacuauuuucgcgaugaggacgcuuacgccgacuaucuggauaauuaccuccaguucaaagacgagaagauugcugaaguuucuuccuuugccgcccugaaaaccuucuguaacgaggaagaggugaaggcuggcaucuauauggauggagaaaaucccgucaugcagcggaacauugugauggcgaaacuuuucggcccugacgagguucugaagaauguggucccgaaggugacaagagaggaaaucgaggaauacuaucaacucgagaaacagauugcccccuaccgccagaacggguacugcaagagcgaggaagaucagaaaaagcugcugcgguuucaaagaaucaaaaaucgcguggaguuccagaccaucacagaauuuuccgagauuaucaacgaacuucugggacagcucauuucuuggagcuuccugcgggagagagaccuccuguauuuucagcuuggcuuccacuaccugugucuccauaacgauaccgagaagccugcugaauauaaggagaucucccgcgaagacgggacggucauucggaaugccauccugcaccaaguugccgcuauguacgugggaggccugcccguguauacccuugccgauaaaaagcuggcggcuuuugagaaaggggaagccgacugcaagcucucuaucagcaaagauacagccggcgcuggaaagaagauuaaagacuucuuuagauacuccaaguauguccugaucaaagaccggaugcucaccgaucagaaccagaaguacacaauuuaccuggccggccuugagcuguucgagaauaccgacgaacaugauaacaucacggacgugcgcaaauauguugaucacuuuaaguacuaugcgacaucugacgagaaugcuaugagcauucucgaucuguacuccgaaauccacgacagauucuuuaccuaugauaugaaguaccagaaaaacguggccaauaugcuggagaacauucuucugcggcauuucguccucauccgcccugaguucuuuacagggagcaagaaagugggagaaggcaagaaaaucaccuguaaggccagagcucaaauugagaucgccgaaaaugggaugcggucugaggacuucaccuauaaacuguccgauggaaagaagaacauuagcacaugcaugaucgcugccagagaccagaaauaccucaauacgguugcgcgccugcuuuacuauccccacgaagccaagaaaucuauuguggauacccgggagaagaaaaacaauaagaagacaaacagaggcgacgggaccuuuaauaaacagaagggcacagcucgcaaagagaaggacaacggaccgcgggaguucaaugauaccggcuuuuccaacacgccuuucgccggguuugaccccuucagaaacagcuga

SEQ ID NO: 11392 - RNA, 4035 nt, Artificial Sequence
  Cas13a variant__Eubacterium rectale__CVRQ01000008.1__Cas13a
augcugagacgggacaaggaggugaaaaagcucuacaacgucuucaaucagauccaaguuggcaccaaacccaagaaauggaacaaugaugaaaagcugagcccugaggaaaacgagcgcagagcccagcagaagaauauuaaaaugaagaacuauaaauggcgggaggcuugcuccaaguacguggaaucuagccagcgcaucauuaaugacgugaucuuuuauuccuacagaaaagccaagaacaaacuucgguauaugcgcaaaaaugaggauauucugaagaaaaugcaagaagcggagaagcucucuaaauucagcgggggaaagcuggaagacuuugucgcuuacacacuuagaaaaucccuggugguuucuaaguaugauacgcaggaguucgacagccucgccgccaugguggucuuucuggaguguaucggcaagaacaauaucuccgaucacgaacgggagauugugugcaaacugcucgaacugauccgcaaggacuucagcaaacuugauccgaacguuaaggggucucagggagcuaauauugugagauccguccggaaccagaauaugaucgugcaaccccagggcgaccgcuuucuguucccucagguguacgccaaagagaacgaaaccgucacaaacaagaauguugagaaggaggggcucaacgaauuucugcuuaauuacgcuaaccuggaugacgagaaaagagccgaaagccuccggaagcugcgccggauucuggauguguauuucucugcgcccaaucauuacgagaaagacauggacaucacccucuccgauaacauugaaaaggagaaauuuaaugugugggagaagcacgaauguggaaagaaagagacaggccuguucgucgacaucccugaugugcuuauggaagccgaggcugaaaacaucaagcuggacgccguuguggagaaaagagagagaaagguccucaaugaucgcgugcggaaacagaacauuaucugcuauagauacacccgcgcuguuguggaaaaguauaauagcaacgagccccuguuuuucgaaaauaacgccauuaaucaauacuggauccaucacauugagaacgcggucgagcggauccuuaagaacuguaaagccggcaagcuguucaaacucagaaagggguaucuggcugaaaaaguguggaaggacgccaucaaucugauuucuaucaaauacauugcucucggaaaggccgucuacaacuuugcccuggaugacaucuggaaggauaaaaagaauaaagagcuuggcauuguggacgaacgcauccggaacgggaucacauccuucgauuaugagaugauuaaggcucaugaaaaucugcagagagagcucgcgguugacaucgccuuuagcgugaacaaucuggcucgcgccgucugcgacauguccaaccuuggaaauaaagagucugauuuccugcucuggaagcggaacgacauugccgauaagcugaaaaauaaggacgauauggcuagcguguccgccguucugcaguuuuucggcgggaaaagcucuugggacaucaacauuuuuaaggaugcguacaaaggaaagaagaaauauaauuacgaagugagauucaucgacgaucuccgcaaggcuauuuauugugcccggaacgagaauuuucacuucaaaaccgcccuggucaacgacgaaaaguggaacacggagcuuuuuggcaaaaucuucgaaagagagaccgaguuuugccugaauguggaaaaggaucgguucuacuccaacaaucucuauauguucuaccaagugagcgagcugcgcaacaugcuggaccaccuuuacucuagaagcguuucccgggcugcccaggucccuucuuauaauagcgugaucgugagaacagcuuuuccggaauacauuaccaacguccucggcuaucagaagcccuccuacgaugccgacacacuggggaaaugguauagcgcguguuacuaucugcucaaggagaucuacuacaauucuuuccugcaguccgaccgcgcccuucaacuguuugaaaagagcgugaagacccucucuugggaugacaaaaagcagcagcgggcuguugauaacuucaaagaccauuuuuccgauauuaagagcgccugcacgucccuggcucaggugugucaaaucuauaugacagaguacaaucagcagaacaaucagauuaagaaagucagaucuagcaacgacuccaucuucgaucaaccuguguaucagcacuacaagguucugcuuaaaaaggccaucgcgaaugccuuugcugacuaucucaaaaacaauaaggaucuguucggauuuauuggcaagcccuucaaagccaacgagauccgcgaaauugacaaggagcaguuucugccugauuggaccucuagaaaauacgaagcucucugcaucgaggugagcgggucccaggagcugcaaaagugguauauugucggaaaauuccuuaacgcccggagccugaaucucauggugggcucuaugcgcuccuacauccaguacguuacagacaucaagagacgggccgcuagcauugggaacgaacugcaugugucuguccacgauguggagaagguggaaaaauggguccagguuaucgaggugugcucccugcuugcgagccgcaccucuaaucaauuugaagacuauuucaacgacaaggaugacuacgccagauaucucaaaagcuacguggauuucuccaaugucgacaugcccagcgaguauucugcucugguggauuuuuccaacgaggaacagagcgaccuguacguugauccgaagaauccuaaagugaaccggaauauuguccacuccaaacucuucgccgccgaccauauccugcgcgauauuguggagcccguuucuaaggacaacaucgaagaguuuuauagccagaaggcugaaaucgccuacuguaagauuaaaggaaaggagaucaccgcggaggaacagaaagcugugcuuaaguaccaaaagcugaaaaauagagucgagcuccgggauauuguggaauauggcgagaucauuaacgaacugcugggccagcuuaucaauugguccuucaugcgcgagagagaccuccuguacuuucagcugggguuccacuaugacugccuccggaacgauucuaagaaaccugagggauacaagaauauuaaaguugacgaaaacagcaucaaggaugccauccuguaucagauuaucggcauguacgugaauggggucacaguguaugcccccgagaaagacggagauaaacuuaaggaacaaugugugaagggcggggucggcguuaagguguccgcuuuucauagauacucuaaauaccugggacucaacgagaagacgcuguauaacgccggccuggagauuuucgaaguggucgcggagcacgaagacaucauuaaucuucgcaacgggaucgaucauuuuaaauacuaucugggagacuaccggagcaugcucuccaucuauagcgagguguucgauagauuuuucaccuacgacauuaaguaucagaagaauguucugaaccuccugcagaauauccuucugcgccacaacgugauugucgaacccauccucgagucuggcuucaaaacaauuggggagcagaccaagccuggagcuaaacuguccauccggagcaucaagucugauacauuucaauacaaagugaagggcgggacccugauuacggacgccaaggaugaaagauaccuugagacaauccgcaaaauucuguauuacgccgaaaaugaggaagacaaccucaagaaauccguuguggucaccaaugcugacaaguaugagaaaaacaaggagagcgaugaccagaauaagcagaaagaaaagaaaaacaaggauaauaaaggcaagaaaaacgaggaaaccaagucugacgccgagaagaauaacaacgaacggcuguccuacaauccguucgcuaaccucaauuuuaaacugagcaacuga

SEQ ID NO: 11393 - RNA, 3858 nt, Artificial Sequence
  Cas13a variant__Herbinix hemicellulosilytica__CRZ35554.1__Cas13a
augaagcugaccagacggcgcaucagcggcaacuccguggaccagaaaauuacagccgcuuucuacagagauaugucucaagggcuccuguauuacgacagcgaggauaaugacugcacggauaaggucaucgaauccauggacuuugagcggucuuggcgcggacggauucuuaaaaacggcgaagaugacaagaaucccuucuauauguuuguuaaagggcuggugggaagcaacgauaagaucgugugugagccuauugacgucgauuccgacccggauaaucucgacauccugaucaacaagaaucuuaccggcuucgggcggaaccugaaagcccccgacucuaaugauacacucgaaaaccugauucgcaagauccaggcgggcauuccugaggaggaagugcugcccgagcucaaaaagaucaaagaaaugauucagaaggacaucguuaauagaaaggagcagcugcuuaaaagcauuaagaacaaucggaucccuuuuucccuggagggaagcaaacucgugcccucuaccaagaaaaugaaguggcuguucaaacuuaucgaugucccuaacaagacauuuaaugaaaagaugcuggagaaauacugggaaauuuaugacuacgauaagcucaaagcuaacaucaccaaccgccuggacaagacagauaaaaaggccagauccauuagccgggccgugucugaggaacugcgcgaguaucacaagaaucucagaaccaacuacaaucgguucguuuccggcgaccgcccggcugccgggcuggauaacggaggcagcgcuaaauacaaucccgacaaggaggaauuucuucuguuccucaaagagguggaacaauauuuuaagaaauacuucccugucaagucuaagcauuccaacaaaagcaaggauaaaucccugguggacaaguauaaaaauuacugcucuuauaagguggucaagaaagagguuaacagaagcaucauuaaucagcuuguggccgggcugauccagcagggaaagcuccuguacuauuuuuacuacaacgacacguggcaagaagauuuccuuaauuccuauggccucagcuacauccagguggaggaggcguucaaaaagucugucaugaccucccugagcugggggauuaaccggcuuacaucuuucuuuaucgacgauagcaauaccgugaaauuugacgauauuacaaccaagaaagccaaggaagcuaucgaguccaacuauuucaauaagcugagaacguguucucgcaugcaggaccacuuuaaagaaaagcucgccuucuuuuaccccguuuaugugaaagauaagaaagaccggccugaugacgauauugagaaccugaucguccuugugaagaacgcuaucgaaagcguuuccuaccugagaaaucgcacauuccauuuuaaggagagcucucuccuggagcugcucaaagaacuggacgauaagaacuccggacagaauaaaauugacuauagcguggccgcggaguucaucaagcgggacauugaaaaccuuuacgaugucuuuagagagcaaauccgcucucugggcauugccgaguacuauaaagcugacaugaucuccgauugcuucaagaccuguggccucgaauuugcccuguacagccccaaaaauucccugaugccggcuuucaagaacguguauaagagaggggccaaucuuaacaaagccuacauuagagacaagggaccuaaagagacaggcgaucaggggcaaaauucuuauaaggcucucgaagaguaccgcgaacugaccugguauaucgaggucaagaacaaugaccagagcuacaacgcguacaaaaaucugcuccagcugaucuauuaccacgccuuccuucccgaggugcgggaaaacgaggcucugauuaccgauuuuaucaauagaacaaaggaauggaaccgcaaagagacggaggaacggcucaacaccaagaauaacaaaaagcauaaaaauuucgacgagaacgaugacauuacaguuaauaccuauagauacgaauccaucccugauuaucagggagagucucuggacgauuaccugaaggugcuucagcggaagcaaauggcccgcgccaaagaagucaacgagaaggaagagggcaauaacaauuauauucaguuuaucagagacgugguugugugggcuuucggggccuaccucgagaacaaacugaagaauuacaaaaacgaacugcagccuccccucagcaaggagaauaucggacugaacgacacacuuaaggaacuguuucccgaggagaaagucaaguccccguucaauauuaaaugccgguuuagcaucucuaccuucauugauaacaagggcaaauccacggacaacacaagcgcggaagcugugaagaccgauggcaaggaggacgaaaaagauaagaaaaauaucaagagaaaagaccuccuguguuuuuaucuguuccuucgccuccuggaugagaacgaaauuugcaagcugcagcaccaauuuaucaaguaccgguguucucucaaagagagacgcuuccccgggaauagaaccaagcuggagaaagaaacagagcuucuggccgaacucgaggaacugauggagcuggugcgguuuaccaugccuuccauccccgagauuagcgccaaggcugaaucuggauaugacacaaugaucaaaaaguacuucaaggauuucauugagaaaaagguuuuuaaaaacccuaagacgagcaaucuuuauuaccacuccgacagcaaaacccccgucacacgcaaguauauggcccuccugaugagaucugcuccgcugcaucucuacaaagauaucuucaagggcuacuaucugauuaccaagaaagaaugccuugaguacaucaagcuguccaacaucauuaaagacuaucagaauagccucaacgaacugcacgagcagcuggagcggaucaagcugaaauccgaaaagcagaaugggaaggacucucuguaccucgauaaaaaggacuuuuauaaagugaaggaguacguggaaaaccuggagcaagucgcccgcuauaaacaucuccagcacaagauuaauuucgagagccuguacagaaucuuucggauucacguggauaucgcggcccgcaugguuggauacacacaggacugggaaagagauaugcauuuccuuuuuaaggcucugguguauaacggcguccucgaggaacggcgcuucgaggccauuuuuaauaacaaugacgauaacaaugacgggagaaucgugaaaaagauccagaacaaccugaauaacaaaaaucgggaacugguuuccaugcuuuguuggaacaagaaacugaauaagaacgaguucggcgcuauuaucuggaagagaaauccuauugcccaccucaaccauuuuacccaaacggagcaaaauucuaaaagcucccuggaaucucucaucaacagccugcgcauucuucuggcguacgaucggaagagacagaaugccgugaccaaaacaaucaacgaccuccugcugaaugauuaucacauccgcauuaagugggagggacgggucgacgaaggccagaucuacuucaacauuaaagagaaggaagauaucgagaaugagcccauuauccaucuuaaacaucugcacaagaaggacugcuauaucuacaaaaacuccuauauguucgacaagcagaaagaauggauuugcaacgggaucaaggaggaaguguacgauaaaagcauucucaaguguaucggaaaucuguuuaaguucgacuacgaggauaaaaacaagucuuccgcuaauccuaaacacaccuga

SEQ ID NO: 11394 - RNA, 4314 nt, Artificial Sequence
  Cas13a variant__Lachnospiraceae bacterium__WP_022785443.1__Cas13a
augaagaucagcaaagugagagaggaaaaccggggcgccaagcugaccgucaaugcuaaaacagccguuguguccgagaaccgcucucaggaagggauucucuacaaugaccccagcagauauggaaagucccggaaaaacgaugaggaccgcgauagauacaucgaaucucggcuuaagagcuccggcaaacuguaucgcauuuucaaugaggacaaaaacaagagagagacggaugaacugcaaugguuucucucugagaucgugaaaaagauuaaucggcgcaacgggcugguccuuagcgacaugcuguccguggaugacagagcguucgaaaaggcuuuugagaaguacgccgagcucagcuauaccaaucggcgcaacaagguuucuggauccccugccuucgaaacaugcggcguggaugcugccaccgcugagagacugaaagggaucaucagcgaaacaaauuuuauuaaccggaucaagaauaacauugacaauaaagucucugaggauaucauugaccgcaucauugccaaguaccugaaaaagucccucuguagagaacgggugaaaagaggacugaagaaacuucugaugaacgcguucgaucucccguauagcgaccccgacaucgauguucagcgcgacuuuaucgauuacgugcuggaggacuucuaccacguccgggccaaaucucagguguccagaagcauuaagaacaugaauaugccugugcagcccgagggcgauggcaaauuugcuaucaccgucuccaaagggggaacagaaucuggcaacaaacgcagcgccgagaaggaggcuuucaagaaauuucuuuccgacuaugccagccuggaugaacggguuagagacgauaugcuccgccggaugagacgccugguggugcuguacuucuaugggucugacgauuccaagcucagcgacgucaaugaaaaauuugacgugugggaggaucaugcggcccggagaguugacaaccgcgaguucauuaagcugccucuugaaaauaaacuggcuaacggaaagaccgauaaggacgccgagcggaucagaaagaauacggugaaggaacucuaccggaaccaaaauauuggcugcuaucgccaggcugucaaagccguggaggaagauaacaaugggagauacuucgacgauaagaugcugaacauguuuuucauccaccggaucgaguauggaguugagaaaauuuacgccaaucuuaaacaggugaccgaauuuaaggcuagaacaggcuaccugucugagaaaaucuggaaggaccucauuaacuauaucagcauuaaauacaucgcgaugggcaaggccgucuauaauuacgcuauggaugaacugaacgccuccgacaaaaaggagaucgagcuggggaaaauuucugaagaguaucucagcggaaucuccagcuucgauuacgaacugauuaaggccgaggaaaugcuucagcgcgagaccgcuguguaugucgccuuugcggcucggcaucugucuucccaaacaguggagcucgacagcgaaaacucugauuuccugcuucugaagcccaaaggcaccauggacaagaaugacaaaaacaagcucgccuccaauaacauccugaauuuucugaaagauaaggagacgcucagagacacaauucugcaguacuucgggggacacagccuuuggaccgauuuuccuuucgacaaguaccuggccggcgggaaagaugacguugauuuucucacagaccugaaggaugugaucuauuccaugcgcaacgacucuuuccauuacgcuaccgaaaaucacaacaauggaaaauggaacaaggagcugauuagcgccauguuugaacacgagaccgagagaaugacagucgugaugaaagauaaguucuauuccaauaaccuuccgauguucuacaagaaugacgaucucaaaaagcugcugaucgaccucuauaaagacaacguugaacgggcuucucaggugcccagcuuuaauaaggucuucgugcgcaaaaacuuuccugcccuggugagagauaaggacaaccuuggcaucgagcuggaucucaaggcggacgccgauaaaggcgaaaaugagcugaaguucuacaacgcucuguauuacauguuuaaagaaauuuacuauaaugccuuccuuaacgacaagaauguucgggagcgcuuuaucacgaaagcuaccaaggucgccgauaacuacgacagaaauaaagagcggaaccucaaggaucgcauuaaguccgcggggagcgacgaaaagaagaaacugagagagcagcugcaaaauuauaucgccgaaaacgauuucggacagcggauuaagaauaucguccaggugaaccccgacuacacacucgcucaaaucugucagcugauuaugaccgaguauaaucagcagaacaauggcugcaugcagaaaaagucugccgcucgcaaggacaucaacaaagauuccuaccaacauuauaagaugcuucugcucgugaaccugagaaaagccuuucuggaguucauuaaggaaaauuacgccuuugugcuuaaaccuuacaagcacgaccucugugauaaggcugacuucguucccgauuuugcgaaauaugugaagccguacgccgggcugaucagccgggucgcuggaucuuccgagcugcagaaaugguauauugugagcagauuccucucuccugcccaggccaaccauaugcugggcuuccuucacagcuacaagcaauauguuugggacaucuaccgccgggcuuccgaaacagggaccgagaucaaucacagcauugccgaagauaaaaucgcgggcguggacauuacggaugucgacgcugugaucgaucugucuguuaagcucugcggaacaauuuccagcgagaucuccgacuauuuuaaggaugacgagguguacgccgaauacaucucuagcuaucuggacuucgaguacgauggcgggaacuauaaagacucccugaauagauuuuguaacucugaugccgucaaugaccagaagguggcucuuuacuaugauggagaacaucccaaacucaaccgcaauauuauccugagcaagcuguacggcgagcggagauuccucgagaaaauuaccgaccgcgugucccggucugauaucgucgaauauuacaagcugaagaaagagaccagccaguaccagacaaaggggauuuuugacuccgaagaugagcagaaaaacaucaagaaauuccaagaaaugaagaauauuguugaguuuagagaccuuauggauuauagcgaaaucgccgacgagcugcagggacagcucaucaacuggauuuaccugcgcgagcgggaucugaugaauuuccaacuuggcuaucacuacgcgugccugaacaaugacucuaacaaacaggcuaccuaugugacacucgacuaccaggggaagaagaauagaaaaaucaacggcgccauucuguaucaaaucugugccauguacauuaacggacucccucuguacuauguggauaaggacuccagcgaauggacggucucugauggcaaagaguccaccggggcuaagaucggagaauuuuaccgguaugccaagagcuucgagaauacaucugacugcuacgcuuccggccuugagaucuuugaaaacauuagcgagcaugauaauaucaccgaacugcgcaacuauauugagcacuucagauacuauuccagcuucgaccggucuuuucucgggaucuacagcgaaguguucgaucgcuuuuucacauacgaccugaaguauagaaagaauguucccaccauucuguacaacauccuucugcagcauuuugugaauguccgguucgaguuuguguccggcaaaaagaugaucggaauugauaaaaaggacagaaaaaucgccaaggagaaggaaugugcgcgcauuacgauccgggagaaaaacgggguuuauucugaacaguucaccuacaagcucaaaaauggcacaguguaugucgaugccagagacaagcgcuaccugcagagcauuauccggcuccuguuuuaucccgagaaagugaacauggacgaaaugauugagguuaaggagaagaaaaagccuuccgauaauaacaccggaaaaggcuacucuaagagagaccgccaacaggaucggaaagaauacgacaaguauaaagagaagaagaaaaaggaagggaauuuccuuagcggaaugggcgggaacaucaauugggaugagaucaacgcucagcugaaaaacuga

SEQ ID NO: 11395 - RNA, 3156 nt, Artificial Sequence
  Cas13a variant__Listeria newyorkensis__WP_036091002.1__Cas13a
augaagaucaccaaaaugagaguggacggccggacaauugucauggagcgcacgagcaaggaagggcagcugggauacgagggcaucgaugggaacaaaaccacagaaauuaucuucgacaagaaaaaggaguccuuuuauaagucuauucucaauaaaaccguuagaaagcccgaugaaaaagagaagaaccggcgcaaacaagccaucaauaaggcuaucaacaaggagauuacagaacugaugcuugccgugcugcaccaggaggugccuagccagaaacuccauaaucugaagucccuuaacaccgaaucucugacaaaacucuucaagccgaaauuucagaauaugaucagcuaucccccuuccaagggagcggagcacguccaauucugccugaccgacauugcugugcccgccaucagagaucuggacgagauuaaaccugauuggggcaucuuuuucgaaaagcucaagcccuacacggacugggccgagucuuacauucauuauaaacagaccacaauccaaaagagcaucgaacagaacaaaauucaguccccugauagcccgcggaagcugguucuucagaaauacgugaccgcuuuucugaauggggagccccucggacuggaccuugucgccaagaaguauaaacuggcugaucucgccgaaucuuucaagcugguggaccugaacgaggauaaauccgcgaauuacaagaucaaagccugucuccagcagcaccaacgcaacauucuggacgagcuuaaggaagacccugagcugaaucaguacggcaucgaaguuaagaaauauauucagagauacuuucccaucaagcgggcuccuaaccgcagcaaacaugccagagcugauuuccucaagaaagagcugaucgaaucuacaguggagcaacaguuuaagaaugccgucuaucacuacgugcuugagcagggcaagauggaagcguaugagcugaccgaccccaaaacgaaggaucuccaggacauucgguccggggaagccuucagcuuuaaauucaucaacgcuugcgccuucgcuucuaacaaucugaagaugauucugaacccggagugugaaaaagauauccucggaaagggcaauuuuaaaaagaaccugccuaauuccacaacccgcagcgacguggucaagaaaaugauucccuucuuuuccgaugagcuucaaaacguuaauuucgacgaggccaucugggccaucagagggucuauucagcagauccggaacgaaguguaccacugcaagaaacauagcuggaaguccauucugaaaaucaagggauuugaguucgaaccuaauaacaugaaguaugcugauagcgacaugcagaaacucauggauaaggacauugcgaaaauccccgaguuuauugaggaaaagcugaaaucuuccggcgugguccgcuucuacagacacgacgagcuucaaagcaucugggaaaugaagcagggguuuucucugcucacaaccaaugcccccuucgugccuagcuuuaagcggguuuacgcuaaaggacaugauuaucagaccuccaagaacagauacuauaaucuggaccugacaacguucgauauccucgaguacggcgaagaggacuuucgcgcccgguauuuccugaccaaacuuguguacuaucagcaauucaugccgugguuuacagccgauaacaaugcuuucagagacgccgcgaacuuuguccugcgccucaacaagaaucggcagcaggaugcuaaagccuucauuaacaucagagagguggaagagggcgaaaugccccgcgacuacaugggguacguucagggacaaauugccauccacgaggauucuauugaagacaccccuaaucacuuugagaaguucaucagccagguguuuaucaagggcuucgaucggcauaugagauccgcuaaccugaaauuuauuaagaauccccgcaaccaggggcuggagcaaagcgaaaucgaggaaaugucuuucgacauuaaagucgagccuuccuuucuuaagaauaaagaugacuauaucgccuucuggaucuuuuguaagaugcucgacgcucggcaccugagcgaacugagaaacgagaugauuaaauacgauggacaucucacaggcgagcaggaaaucauugggcuggcccuucugggaguggacucucgcgagaaugauuggaagcaguucuucuccagcgaacgggaguaugagaagaucaugaaaggcuacgucguggaggaacucuaucagagagaacccuaccggcaauccgacggcaagaccccgauucuguuucgcgggguugagcaggcgagaaaauauggaacggaaacagugauccagcggcuguucgaugccaacccugaguuuaaggucucuaaaugcaaucuugcugagugggaaagacagaaggagaccauugaagagaccaucaagcgccggaaagaacuccacaacgagugggccaagaaucccaaaaagccucaaaacaaugcuuucuuuaaagaguacaaggaauguugcgacgccaucgaugcguacaacuggcauaagaacaaaacaacccuggccuaugugaaugagcugcaccaccuccugauugaaauccuuggcagauacguuggguauguggcuauugccgaccgcgauuuccaguguauggcuaaccaguacuuuaagcauagcggaaucacagagagagucgaauauuggggcgacaaucggcugaaauccauuaagaaacucgauacguuccugaagaaggaggggcuguuugugucugagaaaaacgcccgcaaucacaucgcccaucuuaacuaccucagccugaaguccgaaugcacccugcucuaucugagcgagagacuucgggaaauuuucaaauacgaccgcaagcugaaaaaugcugugucuaagucccucaucgauauccuggacagacacggcaugagcguugucuuugcgaaccugaaggagaauaaacaccggcuugugauuaagucucucgagcccaaaaagcugcgccaucugggaggcaaaaagaucgacgggggauacauugaaacaaaccagguguccgaggaauauuguggcaucgucaaaagacuccuggagauguga

SEQ ID NO: 11396 - RNA, 3363 nt, Artificial Sequence
  Cas13a variant__Listeria seeligeri__WP_012985477.1__Cas13a
auguggaucagcauuaagacccugauccaccaucucggcgugcuguucuuuugcgacuacauguauaacagacgggagaaaaagauuaucgaagucaaaacaaugcgcauuacgaagguugagguggaucggaaaaaggugcuuaucuccagagacaagaaugggggaaaacuggucuacgaaaacgagaugcaggauaauaccgaacaaaucaugcaccauaagaaaucuagcuucuauaaguccgugguuaacaaaacaauuugucgccccgagcagaagcagaugaagaaacucgugcacggccugcuucaggaaaauucucaagaaaagaucaaagucagcgacgugaccaagcugaacauuuccaauuuucucaaccauagauucaaaaagucucuguacuauuuuccugagaauagcccggauaaauccgaagaguaccggaucgagauuaaccugagccagcuccuggaagacucucuuaagaagcagcaggggacauucaucugcugggaguccuuuagcaaagauauggaacuguauauuaauugggccgagaacuacaucucuuccaagaccaaacucaucaagaaaagcauucgcaauaacagaauccaaucuacagaaucccggagcggacagcugauggaccgcuacaugaaggauauucuuaauaagaacaaacccuucgacauccaguccguuucugagaaguaucagcuggagaaacucaccagcgcucugaaggccacguuuaaagaagcgaagaagaacgauaaagagauuaauuacaagcugaaauccacccuccaaaaccacgaaagacagaucaucgaggaacugaaggagaauagcgagcuuaaccaguucaauauugaaauccggaaacaccuggagacauauuuuccuauuaagaagaccaaccgcaaagugggcgacaucagaaaucucgaaauuggggagauccaaaagaucgucaaccaucggcugaaaaauaagauugugcagcgcauccuucaggaaggaaaacuggcuucuuacgagauugaguccacagugaacagcaauucucuccagaagaucaaaauugaagaggccuucgcccugaaguuuaucaacgcuugucuguucgccagcaauaaccucagaaauauggucuaucccguuugcaagaaagauauucugaugaucggcgaguucaagaacuccuuuaaagagaucaagcacaaaaaguucauucggcaauggucucaguuuuucagccaggagaucaccguggacgacauugaacuugcuuccuggggccugagaggggccaucgcgccuauucgcaacgagaucauccaucucaagaaacacagcuggaagaaauuuuucaauaaccccacguuuaaggugaaaaagucuaagauuaucaauggaaaaacaaaggaugucaccuccgaguuccuguacaaagaaacacuuuuuaaggacuauuucuacagcgaacuggauucugugccugagcucauuaucaacaaaauggaguccagcaagauucuggacuacuauuccucugaucagcugaaucaaguuuuuaccaucccgaacuucgaacucagccugcuuaccuccgccgugcccuuugcuccuucuuucaagcgggucuaccugaaaggcuucgacuaucagaaucaggaugaggcccagcccgacuacaaccucaagcugaauaucuauaacgaaaaggcuuuuaauagcgaggccuuccaagcgcaguacucccuguuuaaaaugguguauuaccagguuuuccuuccucaguuuacaacgaacaaugaucucuucaaaagcucuguggacuuuauucugacccugaacaaggaaagaaaaggguacgccaaggcuuuccaagauauccgcaagaugaauaaagacgagaagcccuccgaguauaugagcuacauucagucucagcucaugcuguaucagaaaaagcaagaagagaaagaaaagaucaaccacuuugagaaguucauuaaccaggucuuuaucaaaggauucaauuccuuuaucgaaaagaaccggcuuacauacauuugucauccgaccaaaaauacagugccugagaacgacaauaucgagauucccuuccacaccgauauggacgauagcaacaucgccuucuggcugaugugcaagcuccuggacgcuaaacagcugucugaacuuagaaaugagaugauuaaguuuagcuguucccuccaaagcacggaagagaucucuacauucaccaaggcccgcgaggucauuggccuggcccugcucaacggggaaaaaggaugcaaugauuggaaggagcuguuugacgauaaagaggcuuggaagaaaaacaugucccuuuaugugagcgaagaacugcuccagucccugccuuacacccaggaggacggccagacacccguuaucaaucggucuaucgaucuggugaagaaguauggcaccgagacaauucuugaaaaacucuucagcuccucugacgauuacaaggucagcgcgaaagacaucgccaagcugcaugaguacgaugugacggagaaaauugcucaacaggaaucccugcacaagcaguggaucgaaaagcccgggcucgccagagacucugccuggaccaaaaaguaucagaacguuauuaaugacaucagcaacuaccaaugggcuaaaacaaagguggagcugacccagguccgccaucuucaccagcugacaaucgaucuccugucccggcuggccggauauaugagcauugcggacagagauuuucaauucucuuccaauuacauccuugagcgcgaaaacagcgaguaucgggugaccucuuggauucuccuguccgaaaacaaaaauaagaacaaauacaaugacuaugagcuguacaaccucaagaaugcuagcaucaaggugucuuccaaaaacgauccucagcugaagguugaccuuaaacagcugagacucacgcuggaauaccuggagcuuuuugauaaucggcugaaggagaaacgcaacaauauuagccacuucaacuaucucaauggccagcuggggaacuccauccucgaacuguuugacgaugccagagacguccuuagcuacgaucggaagcugaagaaugccgugucuaaaagccucaaggagauccuguccucucauggaauggaagugaccuucaaaccgcuguaucaaacaaaccaccaucuuaagauugacaaacugcagcccaagaagauccaccaccucggcgagaaaagcaccgucuccucuaaucaggugagcaacgaguacugucagcugguuagaacacuccugaccaugaaguga

SEQ ID NO: 11397 - RNA, 3465 nt, Artificial Sequence
  Cas13a variant__Paludibacter propionicigenes__WP_013443710.1__Cas13a
augagagugagcaaggucaaaguuaaggacggcgggaaagauaagauggugcuggugcaccggaaaaccacaggagcccagcucgucuacuccggccaacccgugucuaacgagacgagcaauauccugccugaaaagaagcgccaguccuucgaccuuucuacccugaacaaaacaauuaucaaguuugauaccgcuaaaaagcagaaacucaauguugaccaguauaagauuguggagaagaucuucaaauacccgaagcaagaacugcccaaacagauuaaggccgaggaaauccuuccuuuucugaaccauaaauuccaggagcccgucaaguauuggaaaaaugggaaggaggagagcuuuaaccucacacugcugaucguggaagcgguucaggcucaagauaagagaaaacuccagccuuacuaugacuggaagaccugguacauucagacaaaauccgaucugcuuaagaaaucuaucgaaaauaaccggauugaccugaccgagaaucucagcaagcgcaagaaagcccugcuugccugggagacggaguucaccgcuuccggaagcaucgaucugacacacuaucauaagguguacaugaccgacguccucugcaaaaugcugcaggaugugaagccccugacagacgauaaaggcaagauuaacaccaaugccuaccacagagggcucaagaaagcucugcaaaaccaucagccugccaucuuuggaacgcgggaagugccgaaugaagcgaaccgcgccgacaaucagcuuucuauuuaucaccuggaggucguuaaguaccucgaacacuauuuccccaucaaaacauccaagagacggaacaccgcugacgauaucgcccauuaccugaaagcucaaacacuuaagaccaccauugagaagcagcuggugaacgccauccgcgcgaauauuauccagcagggcaaaacaaaccaccaugagcucaaggccgacacgaccagcaaugaucugauuagaaucaaaacaaacgaggcuuuugugcugaaucucaccggcacaugugccuucgcugccaacaauauccggaacauggucgacaaugaacaaaccaacgauauucuggggaagggagacuuuaucaaaucucuucugaaggauaauacgaacucccagcucuauagcuucuuuuucggcgaagggcugucuacaaauaaagccgagaaggaaacccagcuuuggggcauucgcggagcugugcagcaaaucagaaacaauguuaaccacuacaagaaagacgcgcugaagaccguguucaacauuuccaauuuugagaacccuacaaucaccgaucccaaacagcagacaaauuaugccgacacgaucuacaaggcucgguucauuaacgagcucgaaaagaucccugaggccuuugcccagcaacugaagaccgggggagcugucagcuacuauacaauugaaaaucugaagucccuccugaccacauuccaguuuucucuuugccgcagcaccauccccuucgccccgggcuuuaaaaagguguucaacggcgggauuaauuaccagaacgcgaaacaggaugaguccuuuuaugaacugaugcucgagcaauaccugagaaaggagaauuucgcugaagagagcuauaacgcccgguacuuuaugcugaaacuuaucuauaauaaccucuuccugccuggauuuacgaccgacagaaaggccuucgcugacucuguuggcuucgugcagaugcagaauaagaaacaagccgaaaaggucaacccccgcaaaaaggaggcuuacgccuuugaggcggugcggccuaugacagccgcugauuccauugccgacuacauggcuuauguccagagcgaacugaugcaggagcagaauaaaaaggaagagaagguggccgaagagaccagaaucaacuucgagaaauuuguucuccaaguguucaucaagggguuugauucuuuccugcgcgcgaaagaauuugacuucguccagaugccccagccccagcuuacagccaccgcuagcaaccaacagaaggccgauaaacugaaucagcucgaggcuuccauuacggccgacuguaagcugacaccucaguacgccaaagcugaugacgcgacccacaucgccuuuuauguguucugcaagcugcuugaugcugcccaucucucuaaccugcggaaugaacugauuaaguuuagagagagcguuaacgaguucaaauuucaccaucuccuggaaaucauugagaucugucuucuguccgccgacguggucccgacagauuaccgcgaccucuauagcucugaagcugauugccuggcccggcugagacccuucaucgagcaaggagcggacauuaccaauugguccgaccuuuucgugcagagcgauaagcacucuccugugauccaugcuaacauugaacucuccguuaaauacggcaccacaaagcugcuggagcagaucauuaauaaagacacgcaauuuaagaccacagaagccaacuucaccgccuggaauacagcucagaaaagcaucgagcagcucaucaaacagcgcgaggaucaccacgaacaaugggucaaggccaaaaacgcggacgauaaggagaaacaggaacggaagagagagaaguccaauuuugcucagaaauucauugagaagcauggggacgauuaucuggacaucugugauuacauuaacaccuacaauuggcuugacaacaaaaugcacuuugugcaucugaaucgccuccacggacugacgaucgaacugcuuggccggauggccggcuucguggcccucuuugauagagacuuccaguuuuucgaugagcaacagauugcugacgaauuuaagcugcacggguucgucaaccugcauucuaucgacaaaaagcucaacgaggugcccacaaagaaaaucaaggaaauuuaugauauccggaauaaaauuauccagauuaacggaaauaagaucaacgagagcguucgcgccaaucugauucaguucaucuccucuaaaagaaacuacuauaauaacgcuuuucuucacgugagcaaugacgagaucaaggaaaagcaaauguacgauauucggaaccauaucgcccacuucaauuaucugaccaaagacgcggccgauuuuucccucauugaccugaucaacgagcugagagaacuucugcauuacgaucgcaagcucaaaaaugcugucagcaaggccuucauugaccuguuugauaaacacggcaugauccucaagcugaaacuuaacgcugaccacaagcugaagguggagucucucgaaccuaaaaagaucuaucaucugggguccagcgccaaagauaagcccgaguaccaguacugcaccaaucagguuaugauggccuauuguaacaugugccggucucugcuugagaugaaaaaguga

SEQ ID NO: 11398 - RNA, 3858 nt, Artificial Sequence
  Cas13a variant__Rhodobacter capsulatus__ETD76934.1__Cas13a
augcagaucggcaaggugcaagggagaaccauuagcgaguucggagaccccgccggcgggcugaaacggaagaucuccacagauggaaagaaccgcaaggaacucccugcucaccugucuagcgacccgaaagcccuuauuggccaguggaucuccgggauugauaagaucuacagaaagcccgacucucggaaaagcgauggaaaggcgauccauuccccuacgcccucuaaaaugcaguuugacgcucgcgaugaccugggcgaggccuucuggaagcucgucagcgaagccggccuggcucaggauuccgacuaugaucaauuuaaaagacggcuucacccuuacggggacaaguuccagcccgccgauagcggagcuaagcugaaauuugaggccgacccuccggaaccccaggcguuccauggccgcugguauggggccaugucuaagagaggaaaugacgcuaaagagcucgccgcugcccuguacgagcaccuccauguugaugaaaagcggauugacggccagccuaaacgcaaccccaagaccgauaaauuugcgccugggcucgugguggccagagcucugggaaucgaguccagcguccuuccccggggcauggcccgccuggcuagaaauuggggcgaagaggagauucaaacauauuucgugguugacguggccgccucugucaaggaaguggcuaaggcggccguuuccgcugcccaggccuuugauccgccuagacaggugagcgggcgcucucucucccccaaagucggauucgcucuggccgagcaccuugaaagagugaccggcagcaagcggugcuccuuugacccugcggcugggcccucugugcuggcccuccacgaugaggucaaaaagacauacaaaagacugugugcccgcggaaagaacgcugcccgggcuuuccccgccgacaagaccgaacugcucgcgcugaugagacauacacacgagaaucgcguucggaaccagauggugagaaugggccgcgugagcgaguaucgggggcaacaggccggagaucuugcucagucccauuacuggaccagcgccggccaaacggaaaucaaagagucugaaauuuuugucagacugugggugggcgcuuucgcccucgcggggcgcuccaugaaggccuggaucgacccuaugggaaaaauuguuaauaccgagaagaacgaucgggaccugacagcugccgugaauaucagacaggucaucagcaacaaagaaaugguggcugaggccauggcccgccggggcauuuacuucggggagaccccggaacuugacagacugggagcugagggcaaugaaggguuuguuuucgcgcuccugcgguaucugcgcggcugcagaaaccagacauuucaccucggagcccgggcuggcuuccugaaggagaucagaaaggaacuugagaaaacccgcugggggaaggccaaagaggccgaacacgugguccugacggauaagacaguggcugccauucgggcgaucauugacaaugaugcuaaagcccucggagccagacugcuugcugaccugucuggcgccuuugucgcgcauuacgcuagcaaggagcacuucuccacccucuauucugaaaucgugaaggccguuaaagaugcccccgaggugagcuccgggcugccucgccugaagcuccugcuuaaaagagcugacggaguccggggcuacgugcaugggcugcgcgauacaagaaagcacgccuuugcuaccaaacugcccccucccccggccccucgggagcuggacgaucccgcgaccaaggcccgcuauaucgcucugcuuagacucuacgacggcccuuuccgggccuaugcuagcggaauuacaggcacggcccuggccgggcccgcugcgcgcgccaaagaagcugccaccgcccuggcucagucuguuaacgugacaaaggccuacuccgaugucauggagggaagaagcucucggcuccgcccucccaaugacggcgaaacccugagagaguaccuuuccgcgcugacaggggaaaccgcuacggaguuucgggugcaaaucggauaugagagcgauuccgaaaacgccagaaagcaggccgaguucauugaaaacuaccgccgggacaugcucgcuuuuauguucgaggacuauaucagagccaaaggcuuugauuggauucugaagaucgaaccgggggcgacagcuaugacccgcgccccugugcugcccgagcccaucgacacccggggccaguacgagcauuggcaggccgcucuuuaucucguuaugcacuucgucccugccucugaugugagcaaucugcugcaccaacucagaaaaugggaagcucugcagggaaaguacgagcuugugcaggacggcgaugccacagaccaggcggaugcccgccgggaagcucuggaccucgucaaaagauuccgcgaugugcugguucuguuucuuaagaccggggaggcccgguucgaaggcagagcugccccguuugaccucaagcccuuccgggcccuguuugcuaacccugcgacauucgaucgccuguuuauggccacgcccaccacagcuagaccugccgaggacgaucccgagggagacggggccuccgaaccugagcuccggguggcucgcacccugagaggacuucggcaaauugccagauauaaucauauggcgguccugucugaccucuucgcuaaacacaaggugcgcgaugaagagguugcccggcuggccgagaucgaagacgagacacaggagaaaagccagauuguggcugcccaggagcugagaaccgaucuucaugacaaggucaugaaaugucaccccaagacgaucuccccggaagaacgccaaagcuacgcggccgcuauuaagaccaucgaggaacaccgguuucucgugggcagaguuuaccugggggaucaucugcgccuccaccggcugaugauggacgugauuggcagacuuaucgauuaugccggagcuuacgagcgcgacacaggcaccuuccugaucaacgccucuaaacagcucggggcuggagccgauugggcggucacaauugccggcgcugccaauaccgacgcuagaacgcagacacggaaggaucuggcccauuuuaacgugcuggaccgcgccgacgggaccccugaucuuacagcucuggugaauagagcgcgggaaaugauggccuaugaccgcaaaagaaagaacgcugucccccgguccauccucgauaugcuggccagacucggacugacccuuaaauggcaaaugaaggaccaucugcuccaggaugccaccauuacacaggcugccaucaagcaccuggacaaaguucgccugacggugggcggcccugcggccgugaccgaggcucgguucagccaggauuaccuucaaauggucgccgcuguguuuaaugggucuguucagaaccccaagccgagacgccgggacgauggagacgccuggcacaaaccucccaagccugcgacagcccagucccagcccgaucaaaaacccccuaauaaggcuccgagcgccggcucuagacugcccccuccccaggugggggaagucuaugagggagugguugugaaagucauugacaccggcagccucggguuccuggcuguggagggaguugccggcaacaucggccuccacaucucccggcugcgccggauucgggaagaugcuaucauuguggggcgcagauaccgguuccgcgucgagaucuaugugccucccaagagcaauacaucuaaacuuaacgccgcggaccuggugagaauugacuga

SEQ ID NO: 11399 - RNA, 1578 nt, Artificial Sequence
  Cas13a variant__Corynebacterium ulcerans__WP_038617242.1__Cas13
augcccaaguacugccugaccgccagauucccucucggcguguaucuggggcacacaggagacgcuaaccgggaugccuacccggaccccgcgcgccuucaugcugcccugaugaaugccgcugcccagggcguccacgcugaggaagauccuaacgagcaucaacucagacccagccagcagucccugcaggcccuucaauggcuggaagcgcacccucccacggggcucgccaugccugagcagcaguggcugucuccggacaccagccggaugauguaucgcaauguuggauccgugaaaaucgauaagacaggcgugaccagagcuacagaaaaccgggccgucucugacggggugagcguuaauggagcuuacggcuauauuugggaugagaugcccguggacaucgccgaggcgauuaccgcccugcucccugaugucgcuugucugggcgaagccuccucucuugugguucuggagcagcaagaaaucgaggcuacacucacccuggacccccaggccacggccuuuagcaccgagcgcgugcaggucagaauugcgcuuccugggcggacacagcaucugcgcgaaguguuccacgcuagauacgggaaaaagcccccguccaaaaaggccgauaaguuucucaaagacgauccuauccacgaucccccuauccccaaggaccaucugggcaccgcucgguaucugcgcgugaacgccgccgacaaagagugcgucacacccuggaccaagguuauucuccuggaagugcacgggaaacaacuuggagcuaaggaacaggugagagccgcggucgcucugcaucgggcccucaucgcccgcauuagaacggacgugagcccuguuaucacaggccgguacgcugccggggcucagagaccggccaauaaccuggcgauucaauacaucccccaccgccaccuugaggcccugggacucaagaccucugcuuucgcccugcuggugccucaggaugcugacuccacagucuaugagcagcucaaucaggcccugaccggccccuuuccucuucggagcggcgggaaacugcucugucaacugaaguacaacggacauguguucagaggcgaugcguuuuggcccgccccgcagccugggaccauucgcaugugggagccccuuaauguuuucaucccugaaucucggccccacaacaaacagcagggagugcuguggagacucgcugacgccggccugcuguccgucgcuuuuguguggcgcgauaauuucccuacaaaggagacggggcccgcccgguaugucgaacucagagacgccgcuuacaacgcggaugugcgcaucuuucaugaccacccgguuagccggaauaccagacgcuucgugcaucggacaaacagaucucugaccauucaaccuuggcggggacuuguccaccugggcucccuccagcaggaucgcgccaucauugcucugggccagagcagacaccugggaggaggccuucucauccccguggacauuccccgguccgaguuugaaacaaugaccucugagaugacgcaugccuga

SEQ ID NO: 11400 - RNA, 3675 nt, Artificial Sequence
  Cas13b variant__Bergeyella zoohelcum__WP_002664492.1__Cas13b
auggagaacaagaccagccugggcaauaacaucuacuauaaucccuucaaaccucaggacaaguccuacuuugccggguauuucaacgcugccauggaaaauacagauucuguguuuagagagcucggaaaacggcugaagggcaaagaauacacgagcgagaacuucuuugacgcgauuuucaaggaaaauaucucccuugucgaguaugagcgcuacguuaagcugcucucugauuauuuuccgauggcuagacugcuugacaaaaaggaagugcccauuaaagagcggaaggaaaacuucaaaaagaauuuuaaggggaucauuaaagccgugcgcgaucugagaaacuucuacacccacaaggagcauggagaggucgaaaucacagacgagaucuuuggcgugcucgaugaaaugcugaaaagcaccguucugacagugaagaaaaagaaagucaagaccgacaagacaaaagagauucucaagaaauccaucgaaaagcaacuggauauucuuugccagaaaaagcuggaguaccuccgggacaccgcccgcaagaucgaggaaaagagacggaaucagcgcgagagaggggaaaaggagcugguggcuccuuucaaauauucugauaagcgggacgaucuuauugccgcuaucuacaacgacgccuuugacguuuauauugauaaaaagaaggacagccugaaagaauccagcaaggcgaaauacaauacgaagucugauccccagcaagaggagggagaccucaaaaucccuaucuccaagaacggcguggucuuccugcugagccucuuccugaccaagcaggaaauucacgccuuuaaaucuaagaucgcuggcuucaaagccacagugauugaugaggcuaccguguccgaagccacagucagccaugggaaaaauucuaucuguuuuauggcgacccacgagauuuucucccaucuugccuauaaaaagcugaaacgcaagguuagaacggcugaaaucaacuacggagaggccgagaacgcugaacagcucagcguguaugccaaggagacacugaugaugcagaugcuugacgaacuguccaaagugcccgaugucguguaccaaaaucucucugaggacguucagaagaccuuuaucgaggauuggaacgaauaccugaaagagaauaacggcgacguggggacaauggaagaggaacaggucauucacccugugauccggaagcgcuaugaggauaaauucaauuacuuugccauuagauuccuggacgaguuugcucaguucccgacccuccgguuucaaguucaccugggaaacuaucuucaugacagcagacccaaggaaaaucugaucuccgaucgccggauuaaggagaaaaucaccguguucggcagacucagcgaacuggagcacaagaaagcgcuuuuuaucaagaacacagaaacgaaugaggaccgcgagcauuacugggaaauuuucccuaaccccaauuaugauuucccuaaagagaacaucucugucaaugacaaggauuuucccauugccggguccauccuggaccgggaaaagcagccgguggcuggaaaaauuggcaucaaggucaaacuccugaaccagcaauacgugagcgagguugauaaggccgugaaagcccaccagcugaagcagagaaaggcuucuaaaccuagcauucagaauaucaucgaagagauuguccccaucaacgaguccaacccuaaggaagccauuguguucggcgggcaacccaccgcguaucucucuaugaaugacauccacagcauucuguacgaguuuuucgauaaaugggaaaagaaaaaggagaaacuugagaagaagggagaaaaagagcugcgcaaggaaaucggcaaagagcucgaaaagaaaaucguugggaagauucaggcucagauccagcaaauuaucgacaaggauacaaacgccaaaauucugaagcccuaccaggacggaaauuccaccgccaucgauaaagagaagcugaucaaagaccuuaagcaggagcagaacauucuccaaaagcugaaagacgaacagacagugcgggagaaggaauauaaugauuuuaucgcuuaccaggacaaaaacagagagauuaauaagguccgcgaucggaaccauaaacaguaucugaaggacaaucucaagagaaaauacccugaagccccggcucgcaaggaggugcuguauuaccgggagaaaggcaagguggccguuuggcuugcgaacgauaucaaaagauucaugcccaccgacuuuaagaaugaauggaagggggagcaacacagccugcuccagaaaucucuggccuauuacgaacagugcaaggaggaacugaaaaaccuucucccugagaaggucuuccaacaucugcccuuuaaacugggaggcuacuuccagcagaaguaucucuaccaguuuuauacguguuaccuggauaaacggcuugaguauauuuccggccuggugcaacaggcugaaaauuucaagagcgagaacaagguguuuaaaaaggucgaaaaugagugcuucaaauuccucaagaaacagaacuacacacacaaggagcuggacgcccgcgugcagucuauccugggguauccuaucuuucuugaaagaggauucauggaugagaagcccaccauuaucaaaggcaagaccuuuaaagggaacgaagcucucuucgccgacugguuucgguacuacaaggaguaucaaaauuuccagacauuuuacgauaccgaaaacuauccgcugguugagcuggagaaaaagcaggcggacagaaagcgcaaaacaaagauuuaccagcaaaagaagaaugauguguucacgcuccugauggccaaacauaucuuuaaguccgucuucaagcaggacagcauugaccaguuuucccuugaagaucuguaucaaucucgggaggaaagacucggaaaccaggagcgcgcuagacagaccggcgaacggaauacaaacuacaucuggaauaaaaccguggaccugaagcugugugaugggaaaauuacaguugagaacgugaaacuuaaaaaugucggcgacuucaucaaguaugaguacgaucagcgcgugcaagccuuccucaaauacgaagagaacaucgaauggcaggcuuuucugauuaaggagagcaaggaagaggagaauuauccuuacguuguggaaagagagaucgaacaguaugagaaaguccggcgcgaggaacugcucaaggaggugcaccugauugaagaguacauccuugaaaaagugaaggacaaagagauucugaagaagggagauaaccagaauuucaaauauuacauccucaacggccugcugaagcaacuuaaaaaugaggacgucgaauccuauaagguuuuuaaccugaacaccgagcccgaagaugugaauaucaaccagcucaaacaggaggccacggaccuggaacagaaggccuucgugcucaccuacauuagaaauaaguuugcucacaaccaacugccuaaaaaggaguucugggauuacugccaggagaaauaugggaagaucgaaaaagagaagacauacgcggaauauuuugccgaggucuucaagaaagaaaaggaggcucuuauuaaauga

SEQ ID NO: 11401 - RNA, 3675 nt, Artificial Sequence
  Cas13b variant__Bergeyella zoohelcum__WP_002664492.1 modified__Cas13b(R116A,H121A,R1177A,H1182A)
auggagaacaagaccagccugggcaauaacaucuacuauaaucccuucaaaccucaggacaaguccuacuuugccggguauuucaacgcugccauggaaaauacagauucuguguuuagagagcucggaaaacggcugaagggcaaagaauacacgagcgagaacuucuuugacgcgauuuucaaggaaaauaucucccuugucgaguaugagcgcuacguuaagcugcucucugauuauuuuccgauggcuagacugcuugacaaaaaggaagugcccauuaaagagcggaaggaaaacuucaaaaagaauuuuaaggggaucauuaaagccgugcgcgaucuggccaacuucuacaccgcuaaggagcacggagaggucgaaaucacagacgagaucuuuggcgugcucgaugaaaugcugaaaagcaccguucugacagugaagaaaaagaaagucaagaccgacaagacaaaagagauucucaagaaauccaucgaaaagcaacuggauauucuuugccagaaaaagcuggaguaccucagagacaccgcccggaagaucgaggaaaaacgcagaaaucagcgggagcgcggggaaaaggagcugguggcuccuuucaaauauucugauaagagagacgaucuuauugccgcgaucuacaacgacgccuuugacguuuauauugauaaaaagaaggacagccugaaagaauccagcaaggcuaaauacaauacgaagucugauccccagcaagaggagggagaccucaaaaucccuaucuccaagaacggcguggucuuccugcugagccucuuccugaccaagcaggaaauucaugccuuuaaaucuaagaucgcuggcuucaaagccacagugauugaugaggcgaccguguccgaagccacagucagccacgggaaaaauucuaucuguuuuauggcuacccaugagauuuucucccaccuugccuauaaaaagcugaaacggaagguucgcacggcugaaaucaacuacggagaggccgagaacgccgaacagcucagcguguaugcuaaggagacacugaugaugcagaugcuugacgaacuguccaaagugcccgaugucguguaccaaaaucucucugaggacguucagaagaccuuuaucgaggauuggaacgaauaccugaaagagaauaacggcgacguggggacaauggaagaggaacaggucauucauccugugaucagaaagcgguaugaggauaaauucaauuacuuugcgauucgcuuccuggacgaguuugcccaguucccgacccucagauuucaaguucaccugggaaacuaucuucacgacagccggcccaaggaaaaucugaucuccgauagacgcauuaaggagaaaaucaccguguucggccggcucagcgaacuggagcauaagaaagcucuuuuuaucaagaacacagaaacgaaugaggacagagagcacuacugggaaauuuucccuaaccccaauuaugauuucccuaaagagaacaucucugucaaugacaaggauuuucccauugccggguccauccuggaccgcgaaaagcagccgguggccggaaaaauuggcaucaaggucaaacuccugaaccagcaauacgugagcgagguugauaaggcugugaaagcccaucagcugaagcagcggaaggcgucuaaaccuagcauucagaauaucaucgaagagauuguccccaucaacgaguccaacccuaaggaagcuauuguguucggcgggcaacccaccgccuaucucucuaugaaugacauccacagcauucuguacgaguuuuucgauaaaugggaaaagaaaaaggagaaacuugagaagaagggagaaaaagagcugagaaaggaaaucggcaaagagcucgaaaagaaaaucguugggaagauucaggcccagauccagcaaauuaucgacaaggauacaaacgcuaaaauucugaagcccuaccaggacggaaauuccaccgccaucgauaaagagaagcugaucaaagaccuuaagcaggagcagaacauucuccaaaagcugaaagacgaacagacagugcgcgagaaggaauauaaugauuuuaucgcuuaccaggacaaaaaccgggagauuaauaaggucagagaucgcaaccacaaacaguaucugaaggacaaucucaagcggaaauacccugaagccccggcgagaaaggaggugcuguauuaccgcgagaaaggcaagguggccguuuggcuugcuaacgauaucaaacgguucaugcccaccgacuuuaagaaugaauggaagggggagcaacauagccugcuccagaaaucucuggccuauuacgaacagugcaaggaggaacugaaaaaccuucucccugagaaggucuuccaacaucugcccuuuaaacugggaggcuacuuccagcagaaguaucucuaccaguuuuauacguguuaccuggauaaaagacuugaguauauuuccggccuggugcaacaggcugaaaauuucaagagcgagaacaagguguuuaaaaaggucgaaaaugagugcuucaaauuccucaagaaacagaacuacacacacaaggagcuggacgcccgggugcagucuauccugggguauccuaucuuucuugaacgcggauucauggaugagaagcccaccauuaucaaaggcaagaccuuuaaagggaacgaagcgcuuuucgccgacugguuuagauacuacaaggaguaucaaaauuuccagacauuuuacgauaccgaaaacuauccgcugguugagcuggagaaaaagcaggcugaccggaagagaaaaacaaagauuuaccagcaaaagaagaaugauguguucacgcuccugauggccaaacacaucuuuaaguccgucuucaagcaggacagcauugaccaguuuucccuugaagaucuguaucaaucucgcgaggaacggcucggaaaccaggagagagcucgccagaccggcgaaagaaauacaaacuacaucuggaauaaaaccguggaccugaagcugugugaugggaaaauuacaguugagaacgugaagcucaaaaaugucggcgacuucaucaaguaugaguacgaucagcgggugcaagccuuccucaaauacgaagagaacaucgaauggcaggccuuucugauuaaggagagcaaggaagaggagaauuauccuuacguuguggaacgcgagaucgaacaguaugagaaagucagacgggaggaacugcucaaggaggugcaucugauugaagaguacauccuugaaaaagugaaggacaaagagauucugaagaagggagauaaccagaauuucaaauauuacauccucaacggccugcugaagcaacuuaaaaaugaggacgucgaauccuauaagguuuuuaaccugaacaccgagcccgaagaugugaauaucaaccagcucaaacaggaggcuacggaccuggaacagaaggcguucgugcucaccuacauugccaauaaguuugcugccaaccaacugccuaaaaaggaguucugggauuacugccaggagaaauaugggaagaucgaaaaagagaagacauacgccgaauauuuugcugaggucuucaagaaagaaaaggaggcccuuauuaaauga

SEQ ID NO: 11402 - RNA, 3384 nt, Artificial Sequence
  Cas13b variant__Prevotella buccae__WP_004343973.1__Cas13b
augcagaagcaagacaaacuguucguggauagaaagaaaaacgccaucuuugcuuuccccaaguacauuacaaucauggagaauaaagaaaagccugagccgauuuauuacgaacucacagacaagcacuuuugggccgcguuccugaaccuugcucggcauaaugucuauacgaccaucaaccacauuaaucgcagacuggagaucgccgaacucaaagaugacggcuacaugauggggaucaagggaagcuggaacgagcaggccaaaaagcuggauaaaaagguucggcuucgcgaccugauuaugaagcauuuucccuuccucgaggcugccgcuuaugaaaugacaaauuccaaaucuccuaacaauaaggagcagagagaaaaagagcagagcgaggcccugucccugaacaaucucaagaacgugcuguuuaucuuccuugaaaaacugcaagugcuccggaauuacuauucucacuacaaguacagcgaggaaucccccaaaccuauuuuugagaccucucugcuuaagaacauguauaaggucuucgaugcgaaugugcgccugguuaaaagagacuacaugcaucacgaaaacaucgauaugcagcgggacuuuacacaccucaaccgcaagaaacaggugggcagaaccaagaauauuaucgauagccccaacuuccauuaucacuuugccgacaaagaggggaauaugacaauugcuggacugcuguucuucgucucccucuuucuggauaagaaggacgccaucuggaugcagaaaaagcugaaaggcuucaaggacgggcggaaccuucgcgagcaaaugaccaaugaaguguuuugcagaagccggaucucucucccuaaacugaaacuugagaacguucagacgaaggauuggaugcagcuggacaugcucaaugaacuggugcgcuguccgaaaucccuguacgagagacuccgggaaaaggauagagagagcuucaaaguccccuuugacauuuucucugaugacuauaacgcugaggaggaaccuuuuaagaauacccuggugcgccaucaggaucgguuccccuacuuugugcuuagauauuucgaccugaacgaaaucuuugagcaacuccgcuuccagauugaucugggaacauaccacuuuuccaucuacaauaaacggauuggcgacgaagaugaggucagacaccuuacccaucaccuguauggcuucgcccgcauccaggacuucgcgccucaaaaccagcccgaggaauggcggaagcucguuaaggaccuggaucauuuugagacaagccaggaaccguacaucucuaaaaccgccccucacuaucaucuggagaaugagaagauugggaucaaauucugcuccgcucacaacaaucucuuucccagccugcagacggacaagacauguaacggaagauccaaauucaaccuuggcacccaauuuacagccgaagcguuccugucugugcacgagcuccugccuaugauguuuuacuaucugcuucucaccaaggauuacagccgcaaagaauccgccgacaagguggaggggauuauccggaaggaaauuagcaauaucuaugccaucuacgaugcuuucgcgaacaaugagauuaacucuaucgccgaccugaccagacgccugcagaauacaaacauucuccagggacaucugcccaaacagaugaucuccauucuuaagggccggcaaaaagauauggggaaggaggcugaaagaaaaaucggagagaugauugacgauacgcagcggcgccuggaccuccugugcaagcagaccaaucagaagaucagaaucggcaaacggaacgccggccugcuuaagagcgggaaaauugccgauuggcucgucaaugacaugaugagauuucaacccgugcagaaggaucagaacaauaucccuauuaacaauucuaaagcuaacagcacagaauaccgcaugcugcagcgggcccuggcucucuucggauccgagaauuuuagacugaaggcuuauuucaaccaaaugaaccuuguuggcaaugacaacccgcaccccuuucuggccgaaacccagugggagcaucagacaaauauccucucuuucuaccgcaacuaucuggaggccagaaagaaauaccugaaggggcuuaaaccucaaaauuggaagcaguaucagcacuuccucauucugaaagugcagaagaccaaccggaauacgcuggucacaggauggaagaacagcuuuaaucucccccgcggcaucuucacccaaccuaucagagaaugguuugagaaacacaacaauuccaagcggauuuacgaccagauccugagcuucgaucgcgugggguuuguugcuaaagccauuccccuuuauuucgcugaagaguacaaggacaacgugcagccguuuuacgauuauccuuucaauaucggaaacagacugaaacccaagaaacggcaguuucucgacaagaaggaacgcgucgagcuguggcaaaagaauaaggagcuguucaaaaacuacccuucugaaaagaaaaagaccgaucuugccuaucucgacuuucuguccuggaagaaauucgagagagaacugcggcucauuaagaaccaggauaucgugacauggcugauguucaaagagcuuuuuaauauggcgaccgucgagggccugaagaucggcgaaauucaucuccgcgacaucgauacaaacacggccaaugaggaaagcaacaauauucugaacagaaucaugcccaugaaacugccugugaagaccuacgagacagacaauaaggggaacauucuuaaagaacggccccuggcuaccuucuauaucgaggagacagaaaccaagguucucaaacagggaaauuuuaaggcccuggugaaagauagacgccucaacggccuguucucuuuugcugagacgaccgaccuuaaucuggaggaacacccgaucuccaagcucagcgucgaucuggaacugauuaaguaccagacaacccggaucuccauuuucgagaugacacuugggcuggagaaaaagcucaucgacaaauauucuacccugccuacggacagcuuuagaaacaugcucgaacgcuggcugcaauguaaggccaaucggcccgagcuuaaaaacuacguuaauucccugauugcggugagaaacgccuucucucauaaucaguaccccauguaugaugcuacacucuuugccgaagugaagaaguucacccuguuuccuagcgucgacaccaaaaagaucgagcugaacauugcuccgcagcuucuggaaaucgugggaaaagccaucaaggagauugagaaauccgaaaacaagaauuga

SEQ ID NO: 11403 - RNA, 3273 nt, Artificial Sequence
  Cas13b variant__Prevotella sp.__WP_044065294__Cas13b
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggagaaaacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaaccauuacaagacauacgaggagaaacugaaugauggaugcgaauuucugaccucuacagagcagccucucagcggcaugaucaacaacuauuacaccgucgcucugcgcaauaugaacgaaagauauggguacaagacagaggaccuugccuucauucaagauaagcgguuuaaauucgugaaggacgcuuauggaaagaagaaaucccagguuaauaccggcuuuuuccugucucuccaggauuacaacggcgacacgcagaagaaacugcaccuuagcggggugggaaucgcccugcucauuugucuguuucuggauaagcaauauaucaauauuuuccucucccgccugcccaucuucagcucuuacaacgcgcaguccgaagagagacggauuaucauccgcagcuuuggcauuaauucuaucaaacuuccuaaagaccggauucauuccgaaaagagcaacaaaucugucgccauggauaugcugaaugaagugaagagaugccccgacgaacucuucaccacacuguccgcugaaaaacagagccgcuuuagaaucauuuccgacgaucacaacgaggugcuuaugaagcggucuagcgaccgcuucgucccucugcuccugcaauacaucgauuaugggaagcuguuugaccacaucagauuccauguuaauaugggaaaacuccgguaccugcuuaaggccgauaaaaccuguauugacggccagacaagagugcgcgugaucgaacagccgcugaacggguuuggacggcucgaggaggcugaaaccaugagaaagcaggagaauggcacguucggcaacuccgggauucgcauccgggauuuugaaaauaugaaaagagacgaugccaaccccgcgaacuauccuuacauugucgacacauauacccacuacauccuggagaauaacaagguggaaauguucaucaaugauaaggaggacagcgcuccccuucugccuguuauugaggacgaucgcuauguggucaaaacaauccccucuugccggauguccacccucgaaauuccggcuauggccuuucauauguuccuguuuggaagcaagaaaaccgagaagcugaucguggacguucacaacagauacaaacgccucuuccaagcuaugcagaaggaagaggugacagccgagaauauugccucuuucggcaucgcugaaagcgaucugccucagaagauucuugaccugaucuccgggaacgcgcacggaaaagaugucgacgccuuuauccggcucacgguggaugacaugcugaccgauacagagagacgcauuaagcgguucaaagacgauagaaagucuauccggagcgcugacaauaaaaugggcaagcgcggguuuaaacagauuuccaccggaaagcuggccgauuuccuugccaaggacaucguccucuuucaacccagcgugaacgacggcgaaaauaaaauuacaggccugaacuacagaaucaugcagucugcuaucgccguuuaugauuccggggacgauuacgaggcgaagcagcaguucaaacugauguuugaaaaggcucggcucauuggaaaaggcaccacggagccucaucccuuccuguauaagguguuugccagaagcauccccgccaaugcugucgaguucuacgaacgcuaucuuauugagcggaaguuuuaccugacagggcucucuaacgaaaucaaaaagggaaauagaguggacguuccuuucauucgcagagaucaaaacaaauggaagaccccggccaugaaaacccugggccggaucuauuccgaggaccugcccguggaacuuccucgccagauguuugauaaugagaucaagagccaccucaagucccugccccagauggaggggauugacuucaacaacgcuaaugucacauaccugaucgccgaauacaugaaaagagugcucgaugacgauuuccagaccuuuuaucaauggaaccggaauuaccgcuauauggacaugcugaagggcgaguacgauagaaaaggaucucuucagcauuguuucacaagcguggaggagcgggaaggccuguggaaggagcgcgcguccagaacggagcgguaucgcaaacaggccucuaacaagauuagaagcaaucggcaaaugagaaacgcuuccagcgaagagaucgaaaccauucucgacaagcgccugucuaauucccggaacgaguaccagaaaagcgagaagguuaucagacgcuaucggguccaggacgcccugcuuuuucuccuggcuaaaaagacacugaccgaacucgccgauuucgacggggagagauuuaaacugaaggaaaucaugccugaugcggagaaaggcauucuuucugaaaucaugcccauguccuucacauuugagaagggagggaagaaauacaccauuacgagcgagggaaugaagcugaaaaauuacggcgacuucuuugugcucgccucugauaagcgcaucgggaaccugcuggaacuugugggcagcgacauugucuccaaagaggauaucauggaagaguucaauaaguaugaccagugccggccggaaauuagcucuaucguguuuaaccucgagaagugggcuuucgauaccuacccugagcuguccgccagaguugaccgcgaagagaaaguggauuucaagagcauccugaaaauucuccugaauaacaagaauaucaacaaagaacaauccgacauucuucggaagaucagaaacgcuuuugaccacaauaacuaucccgauaagggagucguggagauuaaagcccugccugaaaucgccaugucuaucaagaaagccuucggcgaguacgcgauuaugaaguga

SEQ ID NO: 11404 - RNA, 4152 nt, Artificial Sequence
  Cas13b variant__Artificial____PspCas13b-GS-HsADAR2DD(E488Q,del984-1090)
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggaaaagacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaacgcuuacaagacauacgaggagaaacugaaugauggaugcgaauuucugaccucuacagagcagccucucagcggcaugaucaacaacuauuacaccgucgcccugcgcaauaugaacgaaagauauggguacaagacagaggaccuugcuuucauucaagauaagcgguuuaaauucgugaaggacgccuauggcaaaaagaaaucccagguuaauaccggauuuuuccugucucuccaggauuacaacggcgacacgcagaagaaacugcaucuuagcggggugggaaucgcgcugcucauuugucuguuucuggauaagcaauauaucaauauuuuccucucccgccugcccaucuucagcucuuacaacgcccaguccgaagagagacggauuaucauccgcagcuuuggcauuaauucuaucaaacuuccuaaagaccggauucacuccgaaaagagcaacaaaucugucgcuauggauaugcugaaugaagugaagagaugccccgacgaacucuucaccacacuguccgccgaaaaacagagccgcuuuagaaucauuuccgacgaucauaacgaggugcuuaugaagcggucuagcgaccgcuucgucccucugcuccugcaauacaucgauuaugggaagcuguuugaccacaucagauuccacguuaauaugggaaaacuccgguaccugcuuaaggcugauaaaaccuguauugacggccagacaagagugcgcgugaucgaacagccgcugaacggguuuggacggcucgaggaggccgaaaccaugagaaagcaggagaauggcacguucggcaacuccgggauucgcauccgggauuuugaaaauaugaaaagagacgaugcgaaccccgccaacuauccuuacauugucgacacauauacccauuacauccuggagaauaacaagguggaaauguucaucaaugauaaggaggacagcgcuccccuucugccuguuauugaggacgaucgcuauguggucaaaacaauccccucuugccggauguccacccucgaaauuccggccauggcuuuucacauguuccuguuuggaagcaagaaaaccgagaagcugaucguggacguucauaacagauacaaacgccucuuccaagccaugcagaaggaagaggugacagccgagaauauugcuucuuucggcaucgcggaaagcgaucugccucagaagauucuugaccugaucuccgggaacgcccacggaaaagaugucgacgcuuuuauccggcucacgguggaugacaugcugaccgauacagagagacgcauuaagcgguucaaagacgauagaaagucuauccggagcgccgacaauaaaaugggcaagcgcggguuuaaacagauuuccaccggaaagcuggccgauuuccuugcuaaggacaucguccucuuucaacccagcgugaacgacggcgaaaauaaaauuacaggccugaacuacagaaucaugcagucugccaucgcgguuuaugauuccggggacgauuacgaggcuaagcagcaguucaaacugauguuugaaaaggcccggcucauuggaaaaggcaccacggagccucaccccuuccuguauaagguguuugccagaagcauccccgcuaaugccgucgaguucuacgaacgcuaucuuauugagcggaaguuuuaccugacagggcucucuaacgaaaucaaaaagggaaauagaguggacguuccuuucauucgcagagaucaaaacaaauggaagaccccggcuaugaaaacccugggccggaucuauuccgaggaccugcccguggaacuuccucgccagauguuugauaaugagaucaagagccaucucaagucccugccccagauggaggggauugacuucaacaacgccaaugucacauaccugaucgcggaauacaugaaaagagugcucgaugacgauuuccagaccuuuuaucaauggaaccggaauuaccgcuauauggacaugcugaagggcgaguacgauagaaaaggaucucuucagcacuguuucacaagcguggaggagcgggaaggccuguggaaggagcgcgccuccagaacggagcgguaucgcaaacaggcuucuaacaagauuagaagcaaucggcaaaugagaaacgccuccagcgaagagaucgaaaccauucucgacaagcgccugucuaauucccggaacgaguaccagaaaagcgagaagguuaucagacgcuaucggguccaggacgcucugcuuuuucuccuggccaaaaagacacugaccgaacucgcggauuucgacggggagagauuuaaacugaaggaaaucaugccugaugccgagaaaggcauucuuucugaaaucaugcccauguccuucacauuugagaagggagggaagaaauacaccauuacgagcgagggaaugaagcugaaaaauuacggcgacuucuuugugcucgcuucugauaagcgcaucgggaaccugcuggaacuugugggcagcgacauugucuccaaagaggauggaagccuccagcugccgccucuggaacggcucacccugggcucucaacuucaucugccccaggugcucgccgacgcuguuuccagacuggugcuggggaaguucggagaucuuacagacaauuuuagcuccccucacgcccgccggaagguccuggccggcgugguuaugaccacagggaccgaugugaaagacgcuaaggucaucucugugagcacgggaacaaaaugcauuaacggcgaguauauguccgacagagggcucgcgcugaaugauugucaugccgaaaucaucucucggcgcagccuccugagauuccuuuacacccagcuggagcucuaucugaacaauaaggacgaucagaaacgguccauuuuccaaaagucugagcgcggcggauuuagacugaaggaaaacguucaguuccaccuuuacaucagcacaucccccugcggcgacgcucggauuuuuagcccucacgagcccauccuggaggagccggccgauagacauccuaaccgcaaagcccgggggcagcucagaaccaagauugaaucuggacagggcaccauccccgugcgcuccaaugcuagcauccaaacaugggacgggguccugcagggagagcggcuccugacgaugucuuguuccgauaaaauugccagauggaacguggugggcauccaggggagccuucugucuauuuucgucgagcccaucuauuuuuccagcauuauccucggcucccuguaccacggagaccaucugagccgcgcgauguaucaacggaucucuaauauugaagaucuuccuccgcuguacacccucaacaagccccugcucagcggcaucuccaaugcugaggccagacagccugggaaagcccccaacuucucuguuaauuggacagugggagacagcgcuauugaagugaucaacgccaccacaggcaaggaugagcuggggcgcgcguccagacuuugcaagcacgcucuguacugucgguggaugcgcguccacggaaaagugccuucucaucugcucagaagcaagauuaccaaacccaauguuuaucacgaguccaagcuggccgccaaagaauaccaggcugccaaggcucggcuuuuuacggccuucaucaaggcgggccugggcgccuggguggagaaaccuacagaacaggaccaauuuucucucaccuga

SEQ ID NO: 11405 - RNA, 4152 nt, Artificial Sequence
  Cas13b variant__Artificial____PspCas13b-GS-HsADAR2DD(E488Q,T375G,del984- 1090)
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggaaaagacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaacgcuuacaagacauacgaggagaaacugaaugauggaugcgaauuucugaccucuacagagcagccucucagcggcaugaucaacaacuauuacaccgucgcccugcgcaauaugaacgaaagauauggguacaagacagaggaccuugcuuucauucaagauaagcgguuuaaauucgugaaggacgccuauggcaaaaagaaaucccagguuaauaccggauuuuuccugucucuccaggauuacaacggcgacacgcagaagaaacugcaucuuagcggggugggaaucgcgcugcucauuugucuguuucuggauaagcaauauaucaauauuuuccucucccgccugcccaucuucagcucuuacaacgcccaguccgaagagagacggauuaucauccgcagcuuuggcauuaauucuaucaaacuuccuaaagaccggauucacuccgaaaagagcaacaaaucugucgcuauggauaugcugaaugaagugaagagaugccccgacgaacucuucaccacacuguccgccgaaaaacagagccgcuuuagaaucauuuccgacgaucauaacgaggugcuuaugaagcggucuagcgaccgcuucgucccucugcuccugcaauacaucgauuaugggaagcuguuugaccacaucagauuccacguuaauaugggaaaacuccgguaccugcuuaaggcugauaaaaccuguauugacggccagacaagagugcgcgugaucgaacagccgcugaacggguuuggacggcucgaggaggccgaaaccaugagaaagcaggagaauggcacguucggcaacuccgggauucgcauccgggauuuugaaaauaugaaaagagacgaugcgaaccccgccaacuauccuuacauugucgacacauauacccauuacauccuggagaauaacaagguggaaauguucaucaaugauaaggaggacagcgcuccccuucugccuguuauugaggacgaucgcuauguggucaaaacaauccccucuugccggauguccacccucgaaauuccggccauggcuuuucacauguuccuguuuggaagcaagaaaaccgagaagcugaucguggacguucauaacagauacaaacgccucuuccaagccaugcagaaggaagaggugacagccgagaauauugcuucuuucggcaucgcggaaagcgaucugccucagaagauucuugaccugaucuccgggaacgcccacggaaaagaugucgacgcuuuuauccggcucacgguggaugacaugcugaccgauacagagagacgcauuaagcgguucaaagacgauagaaagucuauccggagcgccgacaauaaaaugggcaagcgcggguuuaaacagauuuccaccggaaagcuggccgauuuccuugcuaaggacaucguccucuuucaacccagcgugaacgacggcgaaaauaaaauuacaggccugaacuacagaaucaugcagucugccaucgcgguuuaugauuccggggacgauuacgaggcuaagcagcaguucaaacugauguuugaaaaggcccggcucauuggaaaaggcaccacggagccucaccccuuccuguauaagguguuugccagaagcauccccgcuaaugccgucgaguucuacgaacgcuaucuuauugagcggaaguuuuaccugacagggcucucuaacgaaaucaaaaagggaaauagaguggacguuccuuucauucgcagagaucaaaacaaauggaagaccccggcuaugaaaacccugggccggaucuauuccgaggaccugcccguggaacuuccucgccagauguuugauaaugagaucaagagccaucucaagucccugccccagauggaggggauugacuucaacaacgccaaugucacauaccugaucgcggaauacaugaaaagagugcucgaugacgauuuccagaccuuuuaucaauggaaccggaauuaccgcuauauggacaugcugaagggcgaguacgauagaaaaggaucucuucagcacuguuucacaagcguggaggagcgggaaggccuguggaaggagcgcgccuccagaacggagcgguaucgcaaacaggcuucuaacaagauuagaagcaaucggcaaaugagaaacgccuccagcgaagagaucgaaaccauucucgacaagcgccugucuaauucccggaacgaguaccagaaaagcgagaagguuaucagacgcuaucggguccaggacgcucugcuuuuucuccuggccaaaaagacacugaccgaacucgcggauuucgacggggagagauuuaaacugaaggaaaucaugccugaugccgagaaaggcauucuuucugaaaucaugcccauguccuucacauuugagaagggagggaagaaauacaccauuacgagcgagggaaugaagcugaaaaauuacggcgacuucuuugugcucgcuucugauaagcgcaucgggaaccugcuggaacuugugggcagcgacauugucuccaaagaggauggaagccuccagcugccgccucuggaacggcucacccugggcucucaacuucaucugccccaggugcucgccgacgcuguuuccagacuggugcuggggaaguucggagaucuuacagacaauuuuagcuccccucacgcccgccggaagguccuggccggcgugguuaugaccacagggaccgaugugaaagacgcuaaggucaucucugugagcacgggaggcaaaugcauuaacggggaguauauguccgacagaggccucgcgcugaaugauugucaugccgaaaucaucucucggcgcagccuccugagauuccuuuacacacagcuggagcucuaucugaacaauaaggacgaucagaaacgguccauuuuccaaaagucugagcgcggaggcuuuagacugaaggaaaacguucaguuccaccuuuacaucagcaccucccccugcggggacgcucggauuuuuagcccucacgagcccauccuggaggagccggccgauagacauccuaaccgcaaagcccggggacagcucagaacaaagauugaaucuggccaggggaccauccccgugcgcuccaaugcuagcauccaaaccugggacggaguccugcagggcgagcggcuccugacaaugucuuguuccgauaaaauugccagauggaacgugguggggauccagggcagccuucugucuauuuucgucgagcccaucuauuuuuccagcauuauccucggaucccuguaccacggcgaccaucugagccgcgcgauguaucaacggaucucuaauauugaagaucuuccuccgcuguacacgcucaacaagccccugcucagcgggaucuccaaugcugaggccagacagccuggaaaagcccccaacuucucuguuaauuggaccgugggcgacagcgcuauugaagugaucaacgccacaaccgggaaggaugagcugggacgcgcguccagacuuugcaagcacgcucuguacugucgguggaugcgcguccacggcaaagugccuucucaucugcucagaagcaagauuacaaaacccaauguuuaucacgaguccaagcuggccgccaaagaauaccaggcugccaaggcucggcuuuuuaccgccuucaucaaggcgggccugggggccuggguggagaaaccuacggaacaggaccaauuuucucucacauga

SEQ ID NO: 11406 - RNA, 2862 nt, Artificial Sequence
  Cas13b variant__Alistipes sp.__WP_047447901.1__Cas13b
augagcaacgagaucggcgccuucagagaacaccaguuugcuuacgcccccgggaaugagaagcaagaagaggcgaccuucgcuacauauuuuaaccuggcccucuccaauguggaaggaaugauguucggcgaggucgagucuaacccugacaaaauugaaaagagccuggauacgcuuccgcccgccauccugcggcagauugcuuccuuuaucuggcucucuaaagaggaccauccugauaaggccuacagcaccgaagagguuaaagugauugugacagaccugguccgcagacuuugcuucuaucggaauuacuuuucccacuguuucuaucuggauacccaguacuuuuauucugacgagcucguggauacaaccgcuaucggggaaaagcugcccuacaacuuccaucacuuuaucacaaaucgccuguucagauacagccucccugagauuacccuguuucgguggaacgaaggagagcgcaaguaugaaauccuuagagacggccugauuuucuucugcugucucuuucugaaacgggggcaggccgagcgcuuccuuaaugagcugagauuuuucaagcggacggaugaagagggacgcaucaaaagaaccauuuuuacaaaguacugcacccgggaaucccauaaacacaucggcauugaggaacaagacuuccucaucuuucaggauaucauuggcgaccugaaccgcguucccaaggugugugauggggucguggaccugagcaaggagaaugagagauauaucaaaaaccgggaaacaucuaaugaguccgacgaaaacaaggcgagauaccgccuccugauucgggagaaagauaaguucccuuauuaccuuaugagauauaucguugacuuuggagugcugccgugcauuaccuucaaacagaaugauuacagcacgaaggaaggccgcgggcaguuucacuaccaagacgccgcugucgcccaggaggagcgguguuauaacuucguggugagaaacggaaaugucuacuauucuuacaugccccaggcucagaacguugugcgcaucuccgaacuccaaggcacaaucagcguggaggaacugcggaauauggucuaugccucuauuaacgggaaagaugugaauaaguccguugagcaguaccuuuaucaucugcaccuccuguacgagaagauccugaccauuagcggacagacaaucaaagaaggcagaguggacgucgaggauuaccgcccucuccuggacaaacuucugcuccggcccgcguccaacggcgaagaacugagacgcgaacuucggaagcugcucccuaagagagugugcgaucugcugucuaaucgguuugacuguagcgaggggguuuccgccguggagaaacgccucaaggcuauucugcuuagacaugaacaacugcuccugagccagaaccccgcccugcacaucgauaagaucaaaucugucauugacuaucuuuaccucuucuucuccgacgaugagaaguuucggcagcagccgaccgaaaaagcucacagaggacugaaggacgaggaguuccaaauguaucauuaccuggugggcgauuaugacagccacccucucgcccuguggaaagagcuugaggccucugggcgccugaagcccgaaaugcggaagcucaccagcgcuacaucccugcauggacuguacaugcuuugccucaaaggcacggucgagugguguagaaagcagcugaugucuaucgggaaaggaaccgcgaagguggaagccauugcugaucgcguuggccugaaacucuaugacaagcugaaggaguacacaccugaacagcuugagagagaggugaaacuggucgugaugcacggcuacgccgccgcugccacccccaagcccaaagcgcaggcugccaucccuagcaagcucacagaacugcgguuuuauuccuuccuggggaaacgcgagaugagcuuugccgcuuucauuagacaagauaagaaagcccagaaacuuuggcuccggaauuuuuacaccguugaaaacaucaagacgcugcagaagcgccaggcugccgcggacgccgcuugcaagaaacuguauaaucucgugggagaggucgagagagugcauacaaacgauaaggugcugguucuugucgcccaacgguaccgcgaaagacugcucaaugugggcucuaaaugcgcugugacccuggacaacccggagcggcagcagaagcuggccgaugucuaugaagugcagaaugcguggcuuuccauucgcuucgacgaucucgacuuuacccugacacacguuaaccugagcaaccucagaaaggccuacaaucugaucccccggaaacacauccuugcuuucaaggaguaucuggacaacagagugaaacaaaagcucugugaagagugccgcaauguccggagaaaagaggaucuguguaccugcuguucuccucgcuacuccaaccugacaagcuggcuuaaggaaaaucauuccgagucuagcauugaacgggaggccgcuacgaugaugcugcucgacguggaaagaaagcugcucuccuuucugcuugaugagcgccggaaagccaucauugaguacgggaaguucauccccuuuucugcccugguuaaagaaugcagacucgcugacgcgggacuguguggcauucgcaacgaugugcugcacgacaaugucaucagcuaugccgaugcuaucgggaaacuuuccgccuacuucccuaaggaggccagcgaagcuguggaguauauucggagaaccaaggaaguucgggagcagcgcagagaggaacugauggccaacucuucccaguga

SEQ ID NO: 11407 - RNA, 3348 nt, Artificial Sequence
  Cas13b variant__Bacteroides pyogenes__ERI81700.1__Cas13b
auggagagcaucaagaacucccagaaaucuaccggcaagacacugcaaaaagaucccccuuacuucgggcucuaucugaauauggcccuucugaacgugagaaaggucgaaaaucacauucggaaauggcucggagacguugcucugcuuccggaaaagagcggcuuucauucccugcucacgaccgacaaccugucuagcgccaaguggacacgcuucuacuauaaauccagaaaguuucugcccuuccucgaaauguuugauucugacaaaaagagcuacgagaaucggcgcgaaaccacagagugccuggauaccaucgacagacagaaaauuuccagccuucugaaggagguguaugggaagcuccaggauauccggaacgcguucucucacuaccauauugacgaucaguccgugaaacacacagcucugaucaucagcucugaaaugcaucgcuuuauugagaaugccuauuccuucgcccuucaaaagaccagagcucgguuuacgggagucuucguggaaaccgacuuucugcaggccgaggagaaaggcgauaacaagaaauucuuugcuaucgggggaaaugaaggcauuaagcucaaagacaacgcccugaucuuccugauuugucucuuccuggaucgcgaggaagcguuuaaguuccuuagcagagccacaggcuuuaagucuaccaaagagaagggguuccuggcuguucgggaaacauuuugcgcccucuguugccgccagccucacgagagacugcuuuccgugaauccccgggaggcucugcucauggacaugcugaacgaacugaaucgcuguccugacauccucuucgagaugcuggaugaaaaagaccaaaagagcuuucuuccccugcucggagaggaggagcaggcccacauucuggagaacucccuuaaugaugaacugugcgaggcgaucgacgauccuuucgaaaugaucgccucucucagcaaaagaguccgguacaagaacagauuuccguaccugaugcugcgcuauauugaggaaaagaaccuccugcccuucauccgguuuagaauugaccuuggcugucuggagcucgcuuccuacccuaaaaagaugggggaggaaaauaacuaugagcgcagcgugaccgaucaugccauggcuuucggacggcugacggacuuucacaaugaagaugccguucugcagcagaucacaaaaggcauuaccgacgaggugagauucucucuuuacgcuccccgcuaugccaucuacaacaauaagaucggguucguccggacaggaggcuccgauaaaauuagcuuuccuacccucaagaagaaaggcggggagggacauugcguggcguauacccugcagaacacaaagucuuucggcuuuaucagcauuuacgaccugagaaaaauccuccugcuuuccuuccuggacaaggauaaagccaagaauauugugucugggcuccuggaacaaugugagaagcacuggaaagaccugagcgaaaaccuuuuugaugcuauccgcacggagcuccagaaggaguuccccgucccgcugauccgguacacccugccuagauccaaaggaggcaagcucguuagcucuaaacuggccgacaagcaggaaaaauaugaguccgaauuugagcgccggaaggaaaaacuuacagagauucugagcgaaaaagauuucgaccucucucaaauccccagacggaugauugaugaguggcugaaugugcugccuaccucccgcgagaagaaacuuaagggguacguggaaacacucaaacuggacugcagagagcggcugagagucuuugaaaagcgcgagaagggagaacaccccgugcccccucggaucggcgagauggccaccgaucucgcuaaagacauuaucagaaugguuauugaucagggcgugaagcagcgcaucacgagcgccuauuacuccgagauccagagaugucuggcgcaauaugcuggggacgauaaccggcgccaucuugacucuauuaucagagaacugcggcucaaagacacaaagaauggacacccguuccugggcaaaguccugcgccccgggcuuggacauaccgagaagcucuaccagagauauuuugaagagaagaaagaguggcuggaagccaccuucuacccugccgcuagccccaagcgggugccucgcuuuguuaaucccccgacaggcaaacagaaggagcugccucucauuaucagaaaccugaugaaagaacggcccgaguggcgcgauuggaagcagagaaagaacucccacccuauugaccuucccucucaacuguucgaaaaugagaucugccggcuccugaaagauaagaucgggaaagagccuagcggcaagcugaaauggaacgaaauguucaaacuuuacugggacaaggaguuucccaacggaaugcagagauucuaucgcugcaagcggagaguggaagucuuugauaagguggucgaguacgaauauuccgaggagggcgggaauuacaaaaaguauuacgaagcccugauugacgaggugguucgccagaaaaucucuagcuccaaggaaaagagcaagcuccagguggaggaucugacccucucuguccggagaguguucaagcgcgcuauuaacgaaaaagaguaucaacugcggcuucugugugaggacgauagacuccuguuuauggccguucgcgaccuguacgauuggaaggaagcgcagcuugaccuggauaaaaucgacaauaugcucggagagccgguguccgucagccaggugauucagcuggaaggcgggcaaccugacgccgugaucaaggcugagugcaaacucaaggauguuucuaagcugaugcgguacuguuaugacggaagagucaaaggccuuaugcccuacuucgccaaccaugaggcuacacaggaacagguggagauggaacugcggcacuaugaggaucaccgcagacggguguuuaauugggucuucgcccucgaaaagagcgugcugaaaaacgagaagcugcgcagauuuuacgaggaaucccaagggggcugcgagcaucggagauguaucgacgcgcuucgcaaagccagccugguuucugaagaggaauaugaguuccucgugcacauucggaauaaguccgcucauaaccaguuucccgaucuggagaucggaaagcucccuccgaaugucacgagcggcuucugcgaauguauuugguccaaauacaaggccaucauuugcagaaucauccccuucauugacccugagcgccgguuuuucgggaaacugcuugaacagaaguga

SEQ ID NO: 11408 - RNA, 3348 nt, Artificial Sequence
  Cas13b variant__Bacteroides pyogenes__WP_034542281.1__Cas13b
auggagagcaucaagaacucccagaaaucuaccggcaagacacugcaaaaagaucccccuuacuucgggcucuaucugaauauggcccuucugaacgugagaaaggucgaaaaucacauucggaaauggcucggagacguugcucugcuuccggaaaagagcggcuuucauucccugcucacgaccgacaaccugucuagcgccaaguggacacgcuucuacuauaaauccagaaaguuucugcccuuccucgaaauguuugauucugacaaaaagagcuacgagaaucggcgcgaaaccgcggagugccuggauacaaucgacagacagaaaauuuccagccuucugaaggagguguaugggaagcuccaggauauccggaacgcuuucucucacuaccauauugacgaucaguccgugaaacacaccgcccugaucaucagcucugaaaugcaucgcuuuauugagaaugccuauuccuucgcccuucaaaagacaagagcucgguuuaccggagucuucguggaaacggacuuucugcaggcugaggagaaaggcgauaacaagaaauucuuugccaucgggggaaaugaaggcauuaagcucaaagacaacgcgcugaucuuccugauuugucucuuccuggaucgcgaggaagccuuuaaguuccuuagcagagcuaccggcuuuaagucuacaaaagagaagggguuccuggccguucgggaaaccuuuugcgcucucuguugccgccagccucacgagagacugcuuuccgugaauccccgggaggcccugcucauggacaugcugaacgaacugaaucgcuguccugacauccucuucgagaugcuggaugaaaaagaccaaaagagcuuucuuccccugcucggagaggaggagcaggcgcacauucuggagaacucccuuaaugaugaacugugcgaggccaucgacgauccuuucgaaaugaucgcuucucucagcaaaagaguccgguacaagaacagauuuccguaccugaugcugcgcuauauugaggaaaagaaccuccugcccuucauccgguuuagaauugaccuuggcugucuggagcucgccuccuacccuaaaaagaugggggaggaaaauaacuaugagcgcagcgugacagaucaugcuauggccuucggacggcugaccgacuuucacaaugaagaugccguucugcagcagaucacgaaaggcauuacagacgaggugagauucucucuuuacgcuccccgcuaugcgaucuacaacaauaagaucggguucguccggaccuccggaagcgauaaaauuucuuuuccuacacucaagaagaaaggcggcgaggggcauugcguggccuauacccugcagaacaccaagagcuucggauuuaucuccauuuacgaccugagaaaaauccuccugcuuucuuuccuggacaaggauaaagcuaagaauauugugagcggccuccuggaacaaugugagaagcacuggaaagaccuguccgaaaaccuuuuugaugccauccgcacagagcuccagaaggaguuccccgucccgcugauccgguacacgcugccuagaagcaaagggggaaagcucguuucuuccaaacuggccgacaagcaggaaaaauaugagagcgaauuugagcgccggaaggaaaagcucaccgagauucugucugaaaaagauuucgaccucucccaaauccccagacggaugauugaugaguggcugaaugugcugccuacaagccgcgagaagaaacuuaagggcuacguggaaacccucaaacuggacugcagagagcggcugagagucuuugaaaagcgcgagaagggggaacacccccuucccccucggaucggagagauggcuacagaucuggccaaagacauuaucagaauggugauugaucagggcguuaagcagcgcaucaccuccgcguauuacucugagauccagagaugucuugcucaauaugccggcgacgauaaccggcgccaucuggacagcauuaucagagaacuccggcugaaagacacgaagaaugggcacccguuccugggaaaagugcuucgccccggccucgggcauacagagaagcuguaccagagauauuuugaagagaagaaagaguggcuggaagccaccuucuacccugcugccucccccaagcgggucccucgcuuugugaaucccccgaccggaaaacagaaggagcucccucugauuaucagaaaccuuaugaaagaacggcccgaguggcgcgauuggaagcagagaaagaacucucacccuauugaccugcccagccaacucuucgaaaaugagaucugccggcugcugaaagauaagaucggcaaagagccuuccgggaaacuuaaauggaacgaaauguucaagcuguacugggacaaagaguuucccaacggcaugcagagauucuaucgcugcaagcggagaguugaaguguuugauaaggucguggaguacgaauauagcgaggagggaggcaauuacaaaaaguauuacgaagcucucauugacgaggucgugcgccagaaaaucucuuccagcaaggaaaaaucuaagcugcagguugaggaucucacacuguccgugcggagagucuucaagcgcgccauuaacgaaaaagaguaucaacuucggcugcucugugaggacgauagacugcuguuuauggcggugcgcgaccuuuacgauuggaaggaagcccagcuggaccucgauaaaaucgacaauaugcugggggagccgguuagcgugucucaggucauucagcucgaaggaggccaaccugacgcugugaucaaggccgagugcaaacugaaggaugugagcaaacuuaugcgguacuguuaugacgggagaguuaagggacugaugcccuacuucgcuaaccaugaggccacccaggaacaggucgagauggaacuccggcacuaugaggaucaccgcagacggguguuuaauuggguguucgcgcuggaaaaguccguccugaaaaacgagaaacuucgcagauuuuacgaggaaagccaaggcgggugcgagcaucggagauguaucgacgcccugcgcaaggcuucucucguguccgaagaggaauaugaguuccugguucacauucggaauaagagcgcccauaaccaguuucccgaucucgagaucggcaagcugccuccgaaugugacauccggauucugcgaauguauuuggucuaaguacaaggcuaucauuugcagaaucauccccuucauugacccugagcgccgguuuuucggcaaacuucuggaacagaaguga

SEQ ID NO: 11409 - RNA, 3675 nt, Artificial Sequence; identical to SEQ ID NO: 11400
  Cas13b variant__Bergeyella zoohelcum__WP_002664492.1__Cas13b

SEQ ID NO: 11410 - RNA, 3600 nt, Artificial Sequence
  Cas13b variant__Capnocytophaga canimorsus__WP_013997271.1__Cas13b
augaagaacauccagagacugggcaaagggaaugaguucagccccuuuaagaaagaagacaaguucuacuuuggaggcuuccucaaccuggccaauaacaauauugaggacuuuuucaaagaaaucauuacccgguuugggaucgugauuacagaugagaacaagaagccuaaagaaacguucggagagaagauccuuaaugagaucuuuaaaaaggauauuuccaucgucgacuaugaaaaauggguuaacauuuucgcugauuacuuuccguucaccaaguaucugucucucuaccuggaggaaaugcaauuuaagaaucgcgugaucugcuucagagacgugaugaaagagcuucugaagacagucgaggcccuccggaacuucuauacccacuacgaucaugaacccauuaaaaucgaggaccgcguguuuuauuuccuggauaagguucugcucgacgugagccugacagucaaaaauaaguaccuuaaaaccgauaagacaaaggaauuucugaaccagcacauuggcgaggaacucaaagagcuguguaagcagagaaaagacuaccuuguggggaagggaaaacggaucgauaaggaguccgaaaucauuaauggcaucuauaacaaugcguucaaggacuuuauuugcaaacgcgagaagcaggacgauaaagaaaaccauaacucuguugagaagauccuguguaauaaagaaccucaaaacaagaagcagaaaagcuccgcuaccgugugggagcucugcucuaagagcuccagcaaauacacggagaagucuuuccccaauagagaaaacgacaaacacugucuggaggucccuauuucccagaagggcaucguguuucugcucagcuucuuucugaauaagggggaaaucuaugcccuuaccucuaacauuaaaggauucaaggccaaaaucacaaaggaggaacccgugaccuacgauaaaaauuccauucgguauauggcuacacaucgcauguuuagcuuccuggccuacaagggccucaaaagaaagauccggaccucugagauuaacuauaaugaggacgggcaggcuuccagcacguacgaaaaggagacacugaugcuucaaaugcuggaugaacucaacaaagucccugacguuguguaccagaaucuguccgaggaugugcagaagaccuuuaucgaggacuggaacgaauaucugaaagagaauaacggagaugucggcacaauggaagaggaacaggugauccacccgguuauucgcaagagauacgaggacaaauucaauuauuucgccauccgguuucucgaugaguucgcgcaauuucccacccugcgcuuccaggugcaccuugggaacuaccugugcgacaagagaaccaagcagauuugugacacaacgaccgaacgggaggucaaaaagaaaaucacaguguuuggaagacucucugaacuggagaacaagaaagccauuuuccuuaaugaacgcgaggagaucaagggcugggaaguuuuuccuaaccccagcuaugauuucccuaaggagaauauuuccgugaacuacaaagacuuucccaucgucggcagcauccuggaucgggaaaagcaaccggugucuaauaaaauugggaucagagucaagauugcugacgagcuccagcgcgaaaucgauaaagccauuaaggagaagaaacugcggaacccuaagaauagaaaagcuaaccaggacgagaagcagaaagaacgccuggugaaugagaucguuuccaccaacagcaaugaacaaggagagcccguggucuucaucggccagccuacagccuaucucucuaugaacgauauucauagcgugcuguacgaguuucuuaucaauaagauuuccggggaagcgcuggagaccaaaaucguugaaaagauugagacgcagaucaagcagaucauuggaaaagacgccacaaccaagauccucaaacccuacaccaacgcuaauucuaacagcauuaaccgggaaaagcugcugagagaucuugagcaagagcagcagauccucaaaacacugcuggaagaacagcaacagcgcgaaaaggacaagaaagauaagaaauccaagcggaaacacgagcucuaucccagcgaaaagggcaagguggccgucuggcuggcuaaugacauuaaaagauucaugccuaaggccuuuaaagagcaguggcgcggguaccaucacucucuucugcagaaguaucucgccuacuaugagcaauccaaagaggagcugaagaaccugcuuccgaaggaaguguucaaacacuuccccuuuaagcucaaaggauacuuccagcagcaauaucugaaucaguuuuacaccgauuaccugaagcggagacucagcuaugugaacgagcugcuucugaauauccagaacuucaaaaaugacaaggacgcucucaaggcgacagaaaaagagugcuuuaaguucuuucggaaacagaacuacaucauuaauccuaucaacauucaaauccagucuauucugguuuaucccaucuuccugaagcgcggcuuucuugaugagaaaccuacgaugauugacagagaaaaguucaaagagaauaaggauaccgaacucgccgacugguuuaugcauuacaagaacuauaaagaggauaauuaccagaaguucuaugcuuacccccuggagaaagucgaagagaaggaaaaauucaagcggaacaagcagaucaauaaacaaaagaaaaacgacguguacacacugaugaugguggaguauaucauucagaagaucuuuggcgauaaauucgucgaagagaacccgcucgugcugaaggggauuuuucaguccaaggccgagagacagcaaaauaacacccacgccgcuacaacccaggaacgcaaucuuaacggaauccugaaucagccuaaagacauuaagauccaaggcaaaaucacgguuaagggggugaaacucaaggauauuggaaacuuccggaaguacgagaucgaccagagagucaauaccuuucuggauuaugaaccccgcaaagaguggauggccuaccugccuaacgacuggaaggaaaaagagaagcagggccagcuucccccuaauaacgugauugauagacaaaucagcaaauaugagacaguucgguccaagauucuccugaaagacgugcaggaacuggagaagaucaucucugacgaaauuaaggaggaacaucgccacgaucucaaacaggggaaguacuauaauuucaaauacuacauccugaacggccuucugagacagcucaagaaugagaacgucgagaauuauaaaguguuuaagcugaacaccaaucccgaaaagguuaacauuacacaacugaaacaggaggcgaccgaccuugaacagaaggcuuucgugcugacguacauccggaacaaauuugcccauaaucagcucccgaagaaagaguucugggauuauugucaagagaaguacggaaagauugaaaaagagaagacauaugccgaauacuuugcugaggucuucaaacgcgaaaaggaggcccugaucaaauga

SEQ ID NO: 11411 - RNA, 3657 nt, Artificial Sequence
  Cas13b variant__Capnocytophaga cynodegmi__WP_041989581.1__Cas13b
auggagaacaagaccagccugggcaauaacaucuacuauaaucccuucaaaccucaggacaaguccuacuuugccggguaucucaacgcugccauggaaaauauugauucuguguucagagagcugggaaaacggcuuaagggcaaagaauacacaagcgagaacuuuuucgacgcgaucuuuaaggaaaauauuucccuggucgaguaugagcgcuacguuaagcuccugucugauuauuucccgauggcuagacuucuggacaaaaaggaagugcccaucaaagagcggaaggaaaacuuuaaaaagaauuuccgcgggauuaucaaggccgugagagaucuccggaacuuuuacacgcacaaagagcauggagaggucgaaaucaccgacgagauuuucggcgugcuggaugaaaugcugaagucuacaguucucaccgugaaaaagaaaaagaucaaaacagacaagaccaaggagauucugaaaaaguccaucgaaaaacaacuugauauucugugccagaagaaacucgaguaccugaaggacacagcccgcaagaucgaggagaaaagacggaaucagcgcgagagaggggaaaagaaacuugucccucgguuugaguauucugaucgcagagacgaucugauugcugccaucuacaacgacgcuuucgacguguauaucgauaagaaaaaggacagccucaaggaauccagcaaaaccaaguacaauacggagucuuauccccagcaagaggaaggagaucugaaaauuccuaucuccaagaacggcguuguguuucugcucagccuguuccuuucuaaacaggagguccacgccuucaaguccaagauugcgggcuuuaaagccaccgugaucgacgaagcuacagugagccaucggaagaauagcauuuguuucauggccacccacgagaucuuuucccaucuggcuuacaaaaagcucaaacgcaaggucagaacagccgaaaucaacuauagcgaggcggagaacgccgaacagcuguccauuuacgcuaaagagacccuuaugaugcagaugcuggaugaacucucuaagguucccgacgugguguaccaaaaucugagcgaggauguccagaagacguucaucgaggacuggaacgaauaucugaaagagaauaacggggaugugggaacaauggaagaggaacagguuauucacccugugauccggaagagauacgaggacaaauuuaauuauuucgccauucgcuuucucgaugaguucgcucaguuuccgacccugcgguuccaaguccaccuuggcaacuaccugcaugacuccagacccaaggaacaccucaucagcgaccgccggaucaaagagaagauuacaguguuugggagacugucugaacuugagcauaagaaagcccuguucaucaagaauaccgaaaccaacgaggaucgcaaacacuauugggagguuuuuccuaaucccaacuacgacuucccuaaggaaaauauuuccgugaacgauaaagacuuccccaucgccggaagcauucucgaucgggagaagcagccgacagcuggcaagaucgggauuaaagucaaucugcugaaccagaaguauaucucugaaguggacaaagcggucaaggcccaccaacucaaacagagaaauaacaagccuagcauccagaacauuaucgaggaaauugugcccaucaauggauccaacccuaaggagauuaucguuuuuggcggccagcccacggcuuaccugucuaugaaugauauccauagcauucuuuacgaguucuuugacaaaugggaaaagaaaaaggagaaacuggaaaagaaaggggagaaggagcuccgcaaggaaaucggaaaagagcuggaagagaagauugugggcaaaauccaaacccagauucagcagaucaucgauaaggacauuaacgccaaaauccugaagcccuaucaagaugacgauuccacagccauugacaaggaaaaacuuaucaaggaccucaaacaggagcagaagauucugcagaaacugaagaaugagcaaaccgcucgggaaaaggaguaccaggaaugcaucgccuaucaggaggaaagcagaaaaaucaagcgcucugauaaaucccggcagaaguaccucagaaaccaacugaaacggaaguauccugaggucccgacacgcaaggagauucuuuacuaucaggaaaaagggaagguggcgguuuggcuggcuaaugacaucaaaagauucaugcccaccgauuuuaagaacgaguggaaaggagaacagcacagccuccugcaaaagucucuggccuacuacgagcaguguaaggaagaacuuaaaaaucuccugccucagcagaagguguucaaacaucugcccuuugagcucggcgggcacuuccaacagaaguaucuguaccaguuuuauacgcgguaccuugacaaaagacuggaacauauuuccggacucguccagcaagccgagaacuucaagaaugaaaacaaaguguuuaagaagguggagaaugagugcuucaaauuucugaagaaacagaacuauacacacaagggccuggaugcucaggcccagagcguucuuggcuacccuaucuuccucgaacgcggguucauggacgagaaacccaccauuaucaagggaaagaccuuuaaaggcaaugaaucccuguucacagauugguuucgguauuacaaggaguaccaaaacuuccagaccuuuuaugacacagaaaacuacccgcuggucgagcucgagaaaaagcaggcugauagaaaacgcgaaacgaagauuuaucaacagaagaaaaaugacguguucacccugcuuauggccaagcacaucuuuaaaucuguguucaagcaggauagcaucgacagauuuucccuggaggaucucuaccagucucgggaagaacgccuggaaaaccaagagaaagcgaagcagacaggggagagaaauaccaacuauauuuggaauaagacagucgaccugaaccuuugugacggaaaagugaccguugaaaaugugaagcucaaaaacgucggcaauuucaucaaguacgaguaugaucagcgggugcagacguuucugaaauacgaagagaacauuaaguggcaagccuuccugaucaaagaaagcaaggaggaggaaaauuacccuuauauuguugagcgcgaaaucgagcaguacgagaaggugagacgggaggagcuccugaaagaaguccaucuuaucgaggaauauauucuggagaaggugaaagacaaggagauccucaaaaagggggauaaccagaauuucaaguacuauauucugaacggccugcuuaaacagcugaagaaugaagacguugaguccuacaaaguguuuaaccucaacaccaagcccgaagaugucaauaucaaccaacugaaacaggaggcuacagaccucgaacagaaggccuucgugcugaccuauauucgcaauaaguuugcucacaaccagcuuccuaaaaaggaguucugggauuacugccaagagaaauacggaaagaucgaaaaagagaagacauaugccgaauacuuugcggagguguucaagagagaaaaagaggcccugaugaaguga

SEQ ID NO: 11412 - RNA, 3438 nt, Artificial Sequence
  Cas13b variant__Chryseobacterium sp.__WP_047431796.1__Cas13b
auggagacccagacaaucggccacgggauugccuacgaccauagcaagauccaagauaaacacuucuuuggaggcuuccugaaccucgcugaaaauaacauuaaggccgugcugaaagcguuuuccgagaaguucaaugucgggaacguugacgugaaacaguuugcugaugugucucuuaaggacaaucugcccgauaacgacuuccagaagagagucagcuuucucaaaauguauuucccugugguugauuuuaucaauauuccgaacaaucgggccaaguuccgcuccgaccugacgacccuuuuuaaaucuguggaucagcugagaaacuucuacacacauuauuaccacaagccccucgacuuugaugccagccuguucauccugcucgacgauaucuucgcucggaccgccaaagaaguccgcgaccaaaagaugaaggacgauaaaacaagacagcugcuuuccaagucucugagcgaggaacuccagaaaggauaugagcugcagcuugagcggcugaaggaacucaaucgccugggcaaaaaggugaacauucaugaccaacuggggaucaaaaauggaguucucaacaaugcuuuuaaccaccugauuuacaaggauggcgaguccuucaagaccaaacuuacauauagcucugcccugaccuccuuugaaagcgcggagaacggcaucgagauuucucaguccgggcuccuguuccuucugagcauguuucucaagagaaaagaaaucgaggaccugaagaaucggaacaaaggauucaaggccaagguggucauugaugaagacggcaaagugaaugggcugaaguuuauggcuacgcacuggguguucucuuaccucugcuuuaaaggacugaaguccaaacuuagcaccgaguuccaugaagagacacugcucauccagaucauugaugagcuguccaaggucccugacgaacuuuacugugccuuugauaaggagacccgcgacaaauucaucgaagauauuaacgaguauguuaaggaaggccaccaggacuuuucucuggaggacgcuaaagugauccaucccgugauuagaaagcgguacgagaauaaauucaacuauuucgccauccgcuuucucgaugaguucgucaaguuuccuagccugagauuccaagugcacguugggaauuacgugcacgaccggcgcaucaagaacauugauggaacaaccuuugaaacggaaagagucgugaaagaccggaucaagguuuucggcagacuguccgagauuagcucuuauaaagcgcaguaccucuccagcgugucugauaagcaugacgaaacaggcugggagaucuuucccaauccuagcuaugucuucauuaacaauaacaucccgauccacauuuccguggauaccucuuuuaaaaaggagaucgccgacuucaaaaagcugcgccgggcucagguccccgaugaacuuaagauuagaggggccgagaaaaagcgcaaauuugaaaucacacaaaugauuggaagcaaguccgugcugaaucaggaggagccuaucgcucuccugagccugaacgaaauucccgcccuucucuacgagauccugaucaauggcaaagaaccugccgagauugaacggaucauuaaggacaagcugaacgagagacaggauguuaucaaaaacuacaaucccgagaacuggcucccggcuucucagauuucccgccggcugagaagcaauaagggggaacgcaucaucaacaccgacaaacuucugcaacucgugaccaaggagcugcuggucacagaacagaaacuuaagauuaucucugauaaucgggaggcgcucaagcagaaaaaggaaggaaaauauauuagaaaguucaucuuuacgaacuccgagcugggccgcgaggccauuuggcuggcugacgacaucaaacgguucaugccugccgaugugagaaaggaauggaagggguaccagcauagccaacuccagcagucccuggccuucuauaauucucggcccaaagaggcucuugccauccuggaaagcuccuggaaccucaaggacgagaaaauuaucuggaaugaauggauucugaagucuuuuacccagaacaaauucuuugaugcguucuacaaugaguaucugaagggacgcaaaaaguacuuugcuuuccuuagcgagcacaucguucaauauacauccaacgccaagaaucuccagaaauuuauuaagcagcagaugccuaaagaccuguucgaaaagagacauuacaucaucgaggaucugcaaaccgagaaaaacaagauucucagcaagcccuuuaucuucccccggggcauuuuugacaaaaagccuacauucaucaaaggcgugaaggucgaagauucuccggaguccuucgccaauugguaccaguauggguaccagaaagaccaccaauuucagaaguucuaugauuggaagagagacuacagcgauguguuucuggaacaccuuggaaaacccuucauuaacaacggcgaccgccggacccuggggauggaggaacucaaggagagaaucauuaucaaacaggaucugaagaucaaaaagauuaagauccaggaccuguuucuucgccucauugcugaaaaucuguuccaaaaaguguuuaaguauucugccaaacugccucucuccgacuucuaccugacgcaggaggagagaauggaaaaggagaacauggcugcccuucagaauguucgggaagagggagauaaaagccccaacaucauuaaggacaauuuuaucuggucuaagaugaucccuuauaaaaagggccagauuaucgaaaacgcggucaaacugaaggauauugggaaacucaaugugcugagccuggacgauaaggugcaaacacuucuguccuacgacgaugccaaacccuggagcaagaucgcucucgagaacgaguucucuauuggcgaaaauuccuacgaggucauccgcagagaaaagcuguuuaaagagauccagcaguucgaaagcgagauucucuuucgguccggaugggacggcaucaaccauccggcccagcuggaggauaaucgcaacccuaaguucaaaauguauauugugaaugggauccuuagaaagucugcuggacuguacagccaaggcgaagacauuugguucgaguauaacgccgauuuuaauaaccucgacgcggacguucuggaaaccaaauccgagcuggugcagcuugccuuccuggucaccgcuauccggaacaaguuugcccacaaucagcuccccgcuaaggaguucuacuuuuauauucgcgccaaauacggguucgccgaugaaccuucuguggcucugguuuaucucaacuuuacaaaguacgcgaucaaugaguucaaaaaggugaugaucuga

SEQ ID NO: 11413 - RNA, 3453 nt, Artificial Sequence
  Cas13b variant__Flavobacterium branchiophilum__WP_014084666.1__Cas13b
auggagaaccugaauaagauccucgacaaagaaaacgagauuugcaucagcaagauuuucaauaccaaaggcaucgccgcucccauuacagaaaaggcccuggauaacaucaaauccaagcagaagaaugaccuuaacaaagaggcgagacugcacuacuuuucuaucgggcauagcuucaagcaaauugauacgaaaaagguguuugacuauguccucaucgaagaacugaaagaugagaagccucuuaaguucauuacccugcagaaagacuuuuucacaaaggaauuuuccaucaaacuccagaagcugauuaauucuauccggaacauuaauaaccacuacguucauaauuucaacgauaucaaucugaacaaaaucgacagcaauguguuucacuuccucaaggaguccuuugaacuggcuauuaucgagaaauauuacaaggugaacaagaaauauccgcuugauaacgagauuguccuguuccucaaggaacuguuuaucaaagacgagaauaccgcccuucugaacuacuucacaaaucucucuaaggaugaagccauugaguauauccugaccuucacaaucaccgaaaacaaaauuuggaauaucaacaaugagcauaacauucugaauaucgagaagggaaaguaccucacguuugaagcuaugcuguuccuuauuaccaucuuucuguacaaaaacgaggccaaucaccuccugcccaaacuuuaugacuucaaaaacaauaagagcaaacaggaacuguuuacauucuuuuccaagaaguucaccagccaagauaucgacgcugaggaaggccaccucauuaaauuucgcgacaugauccaguaccugaaccauuauccuacagccuggaauaacgaucugaagcucgagucugagaacaaaaauaagauuaugaccacgaaacugaucgacuccauuaucgaguucgagcuuaacagcaauuaccccucuuuugcgacagauauucaguucaagaaggaagccaaggcuuuucuguucgccuccaacaagaaaagaaaucagaccagcuucucuaacaaguccuauaaugaggaaauccggcacaacccucauaucaaacaauaccgcgacgagauugcuagcgcccucacacccaucuccuuuaaugugaaggaggauaaauucaagauuuuuguuaagaaacacgugcuggaagaguauuucccuaacucuaucggguacgaaaaguuucuugaguacaaugacuucaccgagaaagaaaaggaggauuuuggacugaaacucuauagcaacccgaagaccaauaagcugauugaaagaaucgacaaccacaaacuggucaagucccauggccggaaucaggaucgcuucauggacuuuagcaugagauuccucgcggagaacaacuacuuugggaaagaugccuucuuuaaguguuauaaauucuacgacacacaggaacaggacgaguuccugcaaucuaaugagaacaaugaugacgugaaguuucacaagggaaaaguuacgaccuauaucaaguacgaggaacaucuuaaaaacuauuccuacugggauugccccuucguggaagagaauaacagcaugucugucaagauuagcaucggcuccgaagagaaaauucugaagauccagcggaaucucaugauuuacuuucuggagaacgcucuguauaaugaaaacguggagaaucagggcuacaaacuugugaacaauuauuaccgcgaacucaagaaggacgucgaggaaucuaucgccagccuggaucugaucaaauccaacccugacuucaagagcaaauauaagaaaauucuccccaagagacugcuucacaauuacgcuccugccaagcaagauaaagcccccgagaacgcuuuugagacacugcucaagaaagcggacuuccgggaggaacaguauaagaaacugcugaagaaggccgaacaugagaaaaacaaggaggauuuuguuaaacgcaauaaggggaaacaguucaaacuucacuuuaucagaaaggcuugucagaugauguacuucaaggaaaaguacaacacccucaaagagggaaaugccgccuuugaaaagaaagacccggugauugagaagcggaagaacaaagaacacgaguucggccaucacaagaaucugaacaucacacgcgaggaguucaaugauuauugcaaauggauguuugcuuucaacgggaaugacucuuacaagaaauaucugagagaucucuuuuccgaaaagcauuucuuugacaaccaagaauacaagaaucuguucgagagcucugugaaccuugaagccuuuuaugcgaaaaccaaggagcuguucaaaaaguggauugagacgaauaaaccuacaaacaaugaaaaccgguacacccucgagaauuauaagaaccugauccugcagaaacaggucuuuaucaacguguaccacuucuccaaguaccuuauugacaagaaucuccugaacagcgaaaauaacguuauccaguauaaaucccuggagaauguggaauaccucauuucugauuuuuauuuccaaagcaagcuguccaucgaccaguacaaaaccuguggaaaacuuuuuaacaagcugaagucuaauaagcucgaggauugccugcuguaugagauugcuuacaacuauaucgacaaaaagaauguccacaaaauugauauccagaagauccuuacaagcaaaauuauccucaccauuaacgacgccaauacacccuacaagaucuccgugccuuucaacaagcuggaaagauacacggagaugauugccaucaaaaaucagaacaaucugaaggcucgcuuccucaucgaucugccccuuuaucugagcaaaaacaagauuaaaaagggcaaggacucugccggguacgaaaucauuaucaaaaacgaucucgagauugaggacaucaauaccaucaacaauaagauuaucaacgauuccguuaaauuuacagaagugcugauggagcuggaaaaguauuucauucuuaaagacaaguguauccugagcaaaaauuacauugauaacucugagauccccucccucaagcaauuuagcaaggucuggauuaaagaaaaugagaacgagaucaucaauuaucggaacauugcuugccauuuccaucugccucuccuggaaaccuuugacaaucuucugcucaacguggagcagaaguucaucaaagaggaacugcagaaugucucuacaauuaacgaccugagcaagccgcaggaauaccuuauccugcucuuuauuaaauucaagcacaauaacuuuuaucugaaccucuucaauaagaacgaguccaaaaccaucaagaaugauaaagaggugaagaaaaacagaguucugcaaaaguuuaucaaucaggugauucuuaagaaaaaguga

SEQ ID NO: 11414 - RNA, 3642 nt, Artificial Sequence
  Cas13b variant__Flavobacterium columnare__WP_060381855.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacacggaucaacuuuaaucauaacaauaacgaacuggcuagcgucuucaaggauuauuuuaauaaagagaaguccguugccaaacgcgaacacgcgcuuaaccugcucucuaauuacuuccccgugcuggagcggauucagaagcauacgaaccacaauuuugagcagaccagagaaaucuucgagcuucugcucgacacaauuaaaaagcugcgcgauuauuacacccaucacuaucacaagccuaucacaauuaacccgaaaguguacgacuuucuggaugacacccuccuggauguccuuaucacaaucaagaaaaagaaagugaagaacgacaccagcagagaacugcucaaagagaaguuccggcccgagcugacgcaacuuaagaaucagaaacgcgaagaacugauuaagaaaggcaagaaacuccuggaagagaaccuggaaaaugcuguuuuuaaccauugccucagaccuuuccuggaggagaauaagaccgaugacaagcagaacaaaacagugucccuucggaaguaccgcaaaucuaagcccaaugaagagaccagcaucacacugacccaguccgggcucgucuuccugauuagcuuuuuccuucacagaaaagaauuucaaguguucacgucuggacuggagggcuuuaaggccaagguuaacacaaucaaagaagaggagauuucccucaauaagaacaauaucguguauaugauuacccauuggagcuacucuuauuacaacuucaaagggcugaagcaccggaucaaaacagaucagggagucuccacccuggaacagaauaacaccacacacagccucacgaauaccaacacaaaggaggcccugcuuacccagaucguggacuaucugucuaaggugccuaacgaaauuuacgagacacucuccgaaaaacaacagaaggaguuugaggaagacaucaaugaguauaugcgcgaaaaccccgagaaugaggauagcaccuucuccucuauugucagccauaaaguuaucagaaagcgguacgaaaacaaauuuaauuacuucgcuaugcgcuuucuggacgaguaugccgaacuuccuacgcugagauucauggugaacuuuggcgauuacauuaaggaccggcagaaaaagauccucgaguccauccaauucgauagcgaaagaauuaucaagaaagagauucaccuguucgagaagcugggccucgugacagaauauaaaaagaaugucuaccugaaagagaccucuaacaucgaccuuucccgcuuuccgcuguuccccagcccuucuuaugugauggcuaauaacaauauucccuuuuacaucgauagccgguccaacaaucucgacgaauaucugaaccagaagaagaaagcccagucucagaauagaaagcgcaaccugaccuucgagaaauacaacaaggaacaaagcaaagaugcgaucauugccaugcuucagaaggagaucgggguuaaggaccuccagcagcgguccacaauuggacugcugagcuguaaugagcucccuucuaugcuguacgaagugaucgucaaagauauuaagggcgcugagcuugaaaacaaaaucgcccaaaagauuagagagcaguaucaguccauccgcgacuuuacccuggacagcccccagaaagauaauaucccgacaacgcucaccaagacaauuucuaccgacacauccgugaccuucgaaaaccaaccuaucgauauuccccggcugaagaaugcucugcagaaagagcuuacgcucacccaggagaagcugcugaacguuaaacagcaugaaaucgagguggacaauuacaacagaaauaagaacacauauaaauuuaagaaucaaccuaaagauaaggucgacgauaacaagcuccagcgcaaauacguguucuaucggaaugaaauugggcaggaggccaacuggcuggcgagcgaccuuauccacuuuaugaagaauaaaucccuguggaagggauacaugcauaacgagcuccaaucuuuccuggccuuuuucgaagauaaaaagaacgacugcaucgcucugcuugagaccgucuuuaaucucaaggaagauuguauucugacaaaagaccugaagaaccucuuccugaaacacggcaauuucaucgauuuuuauaaggaguaccuuaaacugaaggaagacuuccucaacaccgagagcacguuucuggagaauggguucauuggacugccucccaagauccuuaaaaaggaacucuccaaaagacugaacuacauuuuuaucguguuccagaagcgccaguuuaucauuaaagagcuggaagagaagaagaauaaccucuaugccgacgcuaucaaucugucucggggcauuuucgaugaaaaacccacaaugaucccguuuaagaaacccaacccugacgaguucgccagcugguuuguugccuccuaccaguauaauaacuaccagagcuucuaugagcuuacccccgauaagauugaaaaugacaaaaagaagaaauacaagaaccugagagcuaucaauaaagugaagauccaagauuauuaccucaaacugauggucgacacacuguaccaggaucuuuucaaccagccucuggacaagucucucuccgauuuuuaugugagcaaaaccgaccgggagaagauuaaggcggaugccaaggcuuaccaaaagcgcaaugacucuuuccuguggaacaaaguuauccaccucucccugcagaacaauagaauuaccgccaaccccaaacuuaaagauaucggcaaguauaagcgggcccugcaggacgagaaaauugcuacacuccugacguacgacgauagaaccuggacauaugcccugcagaagccggagaaagaaaaugagaacgacuacaaggagcuucauuauaccgcgcugaauauggaacuccaagaguacgaaaaagugcgcagcaagaagcugcucaaacagguccaggagcuggagaagcaaauccuugauaaauuuuacgacuucucuaacaaugcuacacacccugaagaucuggagauugaagacaagaaagggaagcggcaucccaacuuuaagcucuauaucaccaaagcccugcugaagaaugagagcgaaaucauuaaccuugagaauaucgauauugagauccugauuaaauacuaugacuacaacacggaaaagcucaaagagaagaucaaaaauauggaugaagacgagaaggccaagaucgugaacacaaaagaaaauuauaacaagauuaccaacgugcugaucaaaaaggcucucguucugauuaucauuagaaauaaaauggcccacaaccaguacccucccaaguucaucuaugaucuugcuacccgcuuugucccuaagaaagaggaggaauacuucgccugcuacuuuaauagaguguucgagacaaucaccacagaacugugggagaacaagaaaaaggcgaaagaaauuguguga

SEQ ID NO: 11415 - RNA, 3540 nt, Artificial Sequence
  Cas13b variant__Flavobacterium columnare__WP_014165541.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacacggaucaacuuuaaucauaacaauaacgaacuggcuagcgucuucaaggauuauuuuaauaaagagaaguccguugccaaacgcgaacacgcgcuuaaccugcucucuaauuacuuccccgugcuggagcggauucagaagcauacgaaccacaauuuugagcagaccagagaaaucuucgagcuucugcucgacacaauuaaaaagcugcgcgauuauuacacccaucacuaucacaagccuaucacaauuaacccgaaaaucuacgacuuucuggaugacacccuccuggaugugcuuaucacaauuaagaaaaagaaagucaagaacgacaccagcagagaacugcucaaagagaagcugcggcccgagcuuacgcaacugaagaaucagaaacgcgaagaacucaucaagaaaggcaagaaacugcuggaagagaaccucgaaaaugcuguguucaaccauugccugagaccuuuucuugaggagaauaagaccgaugacaagcagaacaaaacaguuucccugcggaaguaccgcaaaucuaagcccaaugaagagaccagcauuacacucacccaguccgggcugguguuccuuaugagcuucuuucugcacagaaaagaguuccaagucuuuacgucuggacucgagggcuucaaggccaaggugaacacaaucaaagaagaggagauuucccugaauaagaacaauaucguuuauaugauuacccauuggagcuacucuuauuacaacuuuaaagggcugaagcaccggaucaaaacagaucagggaguguccacccucgaacagaauaacaccacacacagccugacgaauaccaacacaaaggaggcccuucugacccagaucgucgacuaucucucuaaggugccuaacgaaauuuacgagacacuguccgaaaaacaacagaaggaguucgaggaagacaucaaugaguauaugcgcgaaaaccccgagaaugaggauagcaccuuuuccucuauugugagccauaaagucaucagaaagcgguacgaaaacaaauucaauuacuuugcuaugcgcuuccuugacgaguaugccgaacugccuacgcucagauuuaugguuaacuucggcgauuacauuaaggaccggcagaaaaagauccuggaguccauccaauuugauagcgaaagaauuaucaagaaagagauucaccuguucgagaagcucucucuggugacagaauauaaaaagaauguguaccuuaaagagaccuccaacaucgaccugagccgcuucccgcucuuucccaauccuucuuaugucauggcuaacaauaacauucccuucuacaucgauagccgguccaauaaccuggacgaauaucugaaucagaagaagaaagcccagucucagaacaagaaaagaaaccuuaccuuugagaaguacaauaaagaacaaagcaaggaugcgaucauugccaugcuccagaaggagaucggcgugaaagaccugcagcagcgcuccacaauugggcugcucagcuguaacgagcugccuucuaugcuuuacgaaguuaucgugaaggauauuaaaggagcugagcuggaaaauaagaucgcccaaaagauucgggagcaguaucaguccaucagagacuucacccucgacagcccccagaaggauaacaucccgacaacgcugauuaagaccaucaauacagacucuuccgucaccuuugaaaaccaaccuauugauaucccccgccugaaaaaugcuauucagaaggagcuuacacucacccaggagaaacugcugaacgugaaggaacaugagaucgaaguugacaauuacaaccggaauaaaaacacguauaaguucaaaaaucagccuaagaacaagguggaugacaaaaagcuccaaagaaaauacgucuuuuaucgcaaugagauccggcaggaggccaacuggcuggcgagcgaucuuauucacuucaugaagaacaaaucccuguggaagggcuacaugcauaaugaacuccagucuuuucuggccuucuuugaggacaagaaaaacgauugcaucgcucugcuugaaaccguguucaaucucaaggaggacuguauucugacaaaagggcugaagaaccucuuucugaaacacggaaauuucaucgauuucuauaaggaauaccuuaagcugaaagaggacuuucucaacaccgagagcacauuccuggaaaauggccugauugggcuuccucccaagauccucaaaaaggagcuguccaaaagauuuaaguacaucuucauugucuuucaaaagcgccaguucaucauuaaagaacuggaggaaaagaaaaacaaucucuaugccgaugcuaucaaccugucucggggaauuuuugacgagaagcccaccaugaucccguucaaaaagcccaauccugacgaguuugccagcugguucguggccuccuaccaguauaacaauuaccagagcuuuuaugaacuuacgcccgauaucguugagagagacaagaaaaagaaauacaagaaccugcgggcuauuaauaaagugaagauccaagauuauuaccucaaacugauggucgacacacuguaccaggaucuuuucaaccagccucuggacaagucucucuccgauuucuaugugagcaaggcggaacgcgagaaaauuaaggccgacgcuaaagccuaccagaagagaaaugauucuucccuguggaacaaaguuauccaccucagccugcaaaacaaucggauuaccgccaaccccaaacuuaaggacaucggcaaauauaagagagcucugcaggaugaaaagauugccacacuccugaccuacgacgaucgcaccuggacauaugcgcugcagaagccggagaaagagaaugaaaacgacuacaaggagcuucauuauacggcucugaauauggaacuccaggaguacgagaaggugcggucuaaagaacugcucaagcaaguccaggagcuggaaaaacagauccuugaggaauacaccgacuuucugagcacacaaauccacccugccgauuucgagagagagggcaaccccaauuuuaagaaauaucucgcccauuccauucuggaaaacgaggacgaucuggacaaacuuccugaaaagguggaggcuaugcgcgaacuggaugagaccaucacaaaucccauuaucaaaaaggccauugugcucaucaucauuagaaacaaaauggcucacaaucaguacccucccaaguucaucuaugaccuggccaaccgguuuguuccgaaaaaggaggaagaguacuucgcgaccuauuuuaaucgcgucuucgaaacgauuacaaaagagcucugggaaaacaaggagaagaaagauaagacccagguguga

SEQ ID NO: 11416 - RNA, 3642 nt, Artificial Sequence
  Cas13b variant__Flavobacterium columnare__WP_063744070.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacacggaucaacuuuaaucauaacaauaacgaacuggcuagcgucuucaaggauuauuuuaauaaagagaaguccguugccaaacgcgaacacgcgcuuaaccugcucucuaauuacuuccccgugcuggagcggauucagaagcauacgaaccacaauuuugagcagaccagagaaaucuucgagcuucugcucgacacaauuaaaaagcugcgcgauuauuacacccaucacuaucacaagccuaucacaauuaacccgaaaaucuacgacuuucuggaugacacccuccuggaugugcuuaucacaauuaagaaaaagaaagucaagaacgacaccagcagagaacugcucaaagagaagcugcggcccgagcuuacgcaacugaagaaucagaaacgcgaagaacucaucaagaaaggcaagaaacugcuggaagagaaccucgaaaaugcuguguucaaccauugccugagaccuuuucuugaggagaauaagaccgaugacaagcagaacaaaacaguuucccugcggaaguaccgcaaaucuaagcccaaugaagagaccagcauuacacucacccaguccgggcugguguuccuuaugagcuucuuucugcacagaaaagaguuccaagucuuuacgucuggacucgagggcuucaaggccaaggugaacacaaucaaagaagagaagauuucccugaauaaaaacaauaucguuuauaugauuacccauuggagcuacucuuauuacaacuuuaaggggcugaaacaccggaucaagacagaucagggaguguccacccucgagcagaauaacaccacacacagccugacgaauaccaacacaaaggaagcccuucugacccagaucgucgacuaucucucuaaagugccuaacgagauuuacgaaacacuguccgagaagcaacagaaagaguucgaagaggacaucaaugaauauaugcgcgagaaccccgaaaaugaggauagcaccuuuuccucuauugugagccauaaggucaucagaaaacgguacgagaacaaguucaauuacuuugcuaugcgcuuccuugacgaauaugccgagcugccuacgcucagauuuaugguuaacuucggcgauuacauuaaagaccggcagaagaagauccuggaauccauccaauuugauagcgagagaauuaucaaaaaggaaauucaccuguucgagaaacucggccuggugacagaguauaagaaaaauguguaccuuaaggaaaccucuaacaucgaccugucccgcuucccgcucuuucccagcccuucuuaugucauggcuaauaacaauauucccuucuacaucgauagccgguccaacaaucuggacgaguaucugaaccagaagaaaaaggcccagucucagaauagaaaacgcaaccuuaccuuugaaaaguacaacaaagagcaaagcaaggaugcgaucauugccaugcuccagaaggaaaucggggugaaagaccugcagcagcgguccacaauuggacugcucagcuguaaugagcugccuucuaugcuuuacgagguuaucgugaaggauauuaaaggcgcugaacuggagaacaagaucgcccaaaagauuagagaacaguaucaguccauccgcgacuucacccucaauagcccccagaaggacaacaucccgacaacgcugauuaagaccaucucuacagauaccuccgucacauuugagaaucaaccuauugacaucccccggcugaaaaacgcuauucagaaggaacuugcccucacccaggagaaacugcugaaugugaagcagcaugagaucgaaguuaacaauuacaacagaaauaaaaacacguauaaguucaaaaaucaaccuaaggauaagguggacgauaacaaacuccagcgcaaguacgucuuuuaucggaaugagaucgggcaggaagcgaacuggcuggccagcgaccuuauucacuucaugaaaaacaagucccuguggaaaggauacaugcauaaugagcuccaaucuuuucuggcuuucuuugaggauaagaagaacgacugcaucgcccugcuugaaaccguguucaaucucaaagaggauuguauucugacaaaggaccugaaaaaccucuuucugaagcacggcaauuucaucgauuucuauaaagaauaccuuaagcugaaggaggacuuucucaacaccgaaagcacauuccuggagaauggguuuauuggacugccucccaaaauccuuaagaaagagcucuccaagagacugaacuacaucuucauugucuuucagaaacgccaguucaucauuaaggaacuggaggaaaagaaaaauaaccucuaugcugaugccaucaaucugucucggggcauuuuugacgagaagcccaccaugaucccguucaaaaagcccaacccugacgaauuugccagcugguucguggcuuccuaccaguauaauaacuaccagagcuuuuaugagcuuacgcccgauaaaaucgagaaugacaagaagaaaaaguacaaaaaccugagagcgauuaauaagguuaaaauccaagauuauuaccucaagcugaugguggacacacuguaccaggaucuuuucaaccagccucuggacaaaucucucuccgauuucuaugucagcaagaccgaccgggaaaagauuaaagccgaugcuaaggccuaccaaaaacgcaacgacucuuuucuguggaauaaggugauccaccucucccugcagaacaauagaauuacagccaaccccaaacuuaaggauaucggcaaguauaaacgggcucugcaggacgagaagauugccacccuccugaccuacgaugacagaacauggacguaugcgcugcagaaaccggaaaaggagaaugaaaacgacuacaaagagcuucauuauaccgcucugaauauggagcuccaagaauacgagaagguucgcagcaagaaacugcucaaacaggugcaggaacuggagaaacaaauccuugauaaguucuacgacuuuucuaacaaugccacacacccugaggaucuggaaaucgaggacaaaaaggggaagcggcaucccaacuucaaacucuauauuaccaaggcccugcugaaaaaugaaagcgagaucauuaaccuugaaaauaucgauauugagauccugaucaaguacuaugacuacaacacagagaaacucaaggagaaaauuaagaauauggaugaagacgaaaaggcuaaaaucgucaacaccaaggagaacuauaauaaaauuacgaacgugcugaucaagaaagcccucgugcugauuaucaucagaaauaagauggcucacaaccaguacccucccaaguuuauuuaugaucuugccacacgcuucguuccuaaaaaggaagaggaguacuuugcgugcuacuucaauagagucuuugaaaccaucaccacagagcugugggaaaacaaaaagaaagccaaggagauuguguga

SEQ ID NO: 11417 - RNA, 3645 nt, Artificial Sequence
  Cas13b variant__Flavobacterium columnare__WP_065213424.1__Cas13b
augagcuccaagaacgagucuuacaauaaacagaagaccuucaaccacuauaaacaagaagacaaguacuuuuucggcggguuucugaauaacgccgaugacaaucucagacaggugggaaaagaguucaagacacggaucaacuuuaaucauaacaauaacgaacuggcuagcgucuucaaggauuauuuuaauaaagagaaguccguugccaaacgcgaacacgcgcuuaaccugcucucuaauuacuuccccgugcuggagcggauucagaagcauacgaaccacaauuuugagcagaccagagaaaucuucgagcuucugcucgacacaauuaaaaagcugcgcgauuauuacacccaucacuaucacaagccuaucacaauuaacccgaaaaucuacgacuuucuggaugacacccuccuggaugugcuuaucacaauuaagaaaaagaaagucaagaacgacaccagcagagaacugcucaaagagaagcugcggcccgagcuuacgcaacugaagaaucagaaacgcgaggaacucaucaagaaaggcaagaaacugcuggaagagaaccucgaaaaugcuguguucaaccauugccugauuccuuuucuugaggagaauaagaccgaugacaagcagaacaaaacaguuucccugagaaaguaccggaaaucuaagcccaaugaagagaccagcaucacacucacccaguccgggcugguguuccuuaugagcuucuuucugcaccgcaaagaguuccaagucuuuacgucuggacucgaaagauucaaggccaaggugaacacaauuaaagaagaggagaucucccugaauaagaacaauauuguuuauaugaucacccauuggagcuacucuuauuacaacuuuaaaggccugaagcaccggaucaaaacagaucaggggguguccacccucgaacagaauaacaccacacacagccugacgaauaccaacacaaaggaggcccuucugacccagauugucgacuaucucucuaaggugccuaacgaaaucuacgagacacuguccgaaaaacaacagaaggaguucgaggaagacauuaaugaguauaugcgcgaaaaccccgagaaugaggauagcaccuuuuccucuaucgugagccauaaagucauuagaaagcgguacgaaaacaaauucaauuacuuugcuaugcgcuuccuugacgaguaugccgaacugccuacgcucagauuuaugguuaacuucggagauuacaucaaggaccggcagaaaaagauccuggaguccauucaauuugauagcgaaagaaucauuaagaaagagauccaccuguucgagaagcucucucuggugacagaauauaaaaagaauguguaccuuaaagagaccuccaacauugaccugagccgcuucccgcucuuucccaauccuucuuaugucauggcuaacaauaacauccccuucuacaucgauagccgguccaauaaccuggacgaauaucugaaucagaagaagaaagcccagucucagaacaagaaaagaaaccuuaccuuugagaaguacaauaaagaacaaagcaaggaugcgauuaucgccaugcuccagaaggagauuggcgugaaagaccugcagcagcgcuccacaaucggccugcucagcuguaacgagcugccuucuaugcuuuacgaaguuauugugaaggauaucaaaggggcugagcuggaaaauaagauugcccagaaaauccgggagcaauaucaguccaucagagacuucacccucgacagcccccagaaggauaacauuccgacaacgcugaucaagaccauuaauacagacucuuccgucaccuuugaaaaccaaccuaucgauauuccccgccugaaaaaugcccuucagaaggagcucacacugacccaggagaaacugcucaacgugaaggaacaugagaucgaaguugacaauuacaaccggaauaaaaacacguauaaguucaaaaaucagccuaagaacaagguggaugacaaaaagcugcaaagaaaauacgucuuuuaucgcaaugagauccggcaggaggcuaacuggcuugcgagcgaucugauucacuucaugaagaacaaaucccucuggaagggauacaugcauaaugaacugcagucuuuucuggccuucuuugaggacaagaaaaacgauugcaucgcccuucucgaaaccguguucaaucugaaggaggacuguauucugacaaaaggccucaagaaccuguuucuuaaacacgggaauuucaucgauuucuauaaggaauaccugaagcucaaagaggacuuucugagcaccgaguccacauuccuggaaaacggauuuauuggccuuccucccaagauccucaaaaaggagcugucuaaaagacugaaguacaucuucauugucuuucaaaagcgccaguucaucauuaaagaacucgaggaaaagaaaaauaaccuguaugcugaugcuaucaaucuuagccgggggauuuuugacgagaagcccaccaugaucccguucaaaaagcccaacccugacgaguuugccuccugguucguggccagcuaccaguauaauaacuaccagucuuuuuaugaacugacgcccgauaucguugagagagacaagaaaaagaaauacaagaaucuccgggcuauuaacaaagugaagauccaagauuauuaccugaaacugauggucgacacacuuuaccaggaucuguucaaucagccucucgacaagucccugagcgauuucuaugugucuaaggcggaacgcgagaaaauuaaggccgacgcuaaagccuaccagaagcucaacgauuccagccuguggaauaaaguuauccaccuuucucugcaaaacaacagaauuaccgccaaucccaagcucaaggacaucggaaaauauaagcgggcucugcaggaugagaaaauugccacacugcuuaccuacgacgcgagaaccuggacauaugcucugcagaagccggaaaaagagaacgaaaaugauuacaaggagcuccauuauacggcccugaacauggaacuccaggaguacgagaaggugcgcagcaaagaacugcuuaagcaaguccaggagcuggagaaaaagauccucgacaaauuuuacgacuucuccaauaacgccagccacccugaagaucuggaaaucgaggacaagaagggcaaacggcaucccaauuuuaagcuguauauuaccaaagcccuucugaagaacgagucugaaaucauuaaucucgagaacaucgauauugaaauccugcucaaauacuaugacuacaauacagaggaacugaaggagaaaaucaagaacauggaugaggacgaaaaggcuaaaauuaucaauaccaaggagaacuauaauaaaauuacaaacgugcuuaucaagaaagcucuggugcugauuaucaucagaaacaagauggcccacaaucaguacccucccaaguucauuuaugaucucgcgaaccgcuuuguuccuaaaaaggaagaggaauacuucgccaccuacuuuaauagagucuucgagacgaucacaaaagagcugugggaaaacaaggagaaaaaggacaagacccaaguguga

SEQ ID NO: 11418 - RNA, 3468 nt, Artificial Sequence
  Cas13b variant__Flavobacterium sp.__WP_045968377.1__Cas13b
auggacaacaauaucaccguggagaagacagaacugggccucgggauuacguacaaccacgauaaagucgaggacaagcauuauuucggaggcuuuuucaaucuggcccagaacaauaucgaucuuguugcucaagaauuuaaaaagagacugcucauucaggggaaagacagcaucaacauuuucgccaauuacuuuuccgaucagugcucuaucaccaaccuggagcggggaaucaagauucuugcggaauauuuccccguggugagcuacaucgaccuggaugagaagaauaaauccaagucuauucgcgagcaccucauccugcugcucgaaacaauuaacaaucugagaaacuauuacacccauuauuaccacaaaaagaucauuaucgacggcagccuuuuuccucugcucgauacaauccugcuuaaagucgugcuggagauuaagaagaaaaagcucaaagaagacaagaccaaacagcugcugaagaaagggcucgagaaggagaugacaauccuguucaaucuuaugaaggcugaacaaaaagagaagaaaauuaagggauggaacaucgaugaaaauauuaaaggcgccguucugaaccgggccuuuucccaucuccuguacaacgacgagcuuucugauuaucgcaagagcaaguacaauaccgaagacgagacgcugaaagacacccucacagaguccggcauccuguuccugcucagcuuuuuccugaacaagaaagaacaggagcagcuuaaggcuaauaucaaaggguauaagggaaagauugccucuaucccggaugaagagauuacccugaaaaacaauucccucagaaacauggcuacacacuggaccuacagccaccugacguauaagggccuuaaacaucggaucaagacagaccacgaaaaagagacccugcucgugaauauggucgauuaccugucuaaggugccccaugagauuuaucagaaccuguccgaacaaaauaagagccucuuucuggaggacaucaacgaauacaugcgcgauaaugaggaaaaccacgacucuuccgaggccagcagaguuauccacccugugauucggaaacgcuacgagaauaaguucgcguauuucgccaucagauuucuugaugaguucgcugaguuucccacacugcgguucauggucaacguggggaauuacauucaugacaaccgcaaaaaggauaucggaggcaccucccucauuaccaacagaacaaucaaacagcagauuaauguguuugggaaccugacggaaauccacaagaaaaagaaugacuauuucgagaaggaggaaaacaaagagaagacccuggaaugggagcuuuuuccuaaucccucuuaccauuuccagaaagaaaacaucccuauuuuuaucgaucucgaaaagagcaaagagacaaaugaccuggccaaggaauaugcuaaggagaaaaagaaaauuuucggauccagccggaagaaacaacagaacaccgccaagaagaaucgcgaaacaaucauuaaccuggucuuugacaaauacaagaccucugauagaaaaacgguuacauucgagcagccgaccgcgcuccuguccuuuaaugaacuuaacagcuuccuguaugccuuccucguggagaauaagaccggcaaagagcuggaaaagaucaucauugagaagaucgcuaaccaauaccagauucugaaaaauuguucuagcacaguggacaagaccaacgauaacauccccaaauccauuaagaaaaucgucaauacaacgaccgacucuuuuuacuucgaaggcaagaaaaucgauauugagaaacuugaaaaggacaucacaauugagaucgagaagaccaacgaaaagcucgagacaauuaaagaaaaugaggagagcgcccagaacuauaagcggaaugaaagaaacacccagaaacgcaagcuguaccggaaguauguguuuuucacgaaugagaucgggaucgaagcuaccuggauuacaaacgauauccugagauuucucgacaauaaagagaacuggaagggauaccaacacuccgaacugcagaaauucauuagccaguaugauaauuacaagaaagaggcccuuggccugcucgagucugaauggaaccuggaguccgacgccuuuuucgggcagaaucugaagcgcauguuucaaagcaacucuaccuucgaaacauuuuauaagaaauaccuugauaaucggaagaacacccucgagacguaccuguccgcuaucgaaaaccugaaaacaaugaccgacguuagaccuaaggugcucaaaaagaaguggacagagcuguuccgcuuuuucgauaaaaagauuuaucuucugagcaccaucgagaccaaaauuaaugaacucaucacaaagcccaucaaccugucccggggaauuuucgaggaaaaaccuacguuuaucaauggcaagaaccccaauaaggagaacaaucagcaucuguucgcgaacugguuuauuuacgccaaaaagcagaccauccuucaggacuucuauaaucucccgcuggaacaaccuaaagcuauuacaaaccugaagaaacacaaguacaaacucgagagaucuaucaauaaccugaagaucgaggacauuuauaucaagcagauggucgauuuucuuuaccagaaacuguucgaacagagcuuuauugggucccuccaagaccuguauaccucuaaggagaaacgcgaaaucgagaagggaaaagccaagaaugagcagacacccgaugagagcuucauuuggaagaaacagguggaaaucaacacccacaauggccggaucauugccaagacgaaaaucaaggacauuggcaaauuuaagaaccugcuuacagauaauaagaucgcucaucugauuuccuacgacgauagaaucugggacuucagccucaacaacgauggggacauuaccaaaaagcuguacucuaucaauaccgaacucgaguccuaugaaacaauccgccgggagaaacugcuuaagcaaauucagcaguuugagcaguuccugcucgaacaagagaccgaauacagcgccgagagaaaacacccugaaaaguucgagaaggauugcaaccccaauuuuaaaaaguauaucauugagggaguucugaacaaaaucauucccaaucaugaaaucgaggaaaucgagauucugaagucuaaagaagacguguucaagaucaacuuuuccgauauucuuauccugaauaacgacaauauuaaaaagggcuaccuccugaucaugauccggaacaaguucgcgcacaaucagcucauugacaaaaaccuguuuaauuucagccuucagcuguauucuaagaacgagaaugagaacuuuagcgaauaccucaacaaagucugucagaauaucauucaagaguucaaggaaaaacugaaguga

SEQ ID NO: 11419 - RNA, 3480 nt, Artificial Sequence
  Cas13b variant__Myroides odoratimimus__EHO06562.1__Cas13b
augaaggacauccugaccacagauacgaccgagaaacagaacagauucuacagccacaagauugccgacaaauauuucuucggcggguacuuuaaucucgcuuccaacaauaucuaugaaguguucgaggaagucaacaagcggaauacauuuggaaaacuggccaagcgcgauaacggcaaucuuaagaacuacauuauccauguuuucaaagacgagcugucuauuagcgauuuugaaaagagaguggcgaucuucgcuuccuauuuucccauccucgagaccguggacaaaaagucuauuaaagagcggaaucgcacaaucgaucugacccuuagccaacggauuagacaguuccgcgaaaugcugaucucccucgucacagccguggaccagcugagaaacuuuuacacccacuaucaucacucugauauuguuaucgagaauaaggugcuggacuuccucaacagcuccuuugucagcacggcccugcaugugaaggauaaauaccuuaagaccgacaaaacaaaggaauuucugaaagagaccauugcugccgagcucgauauccugaucgaggcuuacaagaaaaagcagauugaaaagaaaaauacacgguucaaggccaacaaacgcgaagacauccuuaaugcgauuuauaacgaggccuuuuggucuuucaucaacgacaaggauaaagacaaggauaaggaaaccguuguggcuaaaggggccgacgcuuacuuugagaagaaucaccacaaauccaacgauccugacuucgcccugaauauuagcgagaagggaaucgucuaucuccugucuuucuuccugacgaacaaagaaauggauucccucaaggcgaaucugacaggcuuuaaggggaaaguggacagagagagcggaaacucuaucaaguacauggccacccaacggauuuauuccuuccauacauaccgcggccuuaaacagaagaucagaaccagcgaagagggcgugaaagaaacccugcucaugcagaugauugaugagcuguccaaggucccgaauguuguguaucagcaccuuucuacaacgcaacagaacagcuuuaucgaggacuggaaugaauacuacaaggauuaugaggacgacguggaaaccgaugaccugucccgggucauucaucccgugauccgcaaaagauacgaggaucgguucaacuauuuugcuaucagauuccucgacgaauuuuucgauuucccuacacugcgcuuucagguucaccugggggacuacgugcacgaucggagaaccaagcagcucggaaaagucgagagcgaccgcauuaucaaggagaaagugacaguuuucgcccggcugaaggauauuaauucugcuaaagccuccuauuuucauagccuugaggaacaagacaaggaggaacuggauaacaaguggacccucuuccccaauccuucuuacgacuuucccaaagagcacacgcugcagcaucagggcgaacaaaagaacgccgggaaaaucggaauuuaugugaaacuuagagauacacaguacaaggagaaggcugcgcuggaagaggcccgcaagagccucaauccuaaagaacgguccgcuaccaaggccucuaaauacgacaucauuacccagaucaucgaggccaacgacaacgucaagagcgagaaaccgcugguguucacaggccagcccauugcuuaucuguccaugaaugauauccacagcaugcucuuuucucugcuuaccgacaacgccgaacugaagaagacaccugaggaagucgaggcgaaacucauugaucaaaucgggaagcagauuaaugaaauccuguccaaagacacggauaccaagauccugaaaaaguacaaggacaacgaucuuaaagagacagacaccgauaagauuacaagagaccucgcucgcgauaaagaggaaaucgagaagcugauucuggaacagaaacagcgggccgacgauuauaauuacaccagcucuacgaaguucaacaucgacaaauccagaaagcgcaagcaucuccuguuuaaugccgagaaaggaaagauuggcguguggcuugcuaacgacaucaaacgguucauguuuaaggaaagcaaauccaaguggaagggcuaucaacacaccgagcugcagaaacucuucgccuacuuugauacaucuaagagcgaccuggagcugauccuuuccaauaugguuauggugaaagauuaucccauugaacucaucgaccuggucaagaaaucuagaacccugguggauuuccucaacaaguaccuggaggcucggcuugaauacauugagaauguuaucacacgcgugaagaacagcauugggaccccucaguucaaaacggucagaaaggagugcuuuacauuccugaaaaaguccaauuauaccguggugagccucgacaaacagguugaacggauccugucuaugccccuguuuaucgagagaggauucauggaugacaagccgacaaugcuugaaggcaaguccuacaaacaacacaaggagaaauuugccgauugguucguccauuauaaggaaaacagcaauuaccagaacuuuuaugacaccgagguguacgagauuaccacagaagauaaacgcgagaaggcgaaggugacgaaaaagaucaaacagcagcaaaagaacgacgucuucacccucaugauggugaauuauaugcuggaagagguucugaaacucucuuccaacgaccggcugagccuuaaugaacuguaccagacaaaggaggagagaauugugaacaaacaggucgccaaggauacccaagaacgcaauaagaacuacaucuggaauaaagugguugaccuccagcugugugaugggcuggugcacauugacaacgucaaacuuaaggauaucggaaauuuuagaaaguaugagaacgacucucgggugaaagaauuucucacauaccagagcgauauuguuugguccgcuuaucugagcaaugagguggacucuaacaagcuguacgucaucgaacgccagcucgauaauuaugaguccaucagaagcaaggagcugcuuaaagaagugcaagagauugaaugcuccguguacaaccaggucgccaauaaggagucucugaaacagagcggcaacgagaacuuuaagcaguauguucuccaagggcugcugccuaucggaauggacgugcgggaaaugcuuauucuguccaccgaugugaaauucaagaaggaggaaaucauucagcucggccaggcuggcgaggucgaacaggaccuguacucucucaucuacauccgcaauaaauucgcccauaaccaacugcccauuaaggaguuuuucgauuuuugugagaauaacuauagaagcaucuccgacaaugaauacuaugcggaguacuauauggaaauuuuccggucuaucaaagagaaguacgccaacuga

SEQ ID NO: 11420 - RNA, 3474 nt, Artificial Sequence
  Cas13b variant__Myroides odoratimimus__WP_006261414.1__Cas13b
augaaggacauccugaccacagauacgaccgagaaacagaacagauucuacagccacaagauugccgacaaauacuuuuucggcggguauuuuaaucucgcuuccaacaauaucuaugaaguguucgaggaagucaacaagcggaauacauuuggaaaacuggccaagcgcgauaacggcaaucuuaagaacuacauuauccauguuuucaaagacgagcugucuauuagcgauuuugaaaagagaguggcgaucuucgcuuccuauuuucccauccucgagaccguggacaaaaagucuauuaaagagcggaaucgcacaaucgaucugacccuuagccaacggauuagacaguuccgcgaaaugcugaucucccucgucacagccguggaccagcugagaaacuuuuacacccacuaucaucacucugagauuguuaucgaaaauaaggugcuggauuuccucaacagcucccuggucagcacggcccuucaugugaaggacaaauaccugaagaccgauaaaacaaaggaguuucucaaagagaccauugcugccgaacuggacauccuuaucgaggcuuacaagaaaaagcagauugaaaagaaaaauacacgguucaaggccaacaaacgcgaggauauccugaaugcgauuuauaacgaagccuucuggucuuuuaucaacgacaaggacaaagauaaggagaccguuguggcuaagggggccgacgcuuacuucgagaaaaaucaccacaaguccaacgauccugacuuugcccucaauauuagcgaaaaaggaaucgucuaucugcugucuuucuuucucacgaacaaggagauggauucccugaaagcgaaucuuacaggcuucaaggggaagguggacagagaaagcggaaacucuaucaaauacauggccacccaacggauuuauuccuuucauacauaccgcggccugaagcagaaaaucagaaccagcgaggaaggcgugaaggagacccuccugaugcagaugauugaugagcuuuccaaagucccgaauguuguguaucagcaccugucuacaacgcaacagaacagcuucaucgaagacuggaaugaguacuacaaggauuaugaagacgauguggagaccgacgaccucucccgggucauucaucccgugauccgcaagagauacgaagaucgguuuaacuauuucgcuaucagauuucuggacgaguucuuugauuucccuacacugcgcuuccagguucaccucggggacuacgugcacgaucggagaaccaaacagcugggaaaggucgagagcgaccgcauuaucaaagaaaaggugacaguuuuugcccggcuuaaagauauuaauucugcuaaggccaacuauuuccauucccuggaggaacaagacaaagaggagcucgauaauaaguggacccuguuucccaacccuagcuacgacuuccccaaggaacacacgcuucagcaucagggcgagcagaaaaaugccgggaagaucggaauuuaugugaaacugagagauacacaauacaaggaaaaagcugcgcucgaggaagcccgcaagucucugaacccuaaggagcggagcgcuaccaaagccuccaaguacgacaucauuacccagaucaucgaggccaacgauaaugucaaaucugaaaagccgcugguguuuacaggccagcccauugcuuaucucagcaugaacgacauccacuccaugcuguucagccuucugaccgacaaugccgagcucaaaaagacaccugaagaggucgaagcgaagcugauugaucaaaucgggaaacagauuaacgagauccugucuaaggacacggauaccaaaauccuuaagaaauacaaggacaaugaucucaaggagacagacaccgauaaaauuacaagagaccuggcucgcgauaaggaagagaucgaaaaacugauucucgagcagaagcagcgggccgacgauuauaacuacaccuccagcacgaaauuuaauaucgacaagucuagaaaacgcaagcaucugcuuuucaacgccgaaaagggaaaaauuggcguguggcuggcuaaugauaucaagcgguuuaugaccgaggaguucaaauccaaguggaaaggcuaucaacacacagaacuccagaagcuguuugccuacuaugacaccagcaaguccgaccuggaucuuauccucucugacaugguuauggugaaagauuaccccauugagcugaucgcucuggucaagaaaagcagaacacucguggacuuccugaacaaguaccuugaagcccggcugggguauauggagaauguuauuacccgcgugaaaaacuccaucggaacgccucaguuuaagacagucagaaaggagugcuucaccuuccucaaaaagucuaauuacacaguggugagccuggauaaacagguugaacggauucuguccaugccccuuuuuaucgagagaggcuucauggacgauaagccgaccaugcucgaagggaaaagcuaucaacagcacaaggagaaguuugcggacugguucguccauuacaaagaaaacucuaauuaucagaacuuuuacgauaccgagguguaugagaucacaacggaagacaagcgcgagaaagccaaggugaccaaaaagauuaagcagcaacagaaaaacgaugucuucacacugaugauggugaauuacaugcuggaagagguucucaagcuguccagcaacgaccggcuuucucugaaugaacucuaccagaccaaagaggagagaaucgugaacaagcaagucgcuaaagacacacaggaacgcaauaagaacuauauuuggaauaaagugguugaucugcagcugugugagggacuugugagaaucgacaaggucaagcucaaagauauuggcaacuuucggaaguacgaaaaugacucccgcgugaaagaguuccugaccuaucagagcgauaucguuuggucugccuaccugagcaacgaaguggacuccaauaagcucuaugucauugagagacaacuggauaacuacgagagcauccggucuaaagaacuucugaaggaggugcaggaaaucgagugcuccguguauaaucaggucgcuaacaaggagagccucaaacaguccgggaaugaaaacuuuaagcaauacguucugcagggacuggugccuauuggcauggacgugcgcgagaugcuuauccugucuacggaugucaaauucauuaaggaagagaucauucagcucggccaggccggggaaguggagcaagaccuguacagccucaucuauaucagaaacaaauuugcgcacaaucagcugcccauuaaggaguucuucgauuuuugugaaaacaauuaccgguccaucucugacaacgaguauuacgccgaauauuacauggagauuuuccgcagcaucaaggaaaaauauacauccuga

SEQ ID NO: 11421 - RNA, 3474 nt, Artificial Sequence
  Cas13b variant__Myroides odoratimimus__EKB06014.1__Cas13b
augaaggacauccugaccacagauacgaccgagaaacagaacagauucuacagccacaagauugccgacaaauacuuuuucggcggguauuuuaaucucgcuuccaacaauaucuaugaaguguucgaggaagucaacaagcggaauacauuuggaaaacuggccaagcgcgauaacggcaaucuuaagaacuacauuauccauguuuucaaagacgagcugucuauuagcgauuuugaaaagagaguggcgaucuucgcuuccuauuuucccauccucgagaccguggacaaaaagucuauuaaagagcggaaucgcacaaucgaucugacccuuagccaacggauuagacaguuccgcgaaaugcugaucucccucgucacagccguggaccagcugagaaacuuuuacacccacuaucaucacucugagauuguuaucgaaaauaaggugcuggauuuccucaacagcucccuggucagcacggcccuucaugugaaggacaaauaccugaagaccgauaaaacaaaggaguuucucaaagagaccauugcugccgaacuggacauccuuaucgaggcuuacaagaaaaagcagauugaaaagaaaaauacacgguucaaggccaacaaacgcgaggauauccugaaugcgauuuauaacgaagccuucuggucuuuuaucaacgacaaggacaaagauaaggagaccguuguggcuaagggggccgacgcuuacuucgagaaaaaucaccacaaguccaacgauccugacuuugcccucaauauuagcgaaaaaggaaucgucuaucugcugucuuucuuucucacgaacaaggagauggauucccugaaagcgaaucuuacaggcuucaaggggaagguggacagagaaagcggaaacucuaucaaauacauggccacccaacggauuuauuccuuucauacauaccgcggccugaagcagaaaaucagaaccagcgaggaaggcgugaaggagacccuccugaugcagaugauugaugagcuuuccaaagucccgaauguuguguaucagcaccugucuacaacgcaacagaacagcuucaucgaagacuggaaugaguacuacaaggauuaugaagacgauguggagaccgacgaccucucccgggucauucaucccgugauccgcaagagauacgaagaucgguuuaacuauuucgcuaucagauuucuggacgaguucuuugauuucccuacacugcgcuuccagguucaccucggggacuacgugcacgaucggagaaccaaacagcugggaaaggucgagagcgaccgcauuaucaaagaaaaggugacaguuuuugcccggcuuaaagauauuaauucugcuaaggccuccuauuuccauagccuggaggaacaagacaaagaggagcucgauaacaaguggacccuguuucccaauccuucuuacgacuuccccaaggaacacacgcuucagcaucagggcgagcaaaagaacgccgggaagaucggaauuuaugugaaacugagagauacacaguacaaggaaaaagcugcgcucgaggaagcccgcaagagccugaauccuaaggagcgguccgcuaccaaagccucuaaguacgacaucauuacccagaucaucgaggccaacgauaacgucaaaagcgaaaagccgcugguguuuacaggccagcccauugcuuaucucuccaugaaugacauccacagcaugcuguucucucuucugaccgacaacgccgagcucaaaaagacaccugaagaggucgaagcgaagcugauugaucaaaucgggaaacagauuaaugagauccuguccaaggacacggauaccaaaauccuuaagaaauacaaggacaacgaucucaaggagacagacaccgauaaaauuacaagagaccuggcucgcgauaaggaagagaucgaaaaacugauucucgagcagaagcagcgggccgacgauuauaauuacaccagcucuacgaaauuuaacaucgacaaguccagaaaacgcaagcaucugcuuuucaaugccgaaaagggaaaaauuggcguguggcuggcuaacgauaucaagcgguuuauguucaaagagagcaaguccaaauggaagggcuaucaacacaccgagcuccagaagcuguuugccuacuucgacacaucuaaaagcgaccuggaacuuauccucuccgauaugguuauggugaaggacuaucccauugagcugaucgaucuggucagaaaaucucggacccucguggacuuucugaauaaguaccuugaagcucgccugggguacauugagaacguuaucacaagagugaaaaauagcauuggaaccccucaguucaagacgguccggaaggagugcuucgccuuucucaaagaauccaacuauacaguggcgagccuggauaagcagaucgagagaauccugucuaugccccuuuucauugaacgcggcuuuauggacuccaaaccgaccaugcucgaggggaaaagcuaccaacagcacaaagaagauuucgccgacugguuugugcauuauaaggaaaauucuaacuaccagaauuucuaugauacagagguuuacgaaaucauuaccgaggacaagcgggaacaggcuaaagucaccaagaaaaucaagcaacagcagaaaaacgauguguuuacacugaugauggugaacuauaugcuggaggaaguccucaagcugccuuccaaugacagacuuagccugaacgagcucuaccaaacgaaggaggaacgcauugugaauaaacagguugccaaggacacccaggagagaaacaaaaauuacaucuggaacaagguggucgaucugcagcugugugaaggacuugugcggauugacaaaguuaagcucaaagauaucggcaauuuccgcaaguaugagaacgacucuagagugaaggaauuucugacauaccaaagcgauaucgucugguccggguaucugagcaaugagguggacucuaacaaacucuacguuauugagcggcagcuggauaauuaugaauccauccgcagcaaggagcuucugaaagaagugcaggagauugagugcaucgucuacaaccagguggcuaauaaggaaucccucaaacaaucuggaaacgagaauuucaagcaguaugugcugcagggccugcuucccagaggcaccgacguccgggaaaugcugauucucagcacagauguuaaguuuaaaaaggaggaaaucaugcagcuggggcaagugcgcgagguggagcaggaccucuacucccugaucuacauuagaaacaaauucgcccacaaccagcuuccuaucaaggaguucuuugauuucugugagaauaacuaucggcccauuucugacaaugaauacuaugcggaguacuauauggaaaucuuucgcagcauuaaagagaaguacgccuccuga

SEQ ID NO: 11422 - RNA, 3480 nt, Artificial Sequence
  Cas13b variant__Myroides odoratimimus__WP_058700060.1__Cas13b
augaaggacauccugaccacagauacgaccgagaaacagaacagauucuacagccacaagauugccgacaaauauuucuucggcggguacuuuaaucucgcuuccaacaauaucuaugaaguguucgaggaagucaacaagcggaauacauuuggaaaacuggccaagcgcgauaacggcaaucuuaagaacuacauuauccauguuuucaaagacgagcugucuauuagcgauuuugaaaagagaguggcgaucuucgcuuccuauuuucccauccucgagaccguggacaaaaagucuauuaaagagcggaaucgcacaaucgaucugacccuuagccaacggauuagacaguuccgcgaaaugcugaucucccucgucacagccguggaccagcugagaaacuuuuacacccacuaucaucacucugauauuguuaucgagaauaaggugcuggacuuccucaacagcuccuuugucagcacggcccugcaugugaaggauaaauaccuuaagaccgacaaaacaaaggaauuucugaaagagaccauugcugccgagcucgauauccugaucgaggcuuacaagaaaaagcagauugaaaagaaaaauacacgguucaaggccaacaaacgcgaagacauccuuaaugcgauuuauaacgaggccuuuuggucuuucaucaacgacaaggauaaagacaaggauaaggaaaccguuguggcuaaaggggccgacgcuuacuuugagaagaaucaccacaaauccaacgauccugacuucgcccugaauauuagcgagaagggaaucgucuaucuccugucuuucuuccugacgaacaaagaaauggauucccucaaggcgaaucugacaggcuuuaaggggaaaguggacagagagagcggaaacucuaucaaguacauggccacccaacggauuuauuccuuccauacauaccgcggccuuaaacagaagaucagaaccagcgaagagggcgugaaagaaacccugcucaugcagaugauugaugagcuguccaaggucccgaauguuguguaucagcaccuuucuacaacgcaacagaacagcuuuaucgaggacuggaaugaauacuacaaggauuaugaggacgacguggaaaccgaugaccugucccgggucacacaucccgugauucgcaaaagauacgaggaucgguucaacuauuuugcuaucagauuccucgacgaauuuuucgauuucccuacccugcgcuuucagguucaccugggggacuacgugcacgaucggagaacaaagcagcucggaaaagucgagagcgaccgcaucauuaaggagaaagugaccguuuucgcccggcugaaggauaucaauucugcuaaagccuccuauuuucauagccuugaggaacaagacaaggaggaacuggauaacaaguggacacucuuccccaauccuucuuacgacuuucccaaagagcacacgcugcagcaucagggcgaacaaaagaacgccgggaaaauuggaaucuaugugaaacuuagagauacccaguacaaggagaaggcugcgcuggaagaggcccgcaagagccucaauccuaaagaacgguccgcuaccaaggccucuaaauacgacauuaucacacagauuaucgaggccaacgacaacgucaagagcgagaaaccgcugguguucaccggccagcccaucgcuuaucuguccaugaaugauauucacagcaugcucuuuucucugcuuacagacaacgccgaacugaagaagacgccugaggaagucgaggcgaaacucaucgaucaaauugggaagcagaucaaugaaauucuguccaaagacaccgauacaaagauccugaaaaaguacaaggacaacgaucuuaaagagaccgacacagauaagaucaccagagaccucgcucgcgauaaagaggaaauugagaagcugauccuggaacagaaacagcgggccgacgauuauaauuacacgagcucuaccaaguucaacauugacaaauccagaaagcgcaagcaucuccuguuuaaugccgagaaaggaaagaucggcguguggcuugcuaacgacauuaaacgguucauguuuaaggaaagcaaauccaaguggaagggcuaucaacacaucgagcugcagaaacucuucgccuacuuugauacaucuaagagcgaccuggagcugauccuuuccaauaugguuauggugaaagauuaucccauugaacucaucgaccuggucaagaaaucuagaacccugguggauuuccucaacaaguaccuggaggcucggcuugaauacauugagaauguuaucacacgcgugaagaacagcauugggaccccucaguucaaaacggucagaaaggagugcuuuacauuccugaaaaaguccaauuauaccguggugagccucgacaaacagguugaacggauccugucuaugccccuguuuaucgagagaggauucauggaugacaagccgacaaugcuugaaggcaaguccuacaaacaacacaaggagaaauuugccgauugguucguccauuauaaggaaaacagcaauuaccagaacuuuuaugacaccgagguguacgagauuaccacagaagauaaacgcgagaaggcgaaggugacgaaaaagaucaaacagcagcaaaagaacgacgucuucacccucaugauggugaauuauaugcuggaagagguucugaaacucucuuccaacgaccggcugagccuuaaugaacuguaccagacaaaggaggagagaauugugaacaaacaggucgccaaggauacccaagaacgcaauaagaacuacaucuggaauaaagugguugaccuccagcugugugaugggcuggugcacauugacaacgucaaacuuaaggauaucggaaauuuuagaaaguaugagaacgacucucgggugaaagaauuucucacauaccagagcgauauuguuugguccgcuuaucugagcaaugagguggacucuaacaagcuguacgucaucgaacgccagcucgauaauuaugaguccaucagaagcaaggagcugcuuaaagaagugcaagagauugaaugcuccguguacaaccaggucgccaauaaggagucucugaaacagagcggcaacgagaacuuuaagcaguauguucuccaagggcugcugccuaucggaauggacgugcgggaaaugcuuauucuguccaccgaugugaaauucaagaaggaggaaaucauucagcucggccaggcuggcgaggucgaacaggaccuguacucucucaucuacauccgcaauaaauucgcccauaaccaacugcccauuaaggaguuuuucgauuuuugugagaauaacuauagaagcaucuccgacaaugaauacuaugcggaguacuauauggaaauuuuccggucuaucaaagagaaguacgccaacuga

SEQ ID NO: 11423 - RNA, 3465 nt, Artificial Sequence
  Cas13b variant__Paludibacter propionicigenes__WP_013446107.1__Cas13b
augaagaccagcgccaacaauaucuacuucaacggcauuaauuccuuuaaaaagaucuucgacucuaaaggggcuauugcccccaucgcggaaaagagcugcagaaacuuugauauuaaagcucagaaugacgugaacaaggaacaacggauccacuauuucgccgucggacauacauuuaagcagcuggauacggagaaucucuucgaauacguucuggacgagaaccuucgcgccaaaagaccuacccgguuuaucucccugcagcaguucgauaaggaauuuauugagaauaucaaacgccucauuucugacaucagaaacauuaauagccacuauauccaucgguucgauccgcugaagauugacgcugugcccacaaacaucaucgauuuucuuaaagaguccuucgaacuggccgugauucaaaucuaccucaaggagaagggcauuaauuaucugcaguuuucugaaaacccucacgcugaccagaaacuggucgccuuccuccaugauaaguuccugccccuugacgagaaaaagaccagcaugcugcagaaugagacaccucaacucaaagaauacaaggaguaucgcaaauacuuuaagacccuguccaagcaggcggccaucgaucagcuucuguucgcugaaaaagagacagacuacauuuggaaccucuuugacagccaccccgugcugaccaucucugccgggaaguaucuguccuucuacagcugucucuuucugcuuucuauguuccuguauaaauccgaagcuaaccagcucaucagcaagauuaaaggauuuaagaagaauacgaccgaggaggaaaaaucuaagagagagaucuucacauuuuucuccaaacgguuuaacagcauggauauugacuccgaagagaaucaacugguuaaguuccgcgaucuuauccuguaccucaaccacuauccuguggccuggaauaaagaccuggaacuggauucuagcaacccggcgaugaccgacaagcucaaguccaaaauuaucgagcuggagaucaaucggagcuuuccccuuuacgaaggcaacgagcgguucgccacauucgcuaaguaucagauuugggggaaaaagcaucugggaaaaucuaucgaaaaggaguacauuaaugccuccuuuaccgaugaagagaucacggcuuacacauaugagaccgacacaugcccugaacucaaggaugcccacaaaaagcuggccgaccuuaaagcugcgaagggccuguucggcaaacgcaaggagaaaaacgaaagcgauauuaagaagaccgagaccucuaucagagagcuccagcaugaacccaauccuauuaaagacaagcugauccaacggaucgagaaaaaccugcucacagucagcuacgggcgcaaucaggacagauuuauggauuucuccgcccgguuucuggcugaaauuaacuauuucggacaggacgccucuuuuaagauguaccacuucuaugccacggaugagcagaauagcgaacuugagaaauacgagcugcccaaggacaagaaaaaguaugauucccucaaauuucaccaaggcaagcuggugcauuucaucagcuacaaagaacaccugaagagauacgagucuugggacgaugcuuuuguuauugaaaacaacgccauccagcuuaagcucuccuucgacgggguggagaauaccgucacaauucagcgcgcgcugcugaucuaucuccuggaagaugcccuucggaacauccagaauaacaccgcugagaaugccggaaaacaacugcuccaggaguacuauagccauaacaaggcugaccugucugccuuuaaacagauucugacacagcaagauuccaucgaaccgcagcagaagaccgaguucaaaaagcuccuuccuagacgccugcugaauaacuacagccccgcuauuaaucaccuccagacgccucauuccucucugccccuuauccuggaaaaggcccuccuggcggagaaacgguauuguagccugguggugaaggccaaagcugaaggcaacuacgacgauuucauuaagagaaauaaagggaagcaauuuaaacuucaguucauccgcaaggccuggaaccucauguauuuuagaaauuccuaccugcagaacguccaagcugccggacaccacaagucuuuccauaucgagagagacgaguuuaaugacuucagccgcuacauguuugcguucgaggagcugucccaguauaaauacuaucucaacgaaauguuugagaagaaaggcuucuuugagaacaaugaguucaagauucuguuccagagcggcacaucucuugaaaaccuguacgagaaaaccaagcagaaguuugaaaucuggcucgccuccaauaccgcuaaaacaaacaagcccgauaauuaucaccugaacaauuacgaacaacaguucagcaaccagcuguuuuucauuaaucuuucucauuuuaucaacuaucucaaauccaccgggaagcugcagacagacgccaauggacaaauuaucuacgaggcucugaacaauguucaguaccucaucccugaguauuacuauacggauaaaccggaacggagcgagucuaagagcggcaacaagcuguacaauaaacuuaaggccaccaaacuggaagacgcccuccuguaugagauggcuaugugcuaccugaaggcggauaaacagauugccgacaaggcuaagcaccccaucacaaaacuucugaccuccgauguggaguucaacauuacaaacaaggaagggauccagcucuaucaucugcucgugccuuuuaaaaagauugacgccuucaucggacugaaaaugcacaaggagcaacaggauaagaaacaccccaccagcuuucuugccaauauugucaacuaccuggaacucgugaagaaugacaaagauaucagaaagacguacgaggcuuucucuaccaacccuguuaaacgcacacugaccuaugacgaucuggccaagaucgacggccaucuuauuuccaaaagcaucaaguuuacaaaugugacccuggaacucgagcgguacuucauuuuuaaggaaucccugaucgucaaaaaggggaacaauauugacuucaaauauaucaagggacucagaaacuacuauaauaacgagaaaaagaagaaugagggcauccggaacaaagcguuccacuuuggcauucccgauucuaagagcuacgaccagcugauccgcgaugcugaagugauguucauugccaaugagguuaaaccgacgcaugccacaaaguauaccgaccuuaacaaacaacugcacacagugugugauaagcucauggaaaccguccacaaugacuacuuuuccaaggagggggauggcaaaaagaaaagagaggcugccggacagaaguacuucgaaaacaucauuucugcgaaauga

SEQ ID NO: 11424 - RNA, 3396 nt, Artificial Sequence
  Cas13b variant__Phaeodactylibacter xiamenensis__WP_044218239.1__Cas13b
augaccaacacacccaagagacggacgcugcaccgccauccuagcuacuucggcgccuuucucaauaucgcuagacacaacgccuucaugauuauggagcaucuguccaccaaauaugacauggaagauaagaauacacuugacgaggcgcagcugccgaacgcuaaacucuuugggugccugaagaaacgguacggaaagcccgaugugaccgaaggcgucucucgcgaccuuagacgguauuucccuuuucugaauuacccccucuuccugcaccuggagaagcaacagaacgccgaacaggccgcuacauaugauaucaauccugaggacauugaguuuacccucaaaggguucuuucgccugcuuaaccagaugagaaauaacuacagccauuauaucuccaauacagauuacggaaaguucgacaaacugcccguucaagauauuuacgaagccgcuaucuuucggcuccuggaccgcggcaagcacaccaaaagauucgauguguuugagucuaagcacacgcggcaucuugaaagcaacaauuccgaguaucgcccuagaucucuggccaacagcccggaccacgagaauaccguggcguucgucacaugucucuuccuggaacggaaguacgccuuucccuuccugucccgccucgauugcuuuagaagcaccaacgacgcugccgagggggacccucugauccggaaggcuucucaugaauguuauacaauguucugcuguagacuuccccagccuaaacuggaguccagcgauauucuccuggacauggugaacgaacuuggacgcugccccucugcccuguacaaucuccuguccgaggaggaucaggcgcgguuucacaucaaaagagaagagauuaccggcuucgaagaggacccggaugaagaacuggagcaggaaaucguucucaagcgccacagcgaccgguuuccuuauuucgcccugagauacuuugaugacacggaggcuuuccaaacacuucgcuuugauguguaucugggccgguggagaaccaaacccgucuacaagaaacgcauuuacgggcaggaacgggacagagugcucacacagucuauccgcaccuucacccggcuguccagacuucugccuauuuaugagaacguuaagcaugaugccgugcggcagaaugaagaggacggaaagcucgucaaccccgacgugacaagccaauuucacaaauccuggauccagaucgagucugaugaccgcgcuuuccugagcgauagaauugaacauuucagcccccacuacaauuuuggcgaccaggugaucgggcugaaguucauuaacccugaucgguaugccgccauccaaaaugucuuuccgaaacuccccggagaggaaaagaaagacaaggaugcuaagcugguuaacgagacggcggacgccauuaucuccacccaugagaucagaucucuuuuccuguaccacuaucucuccaaaaagccuauuagcgcuggcgaugaacgccgguuuauccagguggacacagagaccuucauuaaacaguacaucgauacaauuaagcuguuuuucgaagacaucaaaucuggggagcugcagcccaucgccgauccucccaauuaucaaaagaacgaaccgcuuccuuacgugagaggagacaaggagaaaacccaggaggaacgcgcccaguacagagagcggcagaaggaaauuaaagagcgcagaaaggaacucaauacgcugcugcaaaaccgguauggccucagcauccaguacauucccucccgccugagagaguaucuucugggcuacaaaaaggucccuuaugagaagcucgcucugcagaaacugcgggcccagcgcaaggaagugaaaaagagaaucaaagacauugagaagaugcggacaccccgcguuggggaacaagcgaccuggcuugcugaggauaucguguuucucaccccucccaaaaugcacacaccggaaagaaagaccacaaagcauccucagaaacugaauaacgaccaguuccggauuaugcagucuagccuggccuacuuuuccgucaauaagaaagccaucaagaaauucuuucaaaaggagacgggaaucggccucagcaacagagagaccucucaccccuuccuguaucgcauugauguggggcgguguagaggaauccuugacuucuacacaggcuaccugaaguauaaaauggauuggcucgacgaugcuauuaagaaaguugacaaccgcaagcaugggaaaaaggaagccaagaaauacgagaaguaucugcccuccagcauccagcacaaaaccccucuggaacuugauuacacacggcucccgguguaucugcccagaggacuguuuaagaaagcuauugucaaggcccucgcggcccacgcugacuuccagguggagccugaggaagauaaugucaucuuuugccuggaccaacuucuggauggcgacacccaggacuucuacaacuggcagcgcuauuaccggucugcccucacggagaaggaaaccgauaaucagcuggugcuggcucaucccuacgccgagcaaauccuuggcacaauuaaaacccucgaagggaagcagaaaaacaauaagcugggaaacaaagcgaagcagaaaaucaaggacgagcugauugaucucaagagagccaaacgccggcugcuugacagagagcaguaucugcgggcuguucaagccgaagaucgcgcucucuggcugaugauccaggagagacagaagcagaaagccgaacacgaggaaauugccuuugaccaacuggaucuuaagaauaucacaaaaauccugaccgaguccauugacgcucggcuccgcaucccugauacgaagguggacauuacagauaagcugccccucagacgguacggcgaccugagacgcgucgcgaaagaccggagacuugugaaccuggccagcuauuaccauguugcugggcucuccgagaucccuuaugaucuggugaagaaagaacuggaggaauacgaccgccggagagucgccuucuuugagcacguguaucaguucgaaaaggagguguacgaucgcuacgccgcugagcuucggaaugaaaaccccaaaggagagucuaccuauuuuagccauugggaauacguugccgucgcggugaagcacuccgcugacacacacuucaaugagcuguuuaaggagaaagugaugcagcucagaaacaaguuccaucacaaugaguucccguauuuugauuggcugcucccugaggucgaaaaagccucugccgcucuguacgccgaccgcguguucgauguugcggagggcuauuaccaaaagaugagaaaacuuaugcggcaguga

SEQ ID NO: 11425 - RNA, 3408 nt, Artificial Sequence
  Cas13b variant__Porohyromonas gingivalis__WP_012458151.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccguguuuuucaagccugacgacuuuguccucgccaaaaauagaaaggagcagcugaucagcguggcugauggaaaagagugccugacaguuucuggcuucgccuuuuucaucugucucuuccuggaccgggaacaggcuuccggcaugcuuagccgcauuagaggguuuaagcggaccgaugagaacugggcccgcgcggugcacgaaacguucugcgaccuguguaucagacauccccacgaucggcucgaguccucuaauaccaaggaagcccugcuucuggacaugcucaacgagcugaauagaugcccucgcauucuguaugauaugcucccggaggaggaacgggcucaguuucugcccgcccuugacgaaaacagcaugaauaaccuguccgagaauagccucgaugaagagucuagacugcuuugggacggauccagcgauugggcugaggcccugacaaaacgcauccggcaucaagacagauucccuuaccucaugcugcgcuuuauugaagagauggaccugcucaagggcauccgguucagagucgaucugggggaaauugagcuugacucuuacagcaaaaaggugggacgcaacggcgaauaugaucggaccaucacagaccacgcgcuggccuuugggaaacucuccgauuuccagaacgaggaggaagugucuagaaugaucagcggagaggcuuccuaccccguccgcuuuagccuguucgccccucgguaugcuauuuacgacaauaagaucggcuauugucacaccucugaucccguuuacccgaaauccaagacgggcgaaaagagagcccugagcaacccucagucuaugggguuuauuuccgugcaugaccuucggaaacuccugcugauggagcuccugugcgagggcagcuucucccgcaugcagucugauuuucuuagaaaggccaaucggauccuggacgaaacagcugagggaaaacuccaauucagcgcgcuguuccccgaaaugagacaccgcuuuauuccuccccagaaccccaaguccaaagaucggagagagaaggccgaaaccacacuggagaaguauaaacaggagaucaaggggcgcaaagacaaacuuaauucucaacuccugagcgcuuucgauauggaccagagacagcugccuucccggcuccuggacgaauggaugaacauccgcccggccagccauucugugaaacuuagaaccuacgucaagcagcugaaugaggauugucggcuccgccugagaaaguuucggaaagacggagauggcaaggcccgcgcuauuccccuggugggggaaauggccaccuuccuuucccaagacaucguuagaaugauuaucagcgaggaaacaaagaagcucauuacgucugcguacuauaacgagaugcagcggucccuggcucaguacgccggagaggaaaaucgcagacaguuucgggccaucguggcugagcugagacuccuggauccuagcucuggccaccccuuccuuagcgccaccauggaaacagcucaucgcuauaccgagggcuuuuacaaaugcuaucuggaaaagaagcgggaguggcucgccaaaaucuucuacagaccugagcaagacgaaaacacaaagcgccggauuuccgucuuuuucgugcccgauggggaggcgagaaaacugcugccgcuucucauccgccggagaaugaaggaacagaaugaccugcaggauuggauucgcaacaaacaggcccacccuaucgaccugcccagccaccucuuugauucuaagguuauggagcugcuuaaagugaaggacggaaagaaaaaguggaaugaggcuuucaaagauuggugguccaccaaguauccugacggcaugcaacccuuuuacgggcugcggagagaacucaacauucauggaaaaagcgucuccuacaucccuucugacggcaagaaguucgccgauuguuauacgcaccugauggagaaaacagugcgggacaagaaacgcgaacugagaaccgcugggaagcccgucccgccugaucuugccgcggacauuaaacggagcuuccaucgcgccgugaaugagagagaauuuaugcugcggcucguucaggaggaugacagacugaugcucauggcuaucaacaagaugaugaccgaucgcgaggaagacauccugcccggccuuaagaacauugauuccauccuggacgaggaaaaucaguucucucucgccgugcacgcuaaaguccuggagaaggaaggagagggcggggauaacagccugucccuugugcccgccacaauugagaucaaaucuaagcggaaagacuggagcaaguacauuagauaucgcuacgaccggagaguuccuggacugaugucccacuuuccggaacauaaggccacccucgaugaggugaaaacacugcucggcgaauaugaccgcugccggaucaagaucuucgauugggcuuuugcgcuggagggggccauuaugagcgacagagaucuuaaacccuaccugcacgaaucuuccagccgcgagggaaagucuggcgagcauuccacgcucgucaaaaugcugguggaaaagaaagggugccugaccccugacgagagccaguaucuuauccugauuagaaauaaggcugcccacaaccaauuccccugugccgcugaaaugccucucaucuaccgggaugugucugccaagguuggcuccauugagggaagcuccgcgaaagaccugcccgagggcagcucucucgucgauagccuguggaagaaauacgaaaugaucauccgcaagauucuuccuauccuggaccccgagaauagauuuuucgggaaacugcucaacaauaugucccagccgauuaacgaucuguga

SEQ ID NO: 11426 - RNA, 3408 nt, Artificial Sequence
  Cas13b variant__Porohyromonas gingivalis__ERJ81987.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucagucuaugggguucauuuccguucaugaccuccggaaacugcugcucauggagcugcuuugcgagggcagcuuuucccgcaugcagucuggauuccugagaaaggccaaccggauccucgaugaaacagcugaggggaaacugcaauuuagcgcgcuguuccccgaaaugagacaccgcuucauuccuccccagaaucccaaguccaaagaccggagagagaaggccgaaaccacacuugagaaguauaaacaggagaucaagggacgcaaagauaagcucaacucucaacugcugagcgcuuuugacaugaaucagagacagcucccuucccggcugcuugaugaauggaugaacauccgcccggccagccauucugugaaacugagaaccuacgugaagcagcucaaugaggacugucggcugcgccugagaaaguuccggaaagacggcgaugggaaggcccgcgcuauuccccuugucggagaaauggccaccuuucucucccaagacaucgugagaaugauuaucagcgaggaaacgaaaaagcugauuacaucugcguacuauaacgagaugcagcggucccuggcucaguacgccggcgaggaaaaucgcagacaguuccgggccaucguugcugagcuccaucugcuugauccuagcucuggccaccccuuucugagcgccaccauggaaacagcucacagauauaccgaggacuucuacaaaugcuaucucgaaaagaagcgcgaguggcuggccaaaacauuuuaccggccugagcaagaugaaaacaccaagagacgcaucuccguguucuuuguccccgacggggaggcgcggaaacugcuuccgcuccugauuagacgccggaugaaggaacagaaugaucugcaggacuggaucagaaacaaacaggcccacccuauugaucuccccagccaucuguucgacucuaagaucauggagcuucugaaagugaaggauggaaagaaaaaguggaaugaggcuuuuaaagacuggugguccacgaaguauccugauggcaugcaacccuucuacgggcuccgccgggaacugaacauucacggaaaaagcguuuccuacaucccuucugacggcaagaaguuugccgacuguuauacacaucugauggagaaaaccgugcaggauaagaaaagagaacuucggaccgcugggaagcccgucccgccugaccuggccgcggauauuaaacgcagcuuccacagagccgugaacgagcgggaguucaugcuccgccugguccaggaggacgauagacucaugcugauggcuaucaauaagaugaugacagaccgggaggaagauauccuucccggccugaagaacauugacuccauccucgaugaggaaaaucaguuuucucuggccgugcacgcuaaaguucuggagaaggaaggagagggcggggacaacagccuuucccuggugcccgccaccauugagaucaaaucuaagagaaaagauuggagcaaguacauucgcuaucgguacgacagacgcgucccuggacucaugucccauuucccggaacacaaggccacacuggacgaggugaaaacgcuccugggcgaauaugaucggugcagaaucaagaucuuugacugggcuuucgcgcuugagggggccauuaugagcgaucgcgaccugaaacccuaccuccaugaaucuuccagccgggagggaaagucuggcgagcacuccacccugguuaaaaugcugguggaaaagaaagggugccuuacaccugaugagagccaauaucugauccucauuagaaauaaggcugcccauaaccaguuucccugugccgcugaaaugccucugaucuaccgcgacgucucugccaaggugggcuccauugagggaagcuccgcgaaagaucuccccgagggcagcucucugguggacagccuuuggaagaaauacgaaaugaucaucagaaagauucugccuauccuggaucacgagaaucgguucuuugggaaacuccugaacaauaugucccagcccauuaacgaccuuuga

SEQ ID NO: 11427 - RNA, 3408 nt, Artificial Sequence
  Cas13b variant__Porohyromonas gingivalis__ERJ65637.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucggucuaugggguucauuuccguucaugaccuccgcaaacugcugcucauggagcugcuuugcgagggcagcuuuuccagaaugcagucugauuuccugcggaaggccaacagaauccucgacgaaacagcugagggaaaacugcaguuuagcgcgcuguuccccgaaaugcgccaccgguucauuccuccccaaaaucccaaguccaaagauagacgcgagaaggccgaaaccacacuugagaaguauaaacaggagaucaaggggagaaaagacaagcucaacucucagcugcugagcgcuuuugauauggaccaacggcagcucccuucccgccugcuugacgaauggaugaauaucagaccggccagccauucugugaaacugcggaccuacgugaagcagcucaacgaggauugucgccugagacugcagaaguuccggaaagacggagauggcaaggcccgcgcuauuccccuugucggggaaauggccaccuuucucucccaagacaucgugagaaugauuaucagcgaggaaacgaaaaagcugauuacaucugcguacuauaaugagaugcagcggucccuggcucaguacgccggagaggaaaaccgccaccaguucagagccaucguugcugagcuccggcugcuugauccuagcucuggccaucccuuucugagcgccaccauggaaacagcucacagauauaccgaggacuucuacaaaugcuaucucgaaaagaagcgcgaguggcuggccaaaacauuuuaccggccugagcaagaugaaaauaccaagagacgcaucuccguguucuuuguccccgacggcgaggcgcggaaacugcuuccgcuccugauuagacgccggaugaaggaacagaacgaucugcaggacuggaucagaaauaaacaggcccacccuauugaucuccccagccaucuguucgacucuaagaucauggagcuucugaaagugaaggaugggaagaaaaaguggaacgaggcuuuuaaagacuggugguccacgaaguauccugacggaaugcaacccuucuacggccuccgccgggaacugaauauucacgggaaaagcguuuccuacaucccuucugauggaaagaaguuugccgacuguuauacacaucugauggagaaaaccgugcaggauaagaaaagagaacuucggaccgcuggcaagcccgucccgccugaccuggccgcggauauuaaacgcagcuuccacagagccgugaacgagcgggaguucaugcuccgccugguccaggaggacgauagacucaugcugauggcuaucaacaagaugaugacagaccgggaggaagauauccuucccgggcugaagaauauugacuccauccucgaugaggaaaaccaguuuucucuggccgugcacgcuaaaguucuggagaaggaaggcgagggaggcgacaauagccuuucccuggugcccgccaccauugagaucaaaucuaagagaaaagacuggagcaaguacauucgcuaucgguacgauagacgcgucccugggcucaugucccauuucccggaacacaaggccacacuggacgaggugaaaacgcuccugggagaauaugaucggugcagaaucaagaucuuugacugggcuuucgcgcuugagggcgccauuaugagcgaucgcgaccugaaacccuaccuccaugaaucuuccagccgggaggggaagucuggagagcacuccacccugguuaaaaugcugguggaaaagaaaggcugccuuacaccugaugagagccaauaucugauccucauuagaaacaaggcugcccauaaucaguuucccugugccgcugaaaugccucugaucuaccgcgacgucucugccaaggugggguccauugagggcagcuccgcgaaagaucuccccgagggaagcucucugguggacagccuuuggaagaaauacgaaaugaucaucagaaagauucugccuauccuggaucccgagaaccgguucuuuggcaaacuccugaauaacaugucccagccgauuaaugaccuuuga

SEQ ID NO: 11428 - RNA, 3408 nt, Artificial Sequence
  Cas13b variant__Porohyromonas gingivalis__WP_021665475.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccaacgagaauugggcccgcgcgguucacgaaacguuuugcgaccucuguaucagacauccccacgaucggcuggaguccucuaacaccaaggaagcccuucugcucgacaugcugaaugagcugaacagaugcccucgcauucucuaugauaugcugccggaggaagaacgggcucaguuccuucccgcccuggacgaaaauagcaugaacaaucucuccgagaacagccugaacgaagagucuagacuucugugggauggauccagcgacugggcugaggcccucacaaaacgcauccggcaucaagauagauuuccuuaccugaugcugcgcuucauugaagagauggaccuccugaagggcauccgguuuagaguggaccuuggggaaauugagcuggauucuuacagcaaaaaggucggacgcaauggcgaauaugaccggaccaucacagaucacgcgcucgccuucgggaaacuguccgacuuucagaacgaggaggaagugucuagaaugaucagcggagaggcuuccuaccccgugcgcuucagccuguuugccccucgguaugcuauuuacgauaauaagaucggcuauugucacaccucugaccccgucuacccgaaauccaagacgggcgaaaagagagcccuuagcaacccucagucuaugggguucauuuccguucaugaucuccggaaacugcugcucauggagcugcuuugcgagggcagcuuuucccgcaugcagucuggauuccugagaaaggccaaucggauccucgacgaaacagcugaggggaaacugcaauuuagcgcgcuguuccccgaaaugagacaccgcuucauuccuccccagaaccccaaguccaaagaucggagagagaaggccgaaaccacacuugagaaguauaaacaggagaucaagggacgcaaagacaagcucaauucucaacugcugagcgcuuuugauaugaaccagagacagcucccuucccggcugcuugacgaauggaugaauauccgcccggccagccauucugugaaacugagaaccuacgugaagcagcucaacgaggauugucggcugcgccugagaaaguuccggaaagacggcgacgggaaggcccgcgcuauuccccuugucggagaaauggccaccuuucucucccaagauaucgugagaaugauuaucagcgaggaaacgaaaaagcugauuacaucugcguacuauaaugagaugcagcggucccuggcucaguacgccggcgaggaaaaccgcagacaguuccgggccaucguugcugagcuccaucugcuugacccuagcucuggccaccccuuucugagcgccaccauggaaacagcucacagauauaccgaggauuucuacaaaugcuaucucgaaaagaagcgcgaguggcuggccaaaacauuuuaccggccugagcaagacgaaaauaccaagagacgcaucuccguguucuuuguccccgauggggaggcgcggaaacugcuuccgcuccugauuagacgccggaugaaggaacagaacgaccugcaggauuggaucagaaauaaacaggcccacccuauugaccuccccagccaucuguucgauucuaagaucauggagcuucugaaagugaaggacggaaagaaaaaguggaacgaggcuuuuaaagauuggugguccacgaaguauccugacggcaugcaacccuucuacgggcuccgccgggaacugaacauucacggaaaaagcguuuccuacaucccuucugauggcaagaaguuugccgacuguuauacacaucugauggagaaaaccgugcaggacaagaaaagagaacuucggaccgcugggaagcccgucccgccugaucuggccgcggacauuaaacgcagcuuccacagagccgugaaugagcgggaguucaugcuccgccugguccaggaggaugacagacucaugcugauggcuaucaacaagaugaugacagaucgggaggaagacauccuucccggccugaagaauauugauuccauccucgacaaagagaaccaguuuucucuggccgugcacgcuaagguucuggaaaaagagggagaaggcggggauaauagccuuucccuggugcccgccaccauugagaucaagucuaaaagaaaggacuggagcaaguacauucgcuaucgguacgauagacgcgucccuggacucaugucccauuucccggagcacaaagccacacuggacgaagugaagacgcuccugggcgaguaugaccggugcagaaucaaaaucuuugauugggcuuucgcgcuugaaggggccauuaugagcgaccgcgaucugaagcccuaccuccaugagucuuccagccgggaaggaaaaucuggcgagcacuccacccugguuaagaugcugguggagaaaaaggggugccuuacaccugacgaaagccaauaucugauccucauuagaaacaaggcugcccauaaucaguuucccugugccgcugagaugccucugaucuaccgcgaugucucugccaaagugggcuccauugaaggaagcuccgcgaaggaccuccccgagggcagcucucugguggauagccuuuggaaaaaguacgagaugaucaucagaaaaauucugccuauccuggaccacgaaaaccgguucuuugggaagcuccugaauaacaugucccagcccauuaaugaucuuuga

SEQ ID NO: 11429 - RNA, 3408 nt, Artificial Sequence
  Cas13b variant__Porohyromonas gingivalis__WP_061156637.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucagucuaugggguucauuuccguucaugaccuccggaaacugcugcucauggagcugcuuugcgagggcagcuuuucccgcaugcagucuggauuccugagaaaggccaaccggauccucgaugaaacagcugaggggaaacugcaauuuagcgcgcuguuccccgaaaugagacaccgcuucauuccuccccagaaucccaaguccaaagaccggagagagaaggccgaaaccacacuugagaaguauaaacaggagaucaagggacgcaaagauaagcucaacucucaacugcugagcgcuuuugacaugaaucagagacagcucccuucccggcugcuugaugaauggaugaacauccgcccggccagccauucugugaaacugagaaccuacgugaagcagcucaaugaggacugucggcugcgccugagaaaguuccggaaagacggcgaugggaaggcccgcgcuauuccccuugucggagaaauggccaccuuucucucccaagacaucgugagaaugauuaucagcgaggaaacgaaaaagcugauuacaucugcguacuauaacgagaugcagcggucccuggcucaguacgccggcgaggaaaaucgcagacaguuccgggccaucguugcugagcuccaucugcuugauccuagcucuggccaccccuuucugagcgccaccauggaaacagcucacagauauaccgaggacuucuacaaaugcuaucucgaaaagaagcgcgaguggcuggccaaaacauuuuaccggccugagcaagaugaaaacaccaagagacgcaucuccguguucuuuguccccgacggggaggcgcggaaacugcuuccgcuccugauuagacgccggaugaaggaacagaaugaucugcaggacuggaucagaaacaaacaggcccacccuauugaucuccccagccaucuguucgacucuaagaucauggagcuucugaaagugaaggauggaaagaaaaaguggaaugaggcuuuuaaagacuggugguccacgaaguauccugauggcaugcaacccuucuacgggcuccgccgggaacugaacauucacggaaaaagcguuuccuacaucccuucugacggcaagaaguuugccgacuguuauacacaucugauggagaaaaccgugcaggauaagaaaagagaacuucggaccgcugggaagcccgucccgccugaccuggccgcggauauuaaacgcagcuuccacagagccgugaacgagcgggaguucaugcuccgccugguccaggaggacgauagacucaugcugauggcuaucaauaagaugaugacagaccgggaggaagauauccuucccggccugaagaacauugacuccauccucgauaaagagaaucaguuuucucuggccgugcacgcuaagguucuggaaaaagagggagaaggcggggacaacagccuuucccuggugcccgccaccauugagaucaagucuaaaagaaaggauuggagcaaguacauucgcuaucgguacgacagacgcgucccuggacucaugucccauuucccggagcacaaagccacacuggacgaagugaagacgcuccugggcgaguaugaucggugcagaaucaaaaucuuugacugggcuuucgcgcuugaaggggccauuaugagcgaucgcgaccugaagcccuaccuccaugagucuuccagccgggaaggaaaaucuggcgagcacuccacccugguuaagaugcugguggagaaaaaggggugccuuacaccugaugaaagccaauaucugauccucauuagaaauaaggcugcccauaaccaguuucccugugccgcugagaugccucugaucuaccgcgacgucucugccaaagugggcuccauugaaggaagcuccgcgaaggaucuccccgagggcagcucucugguggacagccuuuggaaaaaguacgagaugaucaucagaaaaauucugccuauccuggaucccgaaaaucgguucuuugggaagcuccugaacaauaugucccagccgauuaacgaccuuuga

SEQ ID NO: 11430 - RNA, 3408 nt, Artificial Sequence
  Cas13b variant__Porohyromonas gingivalis__WP_023846767.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucggucuaugggguucauuuccguucaugaccuccgcaaacugcugcucauggagcugcuuugcgagggcagcuuuuccagaaugcagucugauuuccugcggaaggccaacagaauccucgacgaaacagcugagggaaaacugcaguuuagcgcgcuguuccccgaaaugcgccaccgguucauuccuccccaaaaucccaaguccaaagauagacgcgagaaggccgaaaccacacuugagaaguauaaacaggagaucaaggggagaaaagacaagcucaacucucagcugcugagcgcuuuugauaugaaucaacggcagcucccuucccgccugcuugacgaauggaugaacaucagaccggccagccauucugugaaacugcggaccuacgugaagcagcucaaugaggacugucgccugagacugcggaaguuccgcaaagauggagacggcaaggccagagcuauuccccuugucggggaaauggccaccuuucucucccaggauaucgugcggaugauuaucagcgaggaaacgaaaaagcugauuacaucugcguacuauaacgagaugcaacgcucccuggcucaguacgccggagaggaaaauagacggcaguucagagccaucguugcugagcuccaucugcuugacccuagcucuggccaccccuuucugagcgccaccauggaaacagcucaccgcuauaccgaggauuucuacaaaugcuaucucgaaaagaagcgggaguggcuggccaaaacauuuuacagaccugagcaggacgaaaacaccaagcgccggaucuccguguucuuuguccccgauggcgaggcgagaaaacugcuuccgcuccugauucgccggagaaugaaggaacaaaaugaccugcaggauuggauccgcaacaaacaggcccacccuauugaccuccccagccaucuguucgauucuaagaucauggagcuucugaaagugaaggacgggaagaaaaaguggaaugaggcuuuuaaagauuggugguccacgaaguauccugacggaaugcagcccuucuacggccuccggagagaacugaacauucacgggaaaagcguuuccuacaucccuucugacggaaagaaguuugccgauuguuauacacaucugauggagaaaaccgugcaagacaagaaacgggaacuucgcaccgcuggcaagcccgucccgccugaucuggccgcggacauuaaacggagcuuccacagagccgugaacgagcgcgaguucaugcucagacugguccaggaggaugaccggcucaugcugauggcuaucaauaagaugaugacagauagagaggaagacauccuucccgggcugaagaacauugauuccauccucgacgaggaaaaucaguuuucucuggccgugcacgcuaaaguucuggagaaggaaggcgagggaggcgauaacagccuuucccuggugcccgccaccauugagaucaaaucuaagcgcaaagacuggagcaaguacauucgguauagauacgaccgccgggucccugggcucaugucccauuucccggaacacaaggccacacuggaugaggugaaaacgcuccugggagaauaugacagaugccgcaucaagaucuuugauugggcuuucgcgcuugagggcgccauuaugagcgaccgggaucugaaacccuaccuccaugaaucuuccagcagagaggggaagucuggagagcacuccacccugguuaaaaugcugguggaaaagaaaggcugccuuacaccugacgagagccaguaucugauccucauucgcaauaaggcugcccauaaccaauuucccugugccgcugaaaugccucugaucuacagagaugucucugccaaggugggguccauugagggcagcuccgcgaaagaccuccccgagggaagcucucugguggauagccuuuggaagaaauacgaaaugaucauccggaagauucugccuauccuggaccccgagaaucgcuucuuuggcaaacuccugaacaauaugucccagccgauuaacgaucuuuga

SEQ ID NO: 11431 - RNA, 3408 nt, Artificial Sequence
  Cas13b variant__Porohyromonas gingivalis__ERJ87335.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucggucuaugggguucauuuccguucaugaccuccgcaaacugcugcucauggagcugcuuugcgagggcagcuuuuccagaaugcagucugauuuccugcggaaggccaacagaauccucgacgaaacagcugagggaaaacugcaguuuagcgcgcuguuccccgaaaugcgccaccgguucauuccuccccaaaaucccaaguccaaagauagacgcgagaaggccgaaaccacacuugagaaguauaaacaggagaucaaggggagaaaagacaagcucaacucucagcugcugagcgcuuuugauauggaccaacggcagcucccuucccgccugcuugacgaauggaugaauaucagaccggccagccauucugugaaacugcggaccuacgugaagcagcucaacgaggauugucgccugagacugcagaaguuccggaaagacggagauggcaaggcccgcgcuauuccccuugucggggaaauggccaccuuucucucccaagacaucgugagaaugauuaucagcgaggaaacgaaaaagcugauuacaucugcguacuauaaugagaugcagcggucccuggcucaguacgccggagaggaaaaccgccaccaguucagagccaucguugcugagcuccggcugcuugauccuagcucuggccaucccuuucugagcgccaccauggaaacagcucacagauauaccgaggacuucuacaaaugcuaucucgaaaagaagcgcgaguggcuggccaaaacauuuuaccggccugagcaagaugaaaauaccaagagacgcaucuccguguucuuuguccccgacggcgaggcgcggaaacugcuuccgcuccugauuagacgccggaugaaggaacagaacgaucugcaggacuggaucagaaauaaacaggcccacccuauugaucuccccagccaucuguucgacucuaaggugauggagcuucugaaaguuaaggaugggaagaaaaaguggaacgaggcuuuuaaagacuggugguccacgaaguauccugacggaaugcaacccuucuacggccuccgccgggaacugaauauccacgggaaaagcguguccuacauuccuucugauggaaagaaguuugccgacuguuauacacaucugauggagaaaaccgucagagauaagaaacgggaacuucgcaccgcuggcaagcccgugccgccugaccuggccgcguacaucaaacggagcuuccacagagccgucaacgagcgcgaguucaugcucagacuggugcaggaggaugaccggcucaugcugauggcuauuaacaagaucaugacagauagagaggaagacauccuucccgggcugaagaauauugauuccauccucgacaaagagaaccaguuuucucuggccguucacgcuaaggugcuggaaaaagagggcgaaggaggcgauaauagccuuucccugguccccgccaccauugagaucaagucuaaacgcaaggacuggagcaaguauauucgguacagauaugaccgccgggugccugggcucaugucccauuucccggagcacaaagccacacuggaugaaguuaagacgcuccugggagaguacgacagaugccgcaucaaaaucuuugauugggcuuucgcgcuugaaggcgccauuaugagcgaccgggaucugaagcccuaucuccaugagucuuccagcagagaagggaaaucuggagagcacuccacccuggugaagaugcuggucgagaaaaagggcugccuuacaccugacgaaagccaguaccugauccucauucgcaacaaggcugcccauaaucaauuucccugugccgcugagaucccucugauuuacagagaugugucugccaaagugggguccaucgaaggcagcuccgcgaaggaccuccccgagggaagcucucugguugauagccuuuggaaaaaguaugagaugaucauucggaaaauccugccuauucuggaccccgaaaaccgcuucuuuggcaagcuccugaauaacaugucccagccgaucaaugaucuuuga

SEQ ID NO: 11432 - RNA, 3408 nt, Artificial Sequence
  Cas13b variant__Porohyromonas gingivalis__WP_005873511.1__Cas13b
augaacaccgugcccgccagcgagaauaagggccaguccagaacagucgaagacgauccucaauacuucgggcuguaucucaaccuggcucgggagaaucuuaucgaaguugagucucacgugcgcauuaaauuuggaaagaaaaagcugaacgaagagagccucaaacagucccugcuuugcgaccaucugcucucuguggauagauggacgaaggucuacggccacagccggcgcuaucugccguuccugcauuacuuugaccccgauucccagaucgagaaggaccacgauucuaaaaccgggguggacccugauagcgcccagagacucauucgggaacuguauucccuucuggacuuccuccgcaaugauuuuagccauaacagacuggacggaacaaccuucgagcaccuugaaguuucucccgauaucuccagcuuuauuacaggcaccuacucucuggcgugugggcgggcucaaucccgcuucgccgacuuuuucaagccugacgauuuugugcucgccaaaaauagaaaggagcagcugaucagcgucgcugacggaaaagagugccugacagugucuggccucgccuucuuuaucugucuguuccuugaucgggaacaggcuuccggcaugcugagccgcauuagaggguucaagcggaccgacgagaacugggcccgcgcgguucacgaaacguuuugcgaucucuguaucagacauccccacgaccggcuggaguccucuaauaccaaggaagcccuucugcucgauaugcugaacgagcugaauagaugcccucgcauucucuaugacaugcugccggaggaagaacgggcucaguuccuucccgcccuggaugaaaacagcaugaauaaccucuccgagaauagccugaacgaagagucuagacuucugugggacggauccagcgauugggcugaggcccucacaaaacgcauccggcaucaagacagauuuccuuaccugaugcugcgcuucauugaagagauggaccuccugaagggcauccgguuuagaguggaucuuggggaaauugagcuggacucuuacagcaaaaaggucggacgcaacggcgaauaugaucggaccaucacagaccacgcgcucgccuucgggaaacuguccgauuuucagaaugaggaggaagugucuagaaugaucagcggagaggcuuccuaccccgugcgcuucagccuguuugccccucgguaugcuauuuacgacaacaagaucggcuauugucacaccucugaucccgucuacccgaaauccaagacgggcgaaaagagagcccuuagcaauccucagucuaugggguucauuuccguucauaaccuccggaaacugcugcucauggagcugcuuugcgagggcagcuuuucccgcaugcagucugacuuccugagaaaggccaaucggauccucgaugaaacagcugagggaaaacugcaauuuagcgcgcuguuccccgaaaugagacaccgcuucauuccuccccagaaccccaaguccaaagaccggagagagaaggccgaaaccacacuugagaaguauaaacaggagaucaaggggcgcaaagauaagcucaauucucaacugcugagcgcuuuugacaugaaccagagacagcucccuucccggcugcuugaugaauggaugaauauccgcccggccagccauucugugaaacugagaaccuacgugaagcagcucaacgaggacugucggcugcgccugagaaaguuccggaaagacggagauggcaaggcccgcgcuauuccccuugucggggaaauggccaccuuucucucccaagacaucgugagaaugauuaucagcgaggaaacgaaaaagcugauuacaucugcguacuauaaugagaugcagcggucccuggcucaguacgccggagaggaaaaccgcagacaguuccgggccaucguugcugagcuccaucugcuugauccuagcucuggccaccccuuucugagcgccaccauggaaacagcucacagauauaccgaggacuucuacaaaugcuaucucgaaaagaagcgcgaguggcuggccaaaacauuuuaccggccugagcaagaugaaaauaccaagagacgcaucuccguguucuuuguccccgacggcgaggcgcggaaacugcuuccgcuccugauuagacgccggaugaaggaacagaacgaucugcaggacuggaucagaaauaaacaggcccacccuauugaucuccccagccaucuguucgacucuaagaucauggagcuucugaaagugaaggaugggaagaaaaaguggaacgaggcuuuuaaagacuggugguccacgaaguauccugauggaaugcaacccuucuacggccuccgccgggaacugaacauucacgggaaaagcguuuccuacaucccuucugacggaaagaaguuugccgacuguuauacacaucugauggagaaaaccgugcaggauaagaaaagagaacuucggaccgcuggcaagcccgucccgccugaccuggccgcggauauuaaacgcagcuuccacagagccgugaaugagcgggaguucaugcuccgccugguccaggaggacgauagacucaugcugauggcuaucaacaagaugaugacagaccgggaggaagauauccuucccgggcugaagaauauugacuccauccucgaugaggaaaaccaguuuucucuggccgugcacgcuaaaguucuggagaaggaaggcgagggaggcgacaauagccuuucccuggugcccgccaccauugagaucaaaucuaagagaaaagauuggagcaaguacauucgcuaucgguacgacagacgcgucccugggcucaugucccauuucccggaacacaaggccacacuggacgaggugaaaacgcuccugggagaauaugaucggugcagaaucaagaucuuugacugggcuuucgcgcuugagggcgccauuaugagcgaucgcgaccugaaacccuaccuccaugaaucuuccagccgggaggggaagucuggagagcacuccacccugguuaaaaugcugguggaaaagaaaggcugccuuacaccugaugagagccaauaucugauccucauuagaaacaaggcugcccauaaucaguuucccugugccgcugaaaugccucugaucuaccgcgacgucucugccaaggugggguccauugagggcagcuccgcgaaagaucuccccgagggaagcucucugguggacagccuuuggaagaaauacgaaaugaucaucagaaagauucugccuauccuggaucccgagaaccgguucuuuggcaaacuccugaauaacaugucccagccgauuaaugaccuuuga

SEQ ID NO: 11433 - RNA, 3408 nt, Artificial Sequence
  Cas13b variant__Porohyromonas gulae__WP_039445055.1__Cas13b
augaacaccgugcccgccacagagaauaagggccagagcagaacggucgaagacgauccucaauacuucgggcuguaucucaaccuggcucgggagaaucuuaucgaaguugagucccacgugcgcauuaaauuuggaaagaaaaagcugaacgaagagucucucaaacagagccugcuuugcgaccaucugcucuccaucgauagauggaccaagguguacggccacucucggcgcuaucugccguuccugcauuguuuugaccccgauagcgggauugagaaggaccacgauuccaaaacaggagucgacccugauucugcccagagacucauccgggaacuguacagccuucuggacuuccuccgcaaugauuuuucccauaacagacuggacggcaccacauucgagcaccuuaaggugagccccgauauuucuuccuuuaucaccggggcguauacauucgcuugcgaacgggcccagagccgcuuugccgacuucuuuaaaccugacgauuuccugcucgcuaagaauagaaaagagcaacugaucucuguugccgacggaaaggagugucugaccguguccggcuuugcuuucuucauuugccucuuucuggaucgggaacaggccagcggcaugcuuucucgcaucagaggguucaagcggacggacgagaacugggcgcgcgccguccacgaaaccuuuugugaucugugcauuagacauccccacgaccggcucgaguccagcaauacaaaagaagcucugcuucuggauaugcucaacgagcugaauagauguccucgcauccuguacgacaugcucccggaggaagaacgggcccaguuccugcccgcucuugaugaaaacuccaugaauaaccugucugagaauagccucaacgaagaguccagacugcuuugggacggaagcucugauugggccgaggcgcugaccaagcgcauucggcaucaggacagauuuccuuaucucaugcugcgcuucaucgaagagauggaccugcucaaaggcauucgguuuagaguggaucugggggaaaucgagcuugacuccuacagcaagaaaguuggacgcaacggcgaauacgaucggacaaucaccgaccacgcccuggcuuucgggaagcucucugauuuucaaaaugaggaggaagugagcagaaugauuuccggagaggccucuuaucccguccgcuucagccuguuugcuccucgguacgccaucuaugacaacaaaauuggcuacugccacacguccgaucccguguauccuaagagcaagacaggcgaaaagagagcccugucuaauccgcaguccaugggguucaucagcgugcaugaccuucggaagcuccugcugauggagcuccugugugagggaucuuuuucccgcaugcagagcgauuuccuuagaaaagcuaaccggauucuggacgaaaccgcggagggcaagcuccaguucuccgcccuguuucccgaaaugagacaccgcuucaucccuccccaaaaucccaaaucuaaggaucggagagagaaggcugaaacaacccuggagaaauacaagcaggagaucaaagggcgcaaggacaaacuuaacagccagcuccuguccgccuuugauaugaaucaaagacagcugccuucucggcuccuggacgaauggaugaacauucgcccggccagccauuccgucaaacuuagaaccuauguuaagcagcugaaugaggacugccggcuccgccugagaaaauuccggaaggauggagacggcaaagcucgcgccaucccccuggugggggaaauggcgacauuucuuagccaggauauugugagaaugaucauuucugaggaaacgaagaaacucaucaccuccgcuuacuacaacgagaugcaacggagccuggcccaguaugccggagaggaaaaucgcagacaguuccgggcuaucgucgccgagcugcaccuccuggacccuucuuccggccaucccuuucuuagcgcuacaauggaaaccgcccacagauacacagaggauuucuauaaguguuaccuggaaaagaaacgcgaguggcucgcgaagaccuuuuaucggccugagcaggacgaaaacacgaaaagacgcauuucuguguucuuuguucccgauggcgaggcccggaagcugcugccgcuucucaucagacgccggaugaaagaacaaaaugaccugcaggauuggauuagaaacaagcaggcucacccuaucgaccugcccagccaucucuucgauuccaaaauuauggagcugcuuaaggugaaggacgggaaaaagaaauggaaugaggccuuuaaggauugguggagcacaaaauacccugacggaaugcagcccuucuauggccugcgccgggaacucaacauccacgggaagucugucuccuacauuccuagcgacggaaagaaauucgcugauugcuacacccaucugauggagaagaccgugagagacaaaaagcgggaacugcgcacagccggcaaacccguuccgccugaucuugcggccuauaucaagagauccuuucaccgggcugugaacgagcgcgaguucaugcugagacucguccaagaggacgaucggcugaugcucauggccaucaauaagaugaugaccgacagagaggaagauauucugcccgggcuuaaaaacaucgacucuauucuggaugaggaaaaucaguuuagccucgcugugcacgccaagguccuggagaaagaaggcgagggaggcgacaacucccugucucuugugcccgccacaaucgagauuaagagcaaacgcaaggauugguccaaguacauccgguauagauacgaccgccggguuccugggcugaugucucauuucccggaacacaaagcuacgcucgacgaggugaagacccugcucggagaauaugauagaugccgcaucaaaauuuuugacugggcguucgcccuggagggcgcuaucaugagcgaucgggaccuuaagcccuaccugcaugaauccagcucuagagaggggaaauccggagagcacagcacacucgucaagaugcugguggagaaaaagggcugucugaccccugaugaaucucaguaucuuauucugauccgcaauaaggccgcccauaaccaguuucccugcgcugccgaaaugccucucauuuacagagacguuuccgcgaaaguggggagcaucgagggaucuuccgcuaaggaucugcccgagggcagcucccucgucgacagccuguggaaaaaguacgaaaugaucauucggaaaauccuuccuauucuggaucacgagaaucgcuucuuuggcaagcugcucaacaauaugucucaacccaucaacgaccuguga

SEQ ID NO: 11434 - RNA, 3528 nt, Artificial Sequence
  Cas13b variant__Porphyromonas gingivalis__WP_052912312.1__Cas13b
augaccgagcagaacgaaaagcccuacaauggcacauauuacacgcuggaggacaaacacuucugggccgccuuuuucaaccucgccagacauaaugcguauaucacccuggcucacauugaucggcaacuugccuacagcaaggccgacaucacaaacgaugaagacauucuguuuuucaaagggcaguggaagaaucucgauaacgaccuggagcgcaaagcuagacuucggucccugauccucaagcauuuuucuuuccuggaaggagccgcuuauggcaagaaacuguuugagagccaguccucugggaauaagagcuccaaaaagaaagagcucaccaagaaggaaaaagaggaacugcaggccaacgcgcuuucucuggauaaucucaagagcauucuguucgacuuucuucaaaaacugaaggauuuccgcaacuacuauucccacuacagacauccugagagcucugagcucccgcuguuugacggaaauaugcugcagcggcucuacaacguguucgaugucuccguucagcgcgugaaaagagaccacgaacacaaugauaagguggacccccaucggcacuuuaaccaucugguccgcaaaggcaagaaggacaaauaugggaauaacgauaacccuuucuucaagcaccacuuuguggacagagaggaaaaaguuacagaggccggacuucuguucuuugugagccucuuccuggaaaagcgggaugcuaucuggaugcagaaaaagauccgcggcuuuaagggcgggaccgaggccuaccaacagaugacaaaugaggucuucugcagaucucggauuucccuucccaaacugaagcucgaaagccugcgcaccgacgauuggaugcugcucgacaugcugaacgagcuugugagauguccuaaacugcucuaugaucggcugagagaagaggaccgcgcucgguuuagaguucccguggauauccuuucugacgaagaugacacggacggaaccgaggaggauccuuucaagaauacacugguccgccaucaggaccgguuuccguacuucgcccucagauauuuugaucugaaaaagguguucaccucccugcgcuuucacauugaccucggcacauaccauuucgcgaucuauaagaaaaacauuggggaacagcccgaggaucggcaccugaccagaaaucuuuacggauucggccgcauccaagacuuugccgaggaacaucggccugaagaguggaagagacuggugcgcgaucucgacuacuucgagacgggggauaaacccuauauuacacagaccacaccucacuaccacaucgaaaagggaaaaaucggccugcgguuuguccccgagggccagcugcuuuggccgagcccugaaguuggggcuaccagaaccggacgguccaaguaugcccaagacaagcgcuucacagcugaggccuuucucucugugcaugagcugaugcccaugauguucuacuauuuucugcucagagaaaaauacagcgaggaagccuccgcugagaaggugcagggccggauuaaaagagucaucgaagauguguaugcgguuuacgacgccuucgcucgcgaugagauuaacacgcgggacgagcuggacgccugccuugccgauaaggggaucagacgcggacaucugccuagacagaugauugcuauccucagccaggaacacaaagacauggaggaaaaggugcggaaaaagcugcaagagaugaucgccgauaccgaccaccgccuggauaugcuugacagacagacagaucggaagauucgcaucggcagaaagaaugcggggcuccccaagucuggagucauugcugacuggcuggugcgggauaugaugcgcuuucagcccguugccaaagacaccuccggcaagccucugaacaauagcaaagccaacucuacagaauacagaaugcuccagcgggcucuggcccuuuucggcggggagaaggagcgccugaccccguauuuuagacaaaugaaucucacgggaggcaacaauccccacccuuuccugcaugaaacacggugggagagccacaccaacauccuguccuuuuacagaucuuaucuuaaggcucgcaaagccuuccuccagagcauugggcgguccgauagagaagagaaucaucgcuuccugcugcucaaggaacccaaaaccgaccggcagacacugguggcgggauggaaaagcgaguuucaccuuccuagaggcaucuucaccgaggccguccgcgauugucugaucgaaaugggguacgacgaggugggcucuuauaaagaagucggauuuauggcuaaggccgugccccucuacuucgagcgggcuugcaaggacagaguucagccguuuuaugauuacccuuucaacgugggcaacucccugaaacccaagaaagggcgcuuucugagcaaggagaaacgggccgaagagugggaaucuggaaaggagagauuccgggaccuugaagcguggucccauagcgccgcucgcagaauugaggaugccuuugucggcaucgaguacgcuuccugggaaaauaagaaaaagauugagcaacuccugcaggaccugucucucugggaaacauucgagagcaaacugaaggugaaagccgauaagaucaacauugccaaacuuaagaaggaaauccuggaggcuaaagagcacccuuaucacgacuuuaaguccuggcagaaauucgaacgggagcuccgccugguuaagaaucaggauauuaucacguggaugauguguagagaccugauggaagagaacaaaguggaagggcuugauaccggaacacuguaccucaaggacauccggaccgauguccaagagcagggcucucugaaugugcucaaccaugugaagcccaugagacugccuguugucguguaucgcgcggacagccgggggcacgugcauaaagaggaagcuccccuugcuacagucuacauugaggaaagagacaccaagcugcucaaacagggcaauuucaaguccuuugugaaagaucgccggcugaacggacuguucagcuuuguugacacgggcgcccuugccauggagcaauauccgaucucuaagcugagaguggaguacgaacucgcuaaguaucagaccgcccgcgucugcgcguucgagcagacacuggaacucgaggaaucccugcuuacccgguacccucaucugcccgaugagagcuuuagagagaugcucgaaucuugguccgacccccugcuggauaaauggccugaccuucagcgcgaggugagacugcucauugcuguucggaaugccuucagccacaaccaauacccgauguaugaugaaacaaucuuuucuagcauucgcaaguacgaccccuccagccuggaugccaucgaggaaagaauggggcucaauaucgcucaccggcugucugaggaggugaaacuugccaaggaaauggucgagcgcauuauccaggcguga

SEQ ID NO: 11435 - RNA, 3360 nt, Artificial Sequence
  Cas13b variant__Porphyromonas gingivalis__WP_053444417.1__Cas13b
augaccgagcagaacgaaaagcccuacaauggcacauauuacacgcuggaggacaaacacuucugggccgcuuuucucaaccuggccagacauaaugcguauaucacccuugcucacauugaucggcaacuggccuacagcaaggccgacaucacaaacgaugaagacauucucuucuuuaaagggcaguggaagaaucuggauaacgaccuugagcgcaaagcuagacugcggucccucauccugaagcauuucucuuuucuggaaggagccgcuuauggcaagaaacucuucgagagccaguccucugggaauaagagcuccaaaaagaaagagcugucuaagaaggaaaaagaggaacuucaggccaacgcgcugagccucgauaaucugaaguccauucuuuuugacuuccugcaaaaacucaaggauuuucgcaacuacuauagccacuacagacauccugagucuuccgagcugccgcuguucgacggaaauaugcuccagcggcuguacaacguguuugaugucagcguucagcgcgugaaaagagaccacgaacacaaugauaagguggacccccaucggcacuucaaccaucuuguccgcaaaggcaagaaggacaaauaugggaauaacgauaacccuuucuucaagcaccacuucguggacagagagggaaccguuacagaagccggccugcucuuuuucgugucucuguuucuugagaaacgggaugcuaucuggaugcagaagaaaauccgcggcuucaaagggggaaccgaagccuaccaacagaugacaaaugaggucuuuugcagaucccggauuagccugcccaagcucaagcuggagucucugcgcaccgacgauuggaugcuccuggacaugcuuaacgaacuggugagauguccuaagucccucuaugaucggcugagagaggaagaccgcgcucgguucagaguucccguggauauccuuagcgacgaggaugacacggacggcaccgaagaggauccuuuuaaaaauacacugguccgccaucaggaccgguucccguacuuugcccucagauauuucgaucugaagaaaguguuuaccucccugcgcuuccacauugaccucgggacauaccauuuugcgaucuauaagaagaacauuggagagcagcccgaagaucggcaccugaccagaaaucuuuacggcuucgggcgcauccaagacuucgccgaggaacaucggccugaggaauggaaaagacuggugcgcgaucucgacuacuuugagacgggagauaagcccuauauuacacagaccacaccucacuaccacaucgagaaaggcaagaucggccugcgguucguccccgaagggcagcaucuguggccgucuccugagguuggagcuaccagaaccggccggagcaaauaugcccaagacaagcgccuuacagcugaagccuuucucuccgugcacgagcugaugcccaugauguucuacuauuuucugcucagagagaaguacagcgaagaggugucugccgaaaaaguccaggggcggauuaagagagugaucgaggauguuuaugcuguguacgacgcguucgcccgcgaugaaauuaacacgcgggacgagcuggacgcuugccuugccgauaaaggaaucagacgcggccaucugccuagacagaugauugccauccucucccaggagcacaaggacauggaagagaaaguccggaagaaacugcaagaaaugaucgcugauaccgaccaccgccuggauaugcuugacagacagacagaucggaagauucgcaucgggagaaagaaugccggacuccccaaaagcggcgugguugcggacuggcuggugcgggauaugaugcgcuuucagcccgucgcuaaggacaccucuggcaaaccucugaacaauagcaaggccaacuccacagaguacagaaugcuccagcgggcccuggcucuuuucgggggagaaaaagagcgccugaccccguauuuuagacaaaugaaucucacgggcgggaacaauccccauccuuuccugcacgagacacggugggaaucucauaccaacauucugagcuuuuacagauccuaucuugaggcccgcaaggcuuuccuccagagcaucggacggucugauagaguggaaaaucaccgcuuucugcugcucaaggagcccaaaaccgaccggcagacacuggucgccggcuggaagggggaauuucaucuuccuagaggcauuuucaccgaggcggugcgcgauugucugaucgagaugggauacgacgaaguuggcuccuauaaagaggugggguuuauggccaaggcugucccccucuacuucgaacgggccagcaaagacagagugcagccguuuuaugauuacccuuucaacguuggaaacucucugaagcccaagaaaggccgcuuucuguccaaggagaaacgggcugaggaaugggagagcgggaaggaaagauuccggcuugccaaacucaagaaggagauccuggaagcgaaagagcacccuuaccacgacuuuaaguccuggcaaaaauucgagcgcgaacugagacucgugaagaaucaggauauuaucacauggaugaugugccgggaccugauggaggaaaacaaagucgagggacuugauacgggcacccuguaucucaaggacauucgcacagaugugcaggaacaggggucucugaaugugcugaacagaguuaaacccaugcggcuuccugucgugguguacagagccgacagccgcggccauguccacaaggagcaagcuccccuggccaccguguauaucgaggaacgggauacaaagcuccugaaacagggaaauuuuaaguccuucguuaaagacagacgccucaacggccuguuuucuuucguggauaccggggcucuugccauggagcaguacccgauuagcaagcugcgggucgaauaugagcucgccaaauaccaaacggcuagagugugugcguucgaacagacccuggagcuggaggaaucccuucugacacgcuauccucaucuccccgacaagaauuuucggaagaugcuggagagcuggucugacccccuccuggauaaauggccugaccuucacggaaacguuagacugcucaucgccgugcgcaaugcuuucucccauaaccaguacccgauguacgaugaaacccuguuuagcucuauuagaaaguaugaccccuccagcccugaugccaucgaggagcggaugggccugaauaucgcccaccgccuuucugaagaggucaaacaggcuaaggaaaugguggagagaauuauccaagccuga

SEQ ID NO: 11436 - RNA, 3360 nt, Artificial Sequence
  Cas13b variant__Porphyromonas gingivalis__WP_012458414.1__Cas13b
augaccgagcagaacgaaagacccuacaauggcacauauuacacgcuggaggacaagcacuucugggccgccuuuuucaaccucgcucggcauaaugcguauaucacccuggcucacauugaucgccaacuugccuacagcaaagccgacaucacaaacgaugaagacauucuguuuuucaaggggcaguggaaaaaucucgauaacgaccuggagagaaaggcucggcuucgcucccugauccucaaacauuuuucuuuccuggaaggagccgcuuauggcaagaagcuguuugagagccaguccucugggaauaaaagcuccaagaaaaaggagcucaccaaaaaggaaaaggaggaacugcaggccaacgcgcuuucucuggauaaucucaaaagcauucuguucgacuuucuucaaaagcugaaagauuucagaaacuacuauucccacuaccggcauccugagagcucugagcucccgcuguuugacggaaauaugcugcagcgccucuacaacguguucgaugucuccguucagagagugaagcgggaccacgaacacaaugauaaaguggacccccaucgccacuuuaaccaucuggucagaaagggcaaaaaggaccgguaugggaauaacgauaacccuuucuucaagcaccacuuuguggaccgcgaggaaaaaguuacagaggccggacuucuguucuuugugagccucuuccuggaaaagagagaugcuaucuggaugcagaaaaagauccggggcuuuaaaggcgggaccgagacauaccaacagaugaccaaugaggucuucugccgcucuagaauuucccuucccaagcugaagcucgaaagccugcggacggacgauuggaugcugcucgacaugcugaacgagcuugugagauguccuaaaucucuguaugaucgccuccgggaagaggacagagcccgcuuucggguucccguggauauccuguccgacgaagaugacaccgacggaacagaggaggauccuuucaagaauacccuugucagacaucaggaccgcuuuccguacuucgcucugcgguauuuugaucucaaaaagguguucacaagccugagauuucacauugaccugggcaccuaccauuucgccaucuauaaaaagaacauuggggaacagcccgaggaucgccaccucacgcggaaucuguacggauucggcagaauccaagacuuugcggaagaacaucgcccugaagaguggaagcggcuugugagagaucuggacuacuucgagacaggggauaaacccuauauuacccagacaaccccucacuaccacaucgaaaagggaaaaaucggccuccgguuuguccccgagggccagcaucuguggccguccccugaaguuggggccacccgcacaggaagaucuaaguaugcucaagacaaacggcugacggccgaggcuuuccuuagcgugcacgagcucaugcccaugauguuuuacuauuuccugcugagagaaaaguacuccgaugaggccagcgccgaacgcgugcagggccggauuaagagagucaucgaggacguguaugcuguuuacgaugcguuugcccgcggggaaauuaacaccagagacgagcucgacgcuugccuggccgauaaaggaauccggcgcggccaucuuccuagacagaugauugggauccugucucaggagcacaaggacauggaagagaaagugcggaagaaacuccaagaaaugaucgucgauacagaccaccgccuggauaugcuggacagacagaccgaucggaagauucgcaucggacggaaaaaugccggccuucccaaguccggcgugauugcugacuggcucguuagagauaugaugcgcuuccagcccguggccaaggacacaagcgggaaaccucugaacaauucuaaggcgaacagcaccgaguacagaaugcugcagcgggcucucgcccuguuuggaggcgaaaaagagagacuuacgccguauuuccgccaaaugaaucugacagggggaaacaauccccauccuuuucuccacgagacccggugggaaucccauaccaacauccugucuuucuacagaagcuaucugaaggcccgcaaggcuuuucuucaguccauuggccggagcgauagagucgagaaucaccgcuuccuccugcugaaagaacccaagacagaccggcagacccucguggccggguggaaaggcgaguuccaucugccuagaggaaucuuuacagaagcuguccgcgauugucuuaucgagaugggccuggacgagguggggucuuacaaggaaguuggauucauggccaaagcggugccccucuauuuugagcgggccugcaaggacagaguccagccguucuacgauuauccuuuuaacgugggcaacucccugaaacccaagaaggggcgguuccugagcaaagaaaagcgcgcugaggagugggaaucuggaaaagagagauuucggcuugccaagcucaaaaaggaaauucuggaggcuaaggaacacccuuaccuggacuucaaauccuggcaaaaguuugagcgcgagcucagacugguuaaaaaucaggauaucauuacguggaugaucugucgggaccuuauggaagagaacaagguggaaggccuggauaccgggacacucuaccugaaagacauuagaaccgauguccaggagcagggcaaucugaacgugcuuaaucgcgugaagcccaugcggcugccuguugucguguauagagccgacagccgcggacacgugcauaaagaacaagcgccccucgccacagucuacaucgaggagcgggauaccaagcugcucaagcagggcaacuucaaauccuuugugaaggacagacgccugaaugggcuuuucucuuucguugauacgggagcucuggccauggaacaguauccgauuagcaaacuccggguggaguacgaacuggcuaaguaucaaaccgccagagucugcgccuuugagcagacacuggaacuugaggagucccugcucacccgcuacccucaucugcccgacaaaaacuucagaaagaugcucgaaucuuggagcgacccccugcuugauaaguggccugaccugcacggcaaugugcggcuccugaucgcuguucgcaacgcguuuucccacaaucaguauccgauguacgaugaggccguguucagcucuaucagaaaauacgaccccuccagcccugaugcuauugaggagcggauggggcugaacaucgcccaucgccuuucugaggaagucaagcaggccaaagagauggcugaaagaauuauccaagccuga

SEQ ID NO: 11437 - RNA, 3360 nt, Artificial Sequence
  Cas13b variant__Porphyromonas gingivalis__WP_039417390.1__Cas13b
augaccgagcagaacgaaagacccuacaauggcacauauuacacgcuggaggacaagcacuucugggccgccuuuuucaaccucgcucggcauaaugcguauaucacccuggcucacauugaucgccaacuugccuacagcaaagccgacaucacaaacgaugaagacauucuguuuuucaaggggcaguggaaaaaucucgauaacgaccuggagagaaaggcucggcuucgcucccugauccucaaacauuuuucuuuccuggaaggagccgcuuauggcaagaagcuguuugagagccaguccucugggaauaaaagcuccaagaaaaaggagcucaccaaaaaggaaaaggaggaacugcaggccaacgcgcuuucucuggauaaucucaaaagcauucuguucgacuuucuucaaaagcugaaagauuucagaaacuacuauucccacuaccggcauccugagagcucugagcucccgcuguuugacggaaauaugcugcagcgccucuacaacguguucgaugucuccguucagagagugaagcgggaccacgaacacaaugauaaaguggacccccaucgccacuuuaaccaucuggucagaaagggcaaaaaggaccgguaugggaauaacgauaacccuuucuucaagcaccacuuuguggaccgcgagggaacaguuaccgaagccggccuucuguucuuugugagccucuuccuggagaaaagagaugcuaucuggaugcagaagaaaauccggggcuuuaaagggggaacagaagccuaccaacagaugaccaaugaggucuucugccgcucuagaauuucccuucccaaacugaagcucgagagccugcggacggacgauuggaugcugcucgacaugcugaacgaacuugugagauguccuaagucucuguaugaucgccuccgggaggaagacagagcucgcuuucggguucccaucgauauucuguccgacgaggaugacaccgacggcacagaagaggauccuuucaaaaauacccuugugagacaucaggaccgcuuuccguacuucgcccugcgguauuuugaucucaagaaagucuucacaagccugagauuucacaucgaccuggggaccuaccauuucgcgauuuauaagaaaaacaucggagagcagcccgaagaucgccaccucacgcggaaucuguacggcuucgggcggauucaagacuuugccgaggaacaucgcccugaggaauggaagcggcuugugagagaucuggacuacuucgagacaggagauaagcccuauaucacccagacaaccccucacuaccacaucgagaaaggcaagauuggccuccgguuugugcccgaagggcagcaucuguggccguccccugaggucggagcuacccgcacaggcagaucuaaauaugcccaagacaagcggcugacggcugaagccuuccuuagcguucacgagcucaugcccaugauguuuuacuauuuccugcugagagagaaauacuccgaagaggugagcgccgaaaaggugcaggggcgcaucaagcgggucauugaggauguguaugcuguuuacgacgcguuugccagaggagaaaucgauacccucgaccgccuggacgcuugccuugccgauaaaggcauuagacgggggcaucugccucgccagaugaucgccauccucucucaggagcacaaggacauggaggaaaaagugagaaagaaacugcaagagaugauugcugauacagaccaccggcuggauaugcuugaccgccagaccgauagaaagauccggauuggacgcaaaaacgccggccuccccaaguccggcgucaucgcggacuggcuggugagagauaugaugcgguuccagcccguugcuaaggacacaagcgggaaaccucugaauaacucuaaggccaauagcaccgaauaccgcaugcuccagagagcccuggcucuuuuuggaggcgagaaagaacggcugacgccguauuucagacaaaugaaccucacagggggaaauaacccccauccuuuucugcacgagacccgcugggagucccauaccaauauucugucuuucuaccggagcuaucuuaaggccagaaaggcuuuucuccaguccaucggccgcagcgaucgggaagagaaccacagauuccugcugcucaaggaacccaagacagaccgccagacccugguggccggguggaaaucugaguuccaucuuccucggggcaucuuuacagaagcggucagagauugucugauugagaugggauacgacgaggugggcuccuauaaggaagucggguucauggccaaagcugugccccucuacuuugagcgcgccugcaaggaccggguucagccguucuaugauuacccuuuuaaugugggaaacagccugaaacccaagaagggcagauuccugucuaaagaaaagcgggcugaggagugggaauccgggaaagagcgcuuuagacuugccaagcucaaaaaggaaauccuggaggcgaaggaacacccuuaccuggacuucaaaagcuggcaaaaguuugagcgggagcuccgccuggucaaaaaccaggauauuaucacguggaugauguguagagaccuuauggaagagaauaagguggaaggacuggauaccggcacacucuaucugaaagacauucggaccgauguucacgagcaggggucccugaacgugcuuaauagagucaagcccaugcgccugccuguggugguuuaccgggccgacucuagaggccauguccacaaagaacaggcuccccucgccacaguguauaucgaggagcgcgauaccaagcugcucaagcaaggaaacuucaagagcuuugugaaagaccggagacugaauggccuuuucuccuucgucgauacgggggcucuggccauggaacaguacccgauuucuaaacuccgcguggaguaugaacuggccaaguaccagaccgcucggguuugcgcguuugagcaaacacuggaacuugaggagagccugcucaccagauauccucaucugcccgacaaaaacuuccgcaagaugcucgaauccuggagcgacccccugcuugauaaguggccugaccugcacagaaaagugcggcuccugaucgccguccgcaaugcuuuuucucauaaccaguacccgauguacgaugaggccguguucuccagcaucagaaaguaugaccccucuuccccugaugccauugaagagagaaugggacugaauaucgcucaccgccuuagcgaggaaguuaaacaggccaaggagauggcggaaagaauuauccagguguga

SEQ ID NO: 11438 - RNA, 3528 nt, Artificial Sequence
  Cas13b variant__Porphyromonas gingivalis__EOA10535.1__Cas13b
augaccgagcagaacgaaaagcccuacaauggcacauauuacacgcuggaggacaaacacuucugggccgccuuuuucaaccucgcuagacauaaugcguauaucacccugacacacauugaucggcaacuugcuuacagcaaggccgacaucaccaacgaugaagacauucuguuuuucaaagggcaguggaagaaucucgauaacgaccuggagcgcaaagccagacuucggucccugauccucaagcauuuuucuuuccuggaaggagcugccuauggcaagaaacuguuugagagccaguccucugggaauaagagcuccaaaaagaaagagcucacaaagaaggaaaaagaggaacugcaggcuaacgcccuuucucuggauaaucucaagagcauucuguucgacuuucuucaaaaacugaaggauuuccgcaacuacuauucccacuacagacauccugagagcucugagcucccgcuguuugacggaaauaugcugcagcggcucuacaacguguucgaugucuccguucagcgcgugaaaagagaccacgaacacaaugauaagguggacccccaucggcacuuuaaccaucugguccgcaaaggcaagaaggacagaugcgggaauaacgauaacccuuucuucaaacaccacuuuguggaccgggaggaaaagguuaccgaggcgggacuucuguucuuugugagccucuuccuggaaaaacgcgaugccaucuggaugcagaagaaaaucagaggcuuuaagggcgggacagagaccuaucaacagaugacgaaugaggucuucugucggucucgcauuucccuucccaagcugaaacucgaaagccugagaaccgacgauuggaugcugcucgacaugcugaacgagcuugugcggugcccuaagucucuguacgauagacuccgcgaagaggaccgggcuagauuucgcguucccguggauauccuguccgacgaagaugacacagacggaaccgaggaggauccuuucaaaaauacacuuguccggcaucaggacagauuuccguauuucgcccugcgcuacuuugaucucaagaaaguguucaccagccugcgguuucacauugaccugggcacguaucauuucgcuaucuacaagaagaacauuggggaacagcccgaggauagacaccucacacgcaaucuguauggauucggccggauccaagacuuugccgaagaacauagaccugaagaguggaaacgccuugugcgggaucuggacuacuucgagaccggggauaagcccuacauuacacagaccaccccucacuaucacaucgaaaaaggaaagaucggccucagauuuguccccgagggccagcugcuguggccguccccugaaguuggggcgacacggacgggacgcucuaaauacgcccaagacaagagauucaccgcugaggccuuucuuagcgugcaugagcucaugcccaugauguucuauuacuuucugcugcgggaaaaguauuccgaggaagcuagcgccgagagagugcagggccgcauuaaacgggucaucgaagauguguacgccguuuaugacgcuuucgcgagaggggagauugauacacucgaccgccuggacgccugucuugcugauaagggaaucagacggggccaucugccucgccagaugauugccauccucucucaggagcacaaagacauggaagagaaggugcggaaaaagcugcaagaaaugaucgccgauaccgaccacagacuggauaugcuugaccgccagacagauagaaaaauucggaucgggcgcaagaacgcuggacuccccaaguccggcgucauugccgacuggcuggugagagauaugaugcgguuucagcccguugcgaaagacaccagcggcaagccucugaauaacucuaaagcuaauagcacggaguaccgcaugcuccagagagcccuggcccuuuucgggggagaaaaggagcggcugacaccguacuuuagacaaaugaaccucaccggcgggaauaacccccacccuuuccugcaugagacccgcugggaaucccacacaaauauccugucuuuuuaucggagcuaccuuaaagcuagaaaggccuuccuccaguccauuggacgcagcgaucggguggagaaccauagauuccugcugcucaaggaacccaaaaccgaccgccagacacuggucgcuggcuggaagggggaguuucaccuuccucggggcaucuucacggaagccgugagagauugccugaucgagaugggacucgacgaggucggcucuuauaaagaagugggguuuauggcgaaggccguuccccuguacuucgagcgcgcuuguaaagaccgggugcagccguuuuaugauuacccuuucaaugucggaaacucccugaagcccaagaaaggcagauuucuuagcaaggaaaaacgggccgaggagugggaaucugggaaggagcgcuucagagaccucgaggcuuggucccauagcgccgcgcggcgcauugaggaugccuuugcuggaaucgaaaacgccuccagagagaauaaaaagaagauugagcaacugcugcaggaccucucucugugggaaaccuucgagagcaaacuuaaggugaaagcugauaagaucaacauugccaaacugaagaaagaaauccucgaggccaaggaacacccuuaucuggacuuuaaguccuggcagaaauucgagcgggagcugagacuuguuaagaaucaggauauuaucacauggaugaugugccgcgaccugauggaagagaacaaaguggaaggccucgauaccgggacacuguaccucaaggacauccggaccgauguccacgagcaaggcucucugaaugugcuuaacagagugaaacccaugcgccugccuguugucguguaccgggcugacagcagaggacaugugcacaaggaacaggcgccccucgccacggucuauauugaggagcgcgacaccaagcugcugaaacagggcaauuucaaguccuuugugaaagaucggagacuuaacgggcuguucagcuuuguugacacaggagcucucgccauggaacaauacccgaucucuaagcugcgcguggaguaugaacucgccaaauaccagaccgcuagagucugugccuucgagcagacacuggagcuugaagagucccugcucacccgguauccucaucugcccgauaagaauuuucgcaagaugcuggaaagcuggucugacccccuucuggauaaauggccugaccuccacggcaacgugagacugcucauugcgguucggaaugcuuucucccauaaccaguacccgauguaugaugagacgcuguuuagcucuauccgcaaguacgaccccagcuccccugaugccauugaagagagaauggggcuuaauaucgcccaccggcugagcgaggaagugaaacaagcuaaggagauggucgaaagaaucauucaggccuga

SEQ ID NO: 11439 - RNA, 3360 nt, Artificial Sequence
  Cas13b variant__Porphyromonas gingivalis__WP_061156470.1__Cas13b
augaccgagcagaacgaaagacccuacaauggcacauauuacacgcuggaggacaagcacuucugggccgccuuuuucaaccucgcccggcauaaugcguauaucacccugacacacauugaucgccaacuugcuuacagcaaagccgacaucaccaacgaugaagacauucuguuuuucaaggggcaguggaaaaaucucgauaacgaccuggagagaaaggcccggcuucgcucccugauccucaaacauuuuucuuuccuggaaggagcugccuauggcaagaagcuguuugagaauaaaagcuccgggaacaagucuagcaaaaagaaagagcucacaaagaaggaaaaagaggaacugcaggcuaaugcccuuucccuggauaaccucaagucuauucuguucgacuuucuucagaaacugaaggauuucagaaauuacuauagccacuaccggcauccugaguccagcgagcucccgcuguuugacggaaacaugcugcaacgccucuacaauguguucgaugucucuguucagagagugaaacgggaccacgaacacaacgauaagguggacccccaucgccacuuuaaucaucuggucagaaaaggcaagaaggaccggugcgggaacaacgauaauccuuucuucaaacaccacuuuguggaccgcgagggaaagguuaccgaagcgggccuucuguucuuugugucccucuuccuggagaaaagagaugccaucuggaugcagaagaaaauccggggcuuuaaagggggaacagaggcuuaucagcaaaugaccaacgaagucuucugucgcagcagaauuucucuucccaagcugaagcucgagucccugcggacggacgauuggaugcugcucgacaugcugaaugaacuugugagaugcccuaagagccuguacgaucgccuccgggaggaagacagagcccgcuuucggguucccguggauauccugucugacgaggaugacaccgacggcacagaagaggauccuuucaaaaacacccuugucagacaucaggaccgcuuuccguauuucgcucugcgguacuuugaucucaagaaaguguucacaucccugagauuucacauugaccuggggaccuaucauuucgccaucuacaagaagaauauuggagagcagcccgaagaucgccaccucacgcggaaccuguauggcuucgggagaauccaggacuuugcggaggaacaucgcccugaggaauggaaacggcuugugagagaucuggacuacuucgagacaggagauaagcccuacauuacccaaacaaccccucacuaucacaucgagaaaggcaagaucggccuccgguuuguccccgaagggcagcaucuguggccgagcccugagguuggagccacccgcacaggcagauccaaauacgcucaggacaagcggcugacggccgaggcuuuccuuucugugcacgaacucaugcccaugauguuuuauuacuuccugcugagagagaaguauagcgaagagguguccgccgaaaaaguccaagggcgcauuaagcgggugaucgaggauguuuacgccguguaugacgcuuuugcgagaggagaaauugauacccucgaccgccuggacgccugucuugcugauaaaggcaucagacgggggcaucugccucgccagaugauugccauccucagccaggagcacaaggacauggaggaaaaagucagaaagaaacugcaggagaugaucgccgauacagaccaccggcuggauaugcuugaccgccaaaccgauagaaagauucggaucggacgcaagaaugcuggccuccccaaaucuggcgugauugccgacuggcugguuagagauaugaugcgguuccagcccguggcgaaggacacauccgggaaaccucugaacaauagcaaggcuaacucuaccgaauaccgcaugcuccagagagcccuggcccuuuuuggaggcgagaaagaacggcugacgccguacuucagacagaugaaucucacagggggaaacaauccccauccuuuucugcacgagacccgcugggagagccauaccaacauccuguccuucuaucggucuuaccuuaaggcuagaaaggccuuucuccaaagcauuggccgcuccgaucgggaagagaaucacagauuccugcugcucaaagaacccaagacagaccgccagacccuggucgcuggguggaaaagcgaguuccaucuuccucggggcaucuuuacagaagccgugagagauugccugaucgagaugggauaugacgaggucggcucuuacaaggaagugggguucauggcgaaagccguuccccucuauuuugagcgcgcuuguaaggaccgggugcagccguucuacgauuauccuuuuaacgucggaaacucccugaagcccaaaaagggcagauuccugagcaaagaaaagcgggccgaggagugggaaucugggaaagagcgcuuuagacuugcuaagcucaagaaagaaauucuggaggccaaggaacacccuuaccuggacuucaaauccuggcagaaguuugagcgggagcuccgccuggugaaaaaucaagauaucauuacguggaugaugugcagagaccuuauggaagagaacaagguugaaggacuggauaccggcacacucuaccugaaagacauccggaccgaggugcaggaacaggggagccugaauguccuuaacagagugaagcccaugcgccugccugugguugucuaucgggcggauuccagaggccacgugcauaaggagcaggcuccccucgcuacaguguacauugaggaacgcgacaccaaacugcucaagcaaggaaauuucaaaucuuuugucaaggaucggagacugaacggccuuuucagcuucguggacaccgggggacuggccauggagcaguauccgaucuccaaacuccgcguugaauacgagcuggcuaaguaucagacggcccgggugugugccuuugaacaaacacuggagcuugaggaaucucugcucaccagaugcccucaucugcccgauaagaauuuccgcaaaaugcucgagagcugguccgacccccugcuugacaaguggccugaucugcagagagaagucuggcuccugauugcugugcggaacgcguuuagccacaaucaguacccgauguaugacgaggccguuuucucuuccauccgcaaauacgaucccagcucuccugacgcuaucgaggaaagaaugggccugaacauugcccaccggcuuuccgaggaagugaagcaggccaaagagauggcugaacgcaucauucaagccuga

SEQ ID NO: 11440 - RNA, 3360 nt, Artificial Sequence
  Cas13b variant__Porphyromonas gingivalis__WP_013816155.1__Cas13b
augaccgagcagaacgaaaagcccuacaauggcacauauuacacgcuggaggacaaacacuucugggccgccuuuuucaaccucgccagacauaaugcguauaucacccuggcucacauugaucggcaacuugccuacagcaaggccgacaucacaaacgaugaagacauucuguuuuucaaagggcaguggaagaaucucgauaacgaccuggagcgcaaagcuagacuucggucccugauccucaagcauuuuucuuuccuggaaggagccgcuuauggcaagaaacuguuugagagccaguccucugggaauaagagcuccaaaaacaaggagcucaccaaaaaggaaaaggaggaacugcaggccaaugcgcuuucucuggauaaccucaaaagcauucuguucgacuuucuucaaaagcugaaagauuuccgcaauuacuauucccacuacagacauccugagagcucugagcucccgcuguuugacggaaacaugcugcagcggcucuacaauguguucgaugucuccguucagcgcgugaagagagaccacgaacacaacgauaaaguggacccccaucggcacuuuaaucaucugguccgcaagggcaaaaaggacagauaugggaacaacgauaauccuuucuucaagcaccacuuuguggaccgggagggaacaguuaccgaagccggccuucuguucuuugugagccucuuccuggagaaacgcgaugcuaucuggaugcagaagaaaaucagaggcuuuaaagggggaacagaaaccuaccaacagaugacgaacgaggucuucugccggucucgcauuucccuucccaaacugaagcucgagagccugagaaccgacgauuggaugcugcucgacaugcugaaugaacuugugcgguguccuaagucucuguaugauagacuccgcgaggaagaccgggccagauuucgcguucccguggauauccuguccgacgaggaagauacagacggcgcugaggaggacccuuucaaaaacacccuuguccggcaucaggauagauuuccguacuucgcccugcgcuauuuugaccucaagaaaguguucacaagccugcgguuucagauugaucuggggaccuaccacuucgcgaucuauaagaaaaauauuggagaacaacccgaggacagacaucucacgcgcaaccuguacggcuucgggcggauccaggauuuugccgaggaacacagaccugaagaguggaagcgccuugugcgggaccuggauuacuucgagacaggagacaagcccuauauuacccagacaaccccucauuaccacaucgaaaaaggcaagaucggccucagauuuguccccgaggggcaacaccuguggccguccccugaaguuggagcuacccggacaggccgcucuaaauaugcccaggauaagagauucacggcugaggccuuucugagcgcccaugagcuuaugcccaugauguucuacuauuuucuccugcgggaaaaauacuccgaggaagcuagcgcggagagagugcaggggcgcauuaagcgggugaucgaagacgucuaugccguguacgaugcuuucgccagagacgagauuaauacccgcgaugagcuggacgccugccucgcugacaagggaaucagacggggccaucugccucgccagaugauugggauccuuucucaagaacacaaagauauggaggaaaagaucagaaagaagcugcaggagaugauggccgacacagaucaccggcucgacaugcuggaucgccagaccgacagaaaaauucggaucggacgcaagaacgcgggccugcccaaauccggcguuauugcugauuggcuugugagagacaugaugcgguuucagcccgucgccaaggauacaagcgggaagccucucaauaacucuaaagccaauagcaccgaauaccgcaugcugcaaagagcucuggcccucuucggaggcgagaaggagcggcugacgccguauuuuagacagaugaaccuuacagggggaaauaacccccacccuuuccugcaugaaacccgcugggagucccacaccaauauccucucuuuuuaccggagcuaucugaaagcuagaaaggccuuccugcaguccauuggccgcagcgaccggguggaaaaccauagauuccuucuccugaaagagcccaagacagaucgccagacccugguugcgggguggaagggcgaauuucaccucccucggggaaucuucacagaggccgugagagacugucugaucgagaugggccuugaugaagucgggucuuacaaagaggugggauuuauggcuaaggccgucccccuguauuucgaacgcgcuugcaaagacugggugcaaccguuuuacaacuauccuuucaauguuggcaacucccucaagcccaaaaaggggcgguuucugagcaaggagaaaagagccgaggaaugggagucuggaaaggaacgguuccgccuggcgaaacuuaagaaagagauucucgaagccaaggagcauccuuaccuggacuuuaaguccuggcagaaauucgagagagaacugcggcucgugaagaaucaggauaucauuacguggaugaucuguggcgaccugauggaggaaaacaaagucgaggggcuugauaccggcacacuguaccucaaggacauucgcaccgaugugcaggaacaaggaagccugaauguucugaacagagugaaacccaugcggcuuccugucgugguguauagagcugacucccgcggccacguucacaaggagcaggcuccccuggcuacagucuacaucgaggaacgggauaccaaacuccugaagcaggggaauuuuaagucuuucgugaaagacagacgccucaacggacuguucagcuuuguggauacgggcgcccuugccauggagcaauauccgauuuccaagcugcgggucgaauacgagcucgcuaaauaucagaccgcgagagugugcgccuucgaacagacacuggagcuggaggaaucucuucugacccgcuguccucaucuccccgacaagaauuuucggaaaaugcuggagagcugguccgauccccuccuggacaaguggccugaccuucacagaaagguucgccugcucaucgcugugagaaacgccuucagccauaaucaguacccgauguaugaugaagccgucuuuucuuccauccggaaauacgaccccagcuucccugaugcuauugaggagcgcauggggcugaacaucgcccacagacugucugaagaggugaagcaagcgaaagaaacaguugagcggauuauccaggcuuga

SEQ ID NO: 11441 - RNA, 3528 nt, Artificial Sequence
  Cas13b variant__Porphyromonas gingivalis__WP_005874195.1__Cas13b
augaccgagcagaacgaaaagcccuacaauggcacauauuacacgcuggaggacaaacacuucugggccgccuuuuucaaccucgccagacauaaugcguauaucacccuggcucacauugaucggcaacuugccuacagcaaggccgacaucacaaacgaugaagacauucuguuuuucaaagggcaguggaagaaucucgauaacgaccuggagcgcaaagcuagacuucggucccugauccucaagcauuuuucuuuccuggaaggagccgcuuauggcaagaaacuguuugagagccaguccucugggaauaagagcuccaaaaagaaagagcucaccaagaaggaaaaagaggaacugcaggccaacgcgcuuucucuggauaaucucaagagcauucuguucgacuuucuucaaaaacugaaggauuuccgcaacuacuauucccacuacagacauccugagagcucugagcucccgcuguuugacggaaauaugcugcagcggcucuacaacguguucgaugucuccguucagcgcgugaaaagagaccacgaacacaaugauaagguggacccccaucggcacuuuaaccaucugguccgcaaaggcaagaaggacaaauaugggaauaacgauaacccuuucuucaagcaccacuuuguggacagagaggaaaaaguuacagaggccggacuucuguucuuugugagccucuuccuggaaaagcgggaugcuaucuggaugcagaaaaagauccgcggcuuuaagggcgggaccgaggccuaccaacagaugacaaaugaggucuucugcagaucucggauuucccuucccaaacugaagcucgaaagccugcgcaccgacgauuggaugcugcucgacaugcugaacgagcuugugagauguccuaaaucucuguaugaucggcucagagaagaggaccgcgcucgguuuagaguucccguggauauccuguccgacgaagaugacacggacggaaccgaggaggauccuuucaagaauacacuuguccgccaucaggaccgguuuccguacuucgcccugagauauuuugaucucaaaaagguguucaccagccugcgcuuucacauugaccugggcacauaccauuucgcgaucuauaagaaaaacauuggggaacagcccgaggaucggcaccucaccagaaaucuguacggauucggccgcauccaagacuuugccgaggaacaucggccugaagaguggaagagacuugugcgcgaucuggacuacuucgagacgggggauaaacccuauauuacacagaccacaccucacuaccacaucgaaaagggaaaaaucggccuccgguuuguccccgagggccagcugcuguggccguccccugaaguuggggcuaccagaaccggacggucuaaguaugcccaagacaagcgcuucacagcugaggccuuucuuagcgugcaugagcucaugcccaugauguucuacuauuuucugcugagagaaaaauacuccgaggaagccagcgcugagaaggugcagggccggauuaaaagagucaucgaagauguguaugcgguuuacgacgccuucgcucgcgaugagauuaacacgcgggacgagcucgacgccugccuggccgauaaggggaucagacgcggacaccuuccuagacagaugauugcuauccugucucaggaacauaaagacauggaggaaaaggugcggaaaaagcuccaagagaugaucgccgauaccgaccaccgccuggauaugcuggacagacagacagaucggaagauucgcaucggcagaaagaaugcggggcuucccaaguccggagucauugcugacuggcucgugcgggauaugaugcgcuuucagcccguugccaaagacaccagcggcaagccucugaacaauucuaaagccaacagcacagaauacagaaugcugcagcgggcucucgcccuguucggcggggagaaggagcgccuuaccccguauuuuagacaaaugaaucugacgggaggcaacaauccccacccuuuccuccaugaaacacggugggagucccacaccaacauccugucuuuuuacagaagcuaucugaaggcucgcaaagccuuccuucaguccauugggcggagcgauagagaagagaaucaucgcuuccuccugcugaaggaacccaaaaccgaccggcagacacucguggcgggauggaagucugaguuucaccuuccuagaggcaucuucaccgaggccguccgcgauugucuuaucgaaaugggguacgacgaggugggcuccuauaaagaagucggauuuauggcuaaggccgugccccuguacuucgagcgggcuugcaaggacagaguucagccguuuuaugauuacccuuucaacgugggcaacagccucaaacccaagaaagggcgcuuucugucuaaggagaaacgggccgaagagugggaauccggaaaggagagauuccgggaccuggaagcguggagccauuccgccgcucgcagaauugaggaugccuuugucggcaucgaguacgcuucuugggaaaauaagaaaaagauugagcaacuucuccaggaccugagccugugggaaacauucgaguccaaacucaaggugaaagccgauaagaucaacauugccaaacugaagaaggaaauccuugaggcuaaagagcacccuuaucacgacuuuaagucuuggcagaaauucgaacgggagcugcgccucguuaagaaucaggauauuaucacguggaugauguguagagaccugauggaagagaacaaaguggaagggcuggauaccggaacacuuuaccugaaggacauccggaccgauguccaagagcagggcagccucaaugugcugaaccaugugaagcccaugagacucccuguugucguguaucgcgcggacucccgggggcacgugcauaaagaggaagcuccccuggcuacagucuacauugaggaaagagacaccaagcugcugaaacagggcaauuucaagagcuuugugaaagaucgccggcucaacggacuguucucuuuuguugacacgggcgcccuggccauggagcaauauccgaucuccaaacuuagaguggaguacgaacuggcuaaguaucagaccgcccgcgucugcgcguucgagcagacacucgaacuggaggaaagccuccugacccgguacccucaccuucccgaugagucuuuuagagagaugcuggaauccuggagcgacccccuccuggauaaauggccugaccugcagcgcgaggugagacuucugauugcuguucggaaugccuucucucauaaccaauacccgauguaugaugaaacaaucuuuagcuccauucgcaaguacgaccccagcucucucgaugccaucgaggaaagaauggggcugaauaucgcucaccggcucuccgaggaggugaaacuggccaaggaaauggucgagcgcauuauccaggcguga

SEQ ID NO: 11442 - RNA, 3360 nt, Artificial Sequence
  Cas13b variant__Porphyromonas gulae__WP_039437199.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaugaagacauucucuucuuuaaggggcaguggaaaaaccuggauaaugaccuugagagaaagucucggcugcgcagccucauccugaaacauuucuccuuucuggaaggagccgcuuauggcaagaaguucuuugagucuaaaagcuccgggaacaagucuagcaaaaauaaggagcucaccaaaaaggaaaaggaggaacugcaggccaacgcucuuucccuggauaaucucaaaagcauucuguucgacuuucuucagaagcugaaagauuucagaaacuacuauucucacuaccggcauuccggaagcucugagcucccucuguuugacggcaauaugcugcaacgccucuacaacguguucgaugucuccguucagagagugaagcgggaccacgagcacaaugaugaaguggacccgcauuaucacuuuaaccaucugguccgcaaagggaagaaagacagauacggacacaaugauaaccccagcuucaagcaccauuucguggacggcgagggcaugguuacagaagccgggcuucuguuuuucgugucucucuuucuggagaagcgggaugcgaucuggaugcagaaaaagauccgcggauucaaaggcgggacagaaccuuaugagcagaugaccaacgaggucuuuugcagaucccggauuagccuucccaagcugaaacucgaaucccugcgcacggacgauuggaugcugcucgacaugcugaaugagcuugugagauguccuaagccccuguacgaucggcucagagaaaaggaccgcgccugcuuccggguuccuguggauauccugccggacgaggaugacaccgacggaggcggggaagaucccuuuaaaaacacacuugucagacaccaagaccgcuucccuuauuuugcucugcgguacuucgaucucaagaaaguguuuaccucucugagauuccauauugaccugggaacauaucacuuugccaucuacaagaaaaugauuggcgagcagcccgaggaucgccaucucacccggaaucuguacggcuucgggagaauccaggacuucgcugaagaacaccgcccugaagaguggaagcggcuugugagagaucuggacuauuuugaaacgggagauaagcccuacauuagccagacaaccccgcacuaucauaucgagaaaggcaagaucgggcuccgcuucgucccugagggacaacaccuguggcccuccccugaaguuggcacaacccggaccgggagaagcaaauacgcccaggacaagcggcugacagcggaggccuuucuuucugugcaugaacucaugcccaugauguucuauuacuuucugcugcgcgagaaauauuccgaggaagugagcgcugagaagguccagggaagaauuaagcgggugaucgaagauguuuacgccauuuacgacgcuuucgccagagaugagaucaacacgcucaaagaacuggacgccugucuugcugacaagggcauucgccggggccaucugcccaaacaaaugaucgggauccucucucaggagagaaaggauauggaggaaaaagugcgcaagaaacugcaggagaugauugcggacaccgaucacagacuggacaugcuugaucggcagacagaccgcaagaucagaauuggacggaagaaugccggccucccuaaaagcggggucaucgcugauuggcuggugcgcgacaugaugagauuucaaccgguugccaaggauaccuccggaaaaccccugaacaauucuaaggccaacagcacagaauaucggaugcuccagcgcgcucuggcccuuuucggcggggagaaagaaagacugaccccuuacuuucggcagaugaaucucacgggcggaaacaauccccacccuuuccugcacgagacacgcugggagucccauaccaacauucugagcuuuuauagaucuuaccuucgggcgagaaaggcuuuccucgaacgcaucggccgguccgacagaguggagaauugccccuuucugcugcucaaggaaccgaaaaccgaucgccagacacuggucgccggguggaagggagaguuccaccuuccucggggcaucuucaccgaagccgugagagacugucugauugagaugggguaugaugaggucggaagcuaccgcgaagugggcuuuauggcuaaagccguuccccucuauuucgagcgggcuugcgaagacagagugcaaccuuuuuacgacucucccuucaacgucggcaauucccugaagccuaaaaaggggcgcuuucugagcaaggagaaacgggccgaggaaugggaguccggaaaggaaagauuccggcuugcgaaacucaagaaagagauccuggaagcccaggagcaucccuaccacgauuuuaagucuuggcagaaguucgagcgcgaacugagacucgugaaaaaccaggacauuaucacauggaugaugugucgggaucugauggaggaaaacaagguugagggccuugacacggggacccuguaucucaaagauauucgcccgaaugugcaagaacagggaagccugaacguccugaauagagugaagccuaugcggcuucccgugguugucuacagagcugacucccgcggccacgugcauaaagaggaggcuccccuggccacaguguauaucgaggagcgggauaccaagcuccugaaacaggggaacuuuaagucuuucgucaaggacagacgccucaauggacuguuuagcuucguggauacaggcgcccuugcgauggaacaguacccuauuuccaaacugcggguugaguaugaacucgccaaguaccaaaccgcuagagugugcgccuucgagcagacgcuggagcuggaagagagccuucugacccgcuauccgcaccuccccgacgaaucuuuucgggagaugcuggaguccuggagcgauccucuccugacaaaauggcccgaacuucaugggaaggucagacugcucaucgcugugcgcaacgccuucucucacaaucaguacccuauguacgacgaggccguguuuuccagcaucuggaaauaugaccccucuagcccugaugcuauugaagagagaaugggccugaacaucgcgcaucggcuguccgaagagguuaagcaagccaaggagaccauugaacgcaucauucaggcuuga

SEQ ID NO: 11443 - RNA, 3360 nt, Artificial Sequence
  Cas13b variant__Porphyromonas gulae__WP_039419792.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaaccuugauaaugaccuggaaagaaagagccggcuccgcucccugauucugaaacauuuuucuuuccucgagggggcugccuauggaaagaagcuguuugaaagcaaauccucuggcaacaagagcuccaaaaauaaggagcuuaccaaaaaggagaaggaagaacugcaggcuaacgcccucagccuggauaaucuuaaaucuauccuguucgacuuucuccagaagcugaaagauuucagaaacuacuauucccacuaccggcauagcgggucuuccgaacugccucucuuugacggaaauaugcugcaacgccuuuacaacgucuucgauguuagcgugcagagagugaagcgggaccacgagcacaaugauaaagucgacccgcaucgccacuuuaaccaucuggugagaaagggcaaaaaggaccgguaugggcacaaugauaaccccucuuucaagcaccauuuuguugacggagagggcauggugacagaagcgggccuccuguucuucgucucccuuuuucuggagaaacgcgaugccauuuggaugcagaagaaaaucagaggguucaagggaggcacagaaaccuaccagcaaaugacgaacgagguguuuugccggagccgcaucucccucccuaaacugaagcuggaaucucucagaaccgacgauuggaugcugcuugacaugcugaaugagcucguucggugucccaagccucuguaugauagacuucgcgagaaagaccgggcuagauuccgcgugcccgucgauauucugccugacgaagaugacacagacgggggaggcgaggauccguuuaagaacacccucgugcggcaccaggacagauuccccuacuuugcccugcgcuauuucgaucugaaaaagguguuuacaagccuccgguuccauaucgaccuggggaccuaccacuuugcuauuuauaaaaaggucaucggagaacagccugaggauagacaucuuacgcgcaaucuguacggcuucggccggauucaggacuuugccgaagaacacagacccgaggaauggaagcgccucguucgggaucuggacuacuucgagacaggggauaaaccuuauaucucccaaaccacaccccacuaccauauugaaaagggaaaaaucggccugagauucgugccggaggggcagcaccuuuggccuagccccgaagugggaaccacccggacaggccgcucuaaguaugcgcaggacaaaagacucacggccgaggcuuuucuguccguccaugagcugaugccuaugauguucuacuauuuucuccugcgggaaaaguacagcgaggaagugucugccgagaagguucaagggagaaucaaacgcgugauugaggaugucuaugcuaucuacgacgccuucgcccgggaugaaauuaacaccagagacgagcuugacgcuugccuggcggauaagggaauccgcagaggccaccuccccaaacagaugauuggcauccugagccaggaacacaagaauauggaggaaaaagugcggaagaaacugcaggagaugaucgccgacacagaucaucgccuugacaugcucgauagacaaaccgaccggaagauucgcaucgggagaaagaacgcuggacugcccaaauccggcguuauugccgauuggcuggugcgggacaugaugcgcuuucagccugucgccaaggauacaucugggaaaccgcucaauaacagcaaggcuaauuccaccgaguacagaaugcugcagcgggcccuugcgcuguucggaggcgaaaaagagcgccucacgcccuauuuuagacagaugaaccugacagggggcaauaacccucaccccuuccuggacgaaacccggugggagagccauaccaauauccuuucuuuuuacagauccuaucuccgcgcucggaaggccuuccuggaaagaauuggacgcagcgaucggguggagaacagaccuuuucugcuccugaaggagcccaaaacagaccgccaaacccuugucgccggcuggaagucugaguuccaucugccgcgggggaucuuuacagaggcugugagagauugucucaucgaaaugggauacgacgagguuggcuccuauaaagaagugggguucauggccaaggcugucccucuguacuucgagcgcgccugcaaagaccgggugcagcccuuuuaugauagcccuuucaauguuggaaacucccugaagcccaagaaaggcagauuucuuucuaaggagaaacgggcggaagagugggaaagcgggaaggagcgcuucagacucgccaaacugaagaaggagauucuggaagcucaggagcacccuuaccacgacuuuaaauccuggcagaaguucgaacgggagcuccgccuggugaaaaaccaagauaucauuacguggaugauguguagagaccuuauggaagagaauaaggucgagggccuggauaccggaacacucuaccugaaagacauccggcccaacgugcaggaacagggcucucugaaugugcuuaacagaguuaagccgaugcgccugccugucgugguguaucgggccgauagcagagggcacguccauaaagaggaagcuccccucgccaccguguacauugaggaacgcgacacaaagcugcucaagcagggaaauuuuaaauccuucguuaaggaucggagacugaacggccuuuuuagcuucguggacaccgggggacuggcgauggagcaauaucccaucucuaaacuccgcgucgaguacgaacuggccaaguaucagacggcucgggugugcguuuuugagcugacccuuagacuggaagagucccuccugagccgcuacccucaccucccggaugaaucuuucagagagaugcuggaguccuggagcgacccccuucuggccaaauggccugaacuccauggcaaggugcggcugcugauugcuguccgcaaugccuucucucacaaccaguaucccauguacgacgaggccguguuuagcuccaucagaaaguacgauccuagcucucccgacgcuaucgaggagcggauggggcuuaauauugcgcaucgccuguccgaggaaguuaaacaagccaaggagacaguggaaagaaucauucaggcuuga

SEQ ID NO: 11444 - RNA, 3528 nt, Artificial Sequence
  Cas13b variant__Porphyromonas gulae__WP_039431778.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaacuuugauaaugaccuugaaagaaagagccggcugcgcucccucauucugaaacauuucucuuuucuggagggggcugccuauggaaagaaacucuucgaaagcaaauccucuggcaacaagagcuccaaaaauaaggagcugacaaagaaggagaaggaggaacuucaggcuaacgcccugagccucgauaaucugaaaucuauccuuuuugacuuccugcagaagcucaaagauuuuagaaacuacuauucccacuaccggcauagcgaaucuuccgagcugccucuguucgacgggaauaugcuccaacgccuguacaacgucuuugauguuagcgugcagagagugaagcgggaccacgagcacaaugauaaagucgacccgcaucgccacuucaaccaucuugugagaaagggaaagaaggaccgguauggccacaaugauaaccccucuuuuaagcaccauuucguugacggggaaggaauggugaccgaggcgggccuucucuucuuugucucccuguuccuugaaaaacgcgaugccauuuggaugcagaagaaaaucagaggcuuuaaagggggaacagagaccuaccagcaaaugacgaacgaaguguucugccggagccgcaucucccugccuaaacucaagcuggagucucugagaaccgacgauuggaugcuccuggacaugcuuaaugagcugguucggugucccaagccucucuaugauagacugcgcgaagacgaucgggcuugcuuuagagugcccgucgacauucuuccugaugaggacgacacagauggcgggggagaagacccguucaaaaacacccuggugcgccaccaggaucgguuucccuacuucgcccucagauauuuugaccugaagaaaguguucacaagccugcgcuuucauaucgaucucggcaccuaccacuucgcuauuuauaagaaaaugaucggggagcagccugaagaccggcaucugacgagaaaucuuuacggauuuggccgcauucaggauuucgccgaggagcaccggcccgaagaguggaagagacugguccgcgaccucgauuacuucgaaacaggcgacaagccuuauaucucccaaaccagcccccacuaccauauugagaaagggaagaucggacugcgguuuaugccggaaggccagcaccuguggccuucucccgagguugggacaaccagaaccggacgguccaaauaugcgcaggauaagcgccuuacagccgaggcuuuccucagcgugcaugaacugaugccuaugauguuuuacuauuuccugcucagagagaaauacucugaagaggugagcgccgagaagguccaaggccggaucaagagagugauugaagacguuuaugcuaucuacgaugccuuugcccgcgacgagauuaacacgcugaaagaacuugacgcuugucuggcggauaaggggauccggagaggacaccuccccaaacagaugauugccauccugucccaggagcacaaggacauggaagagaaaauccgcaagaaacugcaggagaugauugcugauaccgaccauagacuugauaugcucgaccggcaaacagaucgcaagaucagaauuggccggaagaaugccggccugcccaaaucuggggugaucgccgacuggcugguccgcgauaugaugagauuccagccuguggcuaaggacaccagcggaaaaccgcucaacaauuccaaggccaacagcacagaauaccggaugcugcagcgcgcgcuugcucuguuuggcggggagaaaaagagacucacccccuauuuccggcagaugaaucugacgggaggcaacaauccucaccccuuucugcaugaaacacgcugggagucucacaccaacauucuuuccuucuacagaagcuaucuccgggccagaaaggccuuucuggaacgcaucgggcggucugauagaauggagaaucgcccuuuccugcuccugaaagagcccaagaccgaccggcaaacacuuguugcuggcuggaaauccgaauuucaucugccgagaggaaucuucaccgaggccgugcgcgauugccucauugaaaugggcuacgacgaggucgggagcuaucgggaagugggauucauggcuaaggccgucccucuguacuuugagagagcgugugaggaccgcgugcagcccuucuaugauuccccuuuuaacguuggcaauucucugaaacccaagaaggggcgguuccuuagcaaagaagagagagccgaagagugggagcggggaaaggaacgcuuuagagaccucgaggcuuggucccacucugccgcucggcgcaucgaagaugccuucgcgggcauugaguacgccagcccugggaacaaaaagaaaaucgaacagcugcugagagaccucucccugugggaggcuuuugagagcaagcugaaggugcgggccgauaaaauuaaccuggcuaagcucaaaaaggaaauccuggaggcccaggaacaccccuaccaugacuucaaaucuuggcaaaaguuugagagagaacugcgccuugucaaaaaucaggauauuaucacauggaugaugugccgggaccugauggaggagaacaagguggaaggccucgauacgggaacccuguaucucaaggacaucagaccgaauguucaggagcagggcucccugaacgugcuuaaucgcgucaaaccuaugcggcugcccguggugguuuacagagccgauagccgcgggcacguccauaaggaagaggcuccccucgcgacaguguauauugaggaacgggacaccaaacugcugaagcaaggaaacuucaaaucuuuugugaaggacagacgccuuaauggccuguucuccuucgucgauacagggggacucgccauggagcaguacccuaucagcaagcugagaguggaauaugagcucgcuaaauaccagaccgcccggguuuguguguuugaacugacgcuucgccuggaggagucucuccugaccagauauccgcaucugcccgacgagagcuuccggaagaugcuugaauccuggagcgauccucugcucgccaaauggcccgaacugcacggcaagguccgccuccugauugcugugagaaacgccuuuucucacaaucaauacccuauguacgacgaggcgguuuucuccagcauccggaaauaugaucccuccucuccugacgcuauugaagagagaauggggcuuaacaucgcccaccgccugagcgaggaagugaagcaggccaaggagacagucgaacggaucauucagguguga

SEQ ID NO: 11445 - RNA, 3528 nt, Artificial Sequence
  Cas13b variant__Porphyromonas gulae__WP_046201018.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaacuuugauaaugaccuugaaagaaagagccggcugcgcucccucauucugaaacauuucucuuuucuggagggggcugccuauggaaagaaacucuucgaaagcaaauccucuggcaacaagagcuccaaaaauaaggagcugacaaagaaggagaaggaggaacuucaggcuaacgcccugagccucgauaaucugaaaucuauccuuuuugacuuccugcagaagcucaaagauuuuagaaacuacuauucccacuaccggcauagcgaaucuuccgagcugccucuguucgacgggaauaugcuccaacgccuguacaacgucuuugauguuagcgugcagagagugaagcgggaccacgagcacaaugauaaagucgacccgcaucgccacuucaaccaucuugugagaaagggaaagaaggaccgguauggccacaaugauaaccccucuuuuaagcaccauuucguugacuccgaagggauggugaccgaggcgggacuccuguucuuugucagccuguuccuugaaaaacgcgaugccauuuggaugcagaagaaaaucagaggcuuuaagggcgggacagagaccuaccagcaaaugacgaacgaaguguucugccggucccgcaucucucugccuaaacucaagcuggagagccugagaaccgacgauuggaugcuccuggacaugcuuaaugagcugguucggugucccaagccucucuaugauagacugcgcgaaaaagaccgggcuagauuucgcgugcccgucgauauucuuccugacgaggaugacacagacggaggcggggaagauccguucaagaacacccuggugcggcaccaggacagauuucccuacuucgcccuccgcuauuuugaucugaaaaagguguucacaucccugcgguuucauaucgaccucggaaccuaccacuucgcuauuuauaaaaagaugaucggcgagcagccugaagauagacaucugacgcgcaaucuuuacggguuuggacggauucaggacuucgccgaggagcacagacccgaagaguggaagcgccugguccgggaucucgacuacuucgaaacaggcgauaaaccuuauaucagccaaaccacaccccacuaccauauugagaagggcaaaaucgggcugagauuuaugccggaaggacagcaccuguggccuucucccgagguuggcaccacccggacagggcgcuccaaguaugcgcaggacaaaagacuuacggccgaggcuuuccucagcgugcaugaacugaugccuaugauguuuuacuauuuccugcuccgggagaaguacucugaagaggugagcgccgagaagguccaaggaagaaucaaacgcgugauugaagauguuuaugcuaucuacgacgccuuugcccgggaugagauuaacacccugaaggaacuugacgcuugccuggcggacaaaggcaucagacgcgggcaccuccccaagcagaugauugccauccugucccaggagcacaaagauauggaagagaagauccggaaaaagcugcaggagaugauugcugacacagaucauagacuugacaugcucgaucgccaaaccgacagaaagauccggauuggacgcaaaaaugccggccugcccaagucuggcgugaucgccgauuggcuggucagagacaugaugcgguuccagccuguggcuaaagauacaagcgggaagccgcucaacaauuccaaagccaacagcaccgaauaccgcaugcugcagagagcgcuugcucuguuuggaggcgagaagaagcggcucacgcccuauuuccgccagaugaaucugacagggggaaacaauccucaccccuuucugcaugaaaccagaugggagucucacaccaacauucuuuccuucuaccggagcuaucucagagcccgcaaagccuuucuggaacggaucggcagaucugaccgcauggagaaucggccuuuccugcuccugaaggagcccaaaacagauagacaaacccuuguugcuggguggaaguccgaauuucaucugccgcgcggcaucuucacagaggccgugcgggacugucucauugaaaugggauacgaugaggucggcagcuauagagaagugggguucauggcuaaagccgucccucuguacuuugagcgcgcgugcgaggaccgggugcagcccuucuaugacuccccuuuuaacguuggaaauucucugaagcccaagaaaggcagauuccuuagcaaggaggaacgggccgaagagugggagcgcgggaaagaaagauuucgggaucucgaggcuuggucccacucugccgcucgcagaaucgaagacgccuucgcgggaauugaguacgccagcccuggcaacaagaaaaagaucgaacagcugcugcgggaucucucccugugggaggcuuuugagagcaaacuuaaagugagagccgacaagauuaaccuggcuaaacucaagaaagaaauccuggaggcccaggaacaccccuaccaugauuucaagucuuggcaaaaauuugagcgcgaacugcggcuugucaagaaucaggacauuaucacguggaugauguguagagaucugauggaggagaacaagguggaagggcucgacaccggcacacuguaucucaaagauauccgcccgaauguucaggagcagggaucccugaacgugcuuaaucgggucaagccuaugagacugcccguggugguuuaccgcgccgacagccggggccacguccauaaagaagaggcuccccucgcgaccguguauauugaagagagagauacaaagcugcugaaacaagggaacuucaagucuuuugugaaggaccgcagacuuaauggacuguucuccuucgucgacaccggcgggcucgccauggagcaguacccuaucagcaaacugcggguggaauaugagcucgcuaaguaccagacggcccgcguuugcguguuugaacugacccuuagacuggaggagucucuccugacacgguauccgcaucugcccgaugagagcuuccgcaaaaugcuugaauccuggagcgacccucugcucgccaaguggcccgaacugcacggaaaagucagacuccugauugcugugcggaacgccuuuucucacaaucaauacccuauguacgaugaggcgguuuucuccagcaucagaaaguaugaccccuccucuccugaugcuauugaggaacgcaugggccuuaacaucgcccaccggcugagcgaggaagugaagcaggccaaagagaccgucgaaagaaucauucagguguga

SEQ ID NO: 11446 - RNA, 3525 nt, Artificial Sequence
  Cas13b variant__Porphyromonas gulae__WP_039442171.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaaccuugauaaugaccuggaaagaaagagccggcuccgcucccugauucugaaacauuuuucuuuccucgagggggcugccuauggaaagaagcuguuugaaagcaaauccucuggcaacaagagcuccaaaaauaaggagcuuacaaagaaggagaaggaagaacugcaggcuaacgcccucagccuggauaaucuuaaaucuauccuguucgacuuucuccagaagcugaaagauuucagaaacuacuauucccacuaccggcauagcgggucuuccgaacugccucucuuugacggaaauaugcugcaacgccuuuacaacgucuucgauguuagcgugcagagagugaagcgggaccacgagcacaaugauaaagucgacccgcauuaucacuuuaaccaucuggugcgcaagggcaaaaaggacagauacgggcacaaugauaaccccucuuucaagcaccauuuuguugacuccgagggaauggugaccgaagcgggccuccuguucuucgucagccuuuuucuggagaaacgggaugccauuuggaugcagaagaaaauccgcggcuucaaagggggaacaggcccuuaugaacagaugaccaacgagguguuuugcagaucccggaucucucuccccaaacugaagcuggaaagccuccgcacggacgauuggaugcugcuugacaugcugaaugagcucguuagauguccuaagccccuguacgaucggcuuagagagaaagaccgcgcuugcuuccgggugccugucgauauucugccggacgaagaugacaccgacgggggaggcgaggaucccuuuaagaacacacucgugagacaccaagaccgcuucccuuauuuugcccugcgguacuucgaucugaaaaagguguuuaccucccucagauuccauaucgaccuggggacauaucacuuugcuauuuacaaaaagaugaucggagaacagcccgaggaucgccaucuuacccggaaucuguacggcuucggccgcauucaggacuuugccgaggagcacagaccugaggaauggaagcggcucgucagagaucuggacuaucuggagacgggggauaaacccuacaucagccagacaaccccgcacuaucauauugaaaagggaaaaaucggccuucgcuucguuccugaggggcaacaccucuggcccucuccugaagugggaacaacccggaccggcagauccaagugugcgcaggacaaacggcugacagccgaggcuuuccugagcgugcaugagcucaugcccaugauguuuuacuauuuccugcuucgcgaaaaguacucugaggaagucagcgccgagaaggugcaggggagaaucaaacggguuauugaggauguguaugcuaucuacgacgccuuugccagagaugaaauuaacacgcugaaggagcucgauaccugccuggcugacaaaggaauccgccggggccaucugcccaagcaaaugauuacaauccuuucccaggaaagaaaagacaugaaggagaaaauccgcaagaagcuccaggaaaugauugcggacaccgaucacagacuggacaugcuggaucggcagacagaccgcaaaaucagaauuggccggaagaaugccgggcucccuaaaucuggagucaucgcugauuggcuggugcgcgacaugaugagauuccaaccgguugccaaggaugccagcggcaaaccccuuaacaauuccaaggcuaacagcaccgaguaccggaugcugcagcgcgcccucgcgcuguuugggggagagaaggaaagacugacgccuuauuuccggcagaugaaucuuacaggcgggaacaauccccacccuuuucuccacgagacccgcugggaaucucauaccaacauucuguccuucuacagaagcuaucugcgggcuagaaaagccuuucucgagcgcaucggccggucugacagaguggaaaauugucccuuccugcuucugaaggagccgaaaacagaucgccagacccucgucgccggauggaaggacgaguuucaucugccucggggcaucuucacagaagcugugagagauugccugauugagaugggguacgacgaagucggauccuaucgcgaggugggcuuuauggccaaagcuguuccccuuuacuucgaacgggccugugaggacagagugcaaccuuucuaugauagccccuuuaacgucggaaauucccucaagccuaagaaagggcgcuuccugucuaaggaggaccgggcggaagagugggaaagaggcauggagcgguuucgcgaucuggaggccuggagccacuccgcugccagacggaucaaagacgcuuucgccgggauugaauacgcgucucccggcaacaagaaaaagaucgagcagcuccugcgcgaucuuagccugugggaagccuuugaguccaagcucaaagugagagcugacaagauuaaccuggccaaacugaagaaagaaauccuugaggcucaggagcacccguaccacgauuucaagagcuggcagaaauuugaacgggagcugagacucguuaagaaucaagacauuaucacguggaugaugugccgcgaucugauggaagagaacaagguggaaggacucgacaccggcacacuguaucuuaaagauauccggccuaauguccaggagcaggggucucugaacgugcucaauagagugaagcccaugcgccugcccguugucguguaccgggccgacuccagaggacaugugcacaaagaggccccucuggcuaccgucuauauugaggaacgcaacacaaaacuucugaagcagggcaauuucaagagcuuugugaaggaccggagacucaacgggcuguucucuuuuguugauaccggaggccucgcgauggaacaauacccgaucuccaaacugcgcguggaguaugaacuugccaaguaccagacggcuagagucuguguguucgagcugacccuccggcuggaggaaagccugcuuucucgcuauccccaucugccugacgagagcuucagagaaaugcucgaguccuggagcgauccccugcucgccaaauggccugagcugcacgggaagguucggcuucugauugccgugcgcaaugcuuuuucucauaaccaguaccccauguacgacgaagccgucuucuccagcaucagaaaauaugauccuuccucucccgacgcgauugaggaacggaugggccugaauaucgcucacagacucagcgaggaagugaagcaagccaaggagacaguugagcgcaucauucaggccuga

SEQ ID NO: 11447 - RNA, 3360 nt, Artificial Sequence
  Cas13b variant__Porphyromonas gulae__WP_039426176.1__Cas13b
augaccgagcaaagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaacuuugauaaugaccuugaaagaaagagccggcugcgcucccucauucugaaacauuucucuuuucuggagggggcugccuauggaaagaagcuguucgaaagcaaauccucuggcaacaagagcuccaaaaauaaggagcugacgaaaaaggagaaggaggaacuucaggcuaacgcccugagccucgauaaucugaaaucuauccuuuuugacuuccugcagaagcucaaagauuuuagaaacuacuauucccacuaccggcauagcgggucuuccgaacugccucuguucgacggaaauaugcuccaacgccuguacaacgucuuugauguuagcgugcagagagugaagcgggaccacgagcacaaugauaaagucgacccgcauuaucacuucaaccaucuugugcgcaagggcaaaaaggacagauacgggcacaaugauaaccccucuuuuaagcaccauuucguugacuccgagggaauggugaccgaagcgggccuccucuucuuugucagccuguuccuugagaaacgggaugccauuuggaugcagaagaaaauccgcggcuuuaaagggggaacaggcccuuaugaacagaugaccaacgagguguucugcagaucccggaucucucugcccaagcucaagcuggaaagccugcgcacggacgauuggaugcuccuggacaugcuuaaugagcugguuagauguccuaagccccucuacgaucggcugagagagaaagaccgcgcuugcuuucgggugccugucgauauucuuccggacgaagaugacaccgacgggggaggcgaggaucccuucaagaacacacuggugagacaccaagaccgcuuuccuuauuucgcccuccgguacuuugaucugaaaaagguguucaccucccugagauuucauaucgaccucgggacauaucacuucgcuauuuacaaaaagaugaucggagaacagcccgaggaucgccaucugacccggaaucuuuacggcuuuggccgcauucaggacuucgccgaggaacacagaccugaggaauggaagcggcuggucagagaucucgacuauuucgagacgggggauaaacccuacaucagccagacaaccccgcacuaucauauugaaaagggaaaaaucggccugcgcuuuaugccugaggggcaacaccuguggcccucuccugaaguuggaacaacccggaccggcagauccaaguacgcgcaggacaaacggcuuacagccgaggcuuuccucagcgugcaugagcugaugcccaugauguuuuauuacuuccugcuccgcgaaaaguauucugaggaagugagcgccgagaagguccaggggagaaucaaacgggugauuaaggauguuuacgcuaucuacgacgccuuugccagagaugagauuaacacgcugaaagaacuugacgcuuguuccgcggacaagggaauccgccggggccaucugcccaaacaaaugauuggcauccucucucaggagcacaagaauauggaagagaaagugagaaagaagcugcaggaaaugaucgccgauaccgaccaccgccuggauaugcuugacagacagacagaucggaaaauucgcaucgggagaaagaacgcuggacucccuaaaagcggcgucauugccgacuggcuggugcgggauaugaugcgcuuccaaccgguugccaaggacaccuccgggaaaccccugaauaacagcaaggcuaauucuacagaguauagaaugcuccagcgggcccuggcgcuuuuuggaggcgagaaggaacgccugaccccuuacuucagacagaugaaccucacagggggcaauaacccccacccuuuucuggaugagacacggugggaaucccauaccaauauccugagcuucuaucgcucuuaccuuagagcucggaaagccuuucucgagagaauuggacgcuccgaccggguggaaaacagacccuuccugcugcucaaggagccgaaaaaugaucgccagacccuggucgccggcuggaaaagcgaguuucaccuuccucgggggaucuucacagaagcugugagagacugccugaucgagaugggauaugaugaagucggcuccuacaaggaggugggguucauggccaaggcuguuccccucuauuuugaacgcgccuguaaggaccgggugcaaccuuucuacgacucucccuuuaacgucggaaacagccugaaaccuaagaaaggcagauuccuguccaaggagaaacgcgcggaggaaugggagucugggaaggaacgguuuagacuugccaagcucaaaaaggagauucuggaggcuaaagaacaucccuaccacgauuucaagagcuggcagaaauuugagcgggaacugcgccucgugaagaaucaggacaucauuaccuggaugaugugcagagaucugauggaggaaaacaaaguugagggccuugacacaggaacgcuguaucucaaggauauccggaccgacgugcacgagcagggcucccugaauguccugaaccgcgugaagccgaugagacuuccugugguugucuaccgggccgauagcagagggcaugugcacaaagaacaagcuccccuggccacaguguauauugaggaacgcgacaccaagcuccugaaacagggaaauuucaagucuuuugucaaagaucggagacucaacggccuguucuccuuuguggacacagggggacuugcgauggagcaguaccccaucagcaagcugcgcguugaauaugagcucgccaaguaccagaccgcucgggugugugccuucgagcaaacgcuggaacuggaggaaucucuucugaccagauauccucaucucccggaugagaauuuccgcgaaaugcuggaguccuggagcgacccccuccugggcaaauggccugaccuucacgggaagguccggcugcucauugcugugagaaacgccuuuucucauaaucaguaccccauguacgaugaggccguuuucagcuccauccgcaaauaugacccuagcucucccgaugcuaucgaagagagaaugggccugaacauugcgcaccggcuguccgaagaggugaagcaggccaaagagacagucgaacgcaucauucaggcuuga

SEQ ID NO: 11448 - RNA, 3528 nt, Artificial Sequence
  Cas13b variant__Porphyromonas gulae__WP_039418912.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaaccuugauaaugaccuggaaagaaagagccggcuccgcucccugauucugaaacauuuuucuuuccucgagggggcugccuauggaaagaagcuguuugaaagcaaauccucuggcaacaagagcuccaaaaauaaggagcuuacaaagaaggagaaggaagaacugcaggcuaacgcccucagccuggauaaucuuaaaucuauccuguucgacuuucuccagaagcugaaagauuucagaaacuacuauucccacuaccggcauagcgggucuuccgaacugccucucuuugacggaaauaugcugcaacgccuuuacaacgucuucgauguuagcgugcagagagugaagcgggaccacgagcacaaugauaaagucgacccgcaucgccacuuuaaccaucuggugagaaagggcaaaaaggaccgguaugggcacaaugauaaccccucuuucaagcaccauuuuguugacuccgagggaauggugaccgaagcgggccuccuguucuucgucagccuuuuucuggagaaacgcgaugccauuuggaugcagaagaaaaucagaggcuucaaagggggaacagaaaccuaccagcaaaugacgaacgagguguuuugccggucccgcaucucucucccuaaacugaagcuggaaagccucagaauggacgauuggaugcugcuugacaugcugaaugagcucguucggugucccaagccucuguaugauagacuucgcgaggacgaucgggcuugcuucagagugcccgucgacauucugccugaugaagacgacaccgauggcgggggagaggacccguuuaaaaacacacucgugcgccaccaggaucgguuccccuacuuugcccugagauauuucgaccugaagaaaguguuuaccucccuccgcuuccauaucgaucugggcacauaccacuuugcuauuuauaagaaaaugaucggggaacagccugaggaccggcaucuuaccagaaaucuguacggauucggccgcauucaggauuuugccgaggagcaccggcccgaggaauggaagagacucguccgcgaccuggauuacuucgagacgggcgacaagccuuauaucagccaaacaucuccccacuaccauauugaaaaagggaagaucggacugcgguucaugccggagggccagcaccuuuggccuucccccgaaguugggaccacaagaaccggacggagcaaauaugcgcaggauaagcgccucaccgccgaggcuuuucugucugugcaugagcugaugccuaugauguucuacuauuuucuccugagagaaaaauacagcgaggaaguguccgccgagaagguccaaggccggaucaagagagugauugaggacguuuaugcuaucuacgaugccuucgcccgcgacgaaauuaacacacuuaaagagcuggacgcuugucucgcggauaaggggauccggagaggacaucugcccaaacagaugauugccauccugucucaggaacacaagaauauggaggaaaaagugcgcaagaaacuucaggagaugaucgcugacacggaucacagacucgacaugcuggaucggcaaaccgaccgcaagauuagaaucggccggaagaacgccggccugcccaaaagcggggucauugccgauuggcucgugcgcgacaugaugagauuucagccuguugcuaaggaugccuccggaaaaccgcugaauaacagcaaggcuaauucuacagaguaccggaugcuucagcgcgcgcuggcccucuucggcggggaaaaagagagacugacccccuauuuucggcagaugaaccugacaggaggcaauaacccucaccccuuccuucaugacacccgcugggaaucccacacgaauauccucagcuuuuacagaucuuaucugcgggccagaaaggcuuuccuggagcgcauugggcgguccgauagaauggaaaaccgcccuuuucuccugcuuaaggagcccaaaacagaccggcaaacccugguggccggcuggaaguccgaguuccaucucccgagaggaaucuuuaccgaagcuguccgcgauugccugaucgagaugggcuacgacgaagugggguccuaucgggaggucggauucauggccaaagcggugccucuguacuucgaaagagccugugaggaccgcguucagcccuuuuaugauucuccuuucaaugugggcaacagccuuaagcccaaaaaggggcgguuucucuccaaggaggaaagagcugaggaaugggagcggggaaaagagcgcuucagagaccuggaagccuggucucacagcgcugcccggcgcauugaggaugcguuugccggcaucgaauacgcuuccccugggaacaagaaaaagauugagcagcugcucagagaccugagccuuugggaagccuucgagucuaaacugaagguccgggcugauaagaucaaucucgccaaacugaagaaagagauucuggaagcccaggagcaccccuaccaugacuuuaaguccuggcaaaaauucgaaagagagcuucgccuggugaagaaccaggauaucauuacauggaugaugugccgggaccucauggaagagaauaaaguugagggccuggauaccggaacacucuaucugaaggacaucagaacgaacgugcaggaacagggcagccuuaauguccugaaccacgugaagccgaugcgccucccugugguugucuaccgggcugauucuagagggcaugugcacaaagaggaagcgccccuggccaccguguauaucgaggaacgcgacacaaagcugcuuaaacaaggaaauuuuaaguccuucgucaaagaccggagacugaacggccucuuuagcuucguggauaccgggggacuggcuauggagcaguaccccauuucuaagcuccgcguugaguaugaacuggccaaguaccagacagccagagugugugcuuucgagcaaacccuugaacuggaggagagccuccugacgcgguauccucaucugccggacaaaaauuuucgcaagaugcuugaauccuggagcgauccccugcucgccaaauggccugagcugcacggcaaggucagacuccugaucgcggugcggaacgcuuucucucacaaucaguaccccauguacgacgaagccguuuuuagcagcauucgcaaauaugauccuuccucucccgacgccaucgaggaaagaauggggcuuaacauugcucaucggcugagcgaggaggugaagcaggccaaggaaaccgucgagagaaucauccaggcguga

SEQ ID NO: 11449 - RNA, 3528 nt, Artificial Sequence
  Cas13b variant__Porphyromonas gulae__WP_039434803.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaacuuugauaaugaccuugaaagaaagagccggcugcgcucccucauucugaaacauuucucuuuucuggagggggcugccuauggaaagaaacucuucgaaagcaaauccucuggcaacaagagcuccaaaaauaaggagcugacaaagaaggagaaggaggaacuucaggcuaacgcccugagccucgauaaucugaaaucuauccuuuuugacuuccugcagaagcucaaagauuuuagaaacuacuauucccacuaccggcauagcgggucuuccgaacugccucuguucgacggaaauaugcuccaacgccuguacaacgucuuugauguuagcgugcagagagugaagauugaccacgagcacaaugaugaggucgacccgcauuaucacuucaaccaucuugugcggaaaggcaagaaagaccgcuacgggcacaaugauaaccccucuuuuaagcaccauuucguugacggagaaggcauggugaccgaggcgggccuccuguucuuugucucccuguuccuugaaaagagagaugccaucuggaugcagaaaaagauccggggguuuaaaggaggcacagagaccuaucagcaaaugacgaacgaaguguucugccgcagcagaauuucccugccuaagcucaaacuggagucucugcggauggacgauuggaugcuccuggacaugcuuaaugagcugguucgcugucccaagccucucuacgauagacugcgggaagacgauagagcuugcuuucgcgugcccgucgacauccuuccugaugaggacgacaccgaugggggaggcgaagacccguucaagaacacacuggugcggcaccaggauagauuucccuauuucgcccuccgcuacuuugaccugaaaaagguguucaccagccugcgguuucauauugaucucgggacauaucacuucgcuaucuacaaaaagaugauuggagagcagccugaagacagacaucugacccgcaaucuuuacggcuuuggccggauccaggauuucgccgaggagcacagacccgaagaguggaaacgccugguccgggaccucgauuauuucgaaacgggggacaagccuuacauuucccaaacaagcccccacuaucauaucgagaagggaaaaaucggccugagauuuaugccggaagggcagcaccuguggccuucucccgagguuggaaccacacgcaccggccgguccaaguacgcgcaggauaaaagacuuaccgccgaggcuuuccucagcgugcaugaacugaugccuaugauguuuuauuacuuccugcuccgggagaaguauucugaagaggugagcgccgagcgcguccaagggagaauuaaacgggugaucgaagacguuuacgcuguguacgaugccuuugccagagacgagauuaacacacgcgacgaacuggaugcuugucuugcggacaagggaauccggagaggccaucugccccgccagaugauugccauccucucccaggagcacaaggauauggaagagaaaaucagaaagaaacugcaggagaugauggcugacacggaucaccggcuggacaugcuugaucgccaaaccgacagaaagauucggaucggccgcaaaaaugccgggcuccccaagucuggagucauugccgauuggcuggugagagacaugaugcgguuccagccuguugcuaaagaugccagcggcaagccgcugaacaauuccaaggcgaacagcacagaauaucgcaugcuccagagagcucuggcccuuuuugggggagagaaagaacggcugacccccuacuuccgccagaugaaucucacaggcgggaacaauccucaccccuuucugcaugagaccagaugggaaucucacacgaacauccuguccuucuaucggagcuaccuuagagcccgcaaggcuuuucucgagcggauuggcagaucugaccgcguggagaaucggccuuuccugcugcucaaagaacccaagacagauagacaaacccuggucgccggauggaaaggcgaguuucaucuuccgcgcgggaucuucaccgaagcugugcgggacugccugaucgagaugggacacgacgaagucgccuccuauaaggaggugggcuucauggcgaaggccguuccucucuacuuugagagagcuugugaagaucgcgugcagcccuucuaugacagcccuuuuaacgucggaaauucccugaaacccaagaaagggcgguuccugucuaaggaggaaagagccgaggagugggaacggggcaaagagcgcuuuagagaucuugaagccuggagcuacuccgccgcgcggcgcauugaggacgccuucgcugggaucgaauacgccucuccuggcaacaagaagaaaauugagcagcuccugagagaucugagccucugggaggcuuuugaauccaagcugaaagugcgggccgacagaaucaaccuugccaagcugaaaaaggagauucucgaagcucaggagcaccccuaucaugauuucaagagcuggcaaaaauuugaacgcgagcugcggcugguuaagaaucaggacaucauuacauggaugaugugcagagaucuuauggaggaaaacaaaguggagggacuggacaccggcacacucuaccugaaggauauccgcccgaauguccaggaacaggggucucucaacgugcugaaucgggugaaaccuaugagacuucccguugucguguaucgcgcggacucccggggacacgugcauaaggaggaagcuccccuggcuacggucuacaucgaggagagagacaccaaacuccugaagcaaggcaacuucaagagcuuugugaaagaucgcagacugaaugggcuuuucucuuucguugacacaggaggccuggccauggaacaguauccuauuuccaagcuccggguggaguacgaacuggccaaauaucagaccgcucgcgucuguguguuugagcucacacugagacuugaggaaagccugcucacccgguacccgcaucugcccgaugagucuuuccgcgaaaugcuggagagcugguccgacccucuucuggccaaguggcccgaacuccacgggaaaguuagacugcucaucgcggugcggaacgcuuuuagccacaaucaauacccuauguaugaugaggccgucuucucuuccauuagaaaguacgaccccagcuccccugaugccaucgaggaacgcaugggccugaacauugcucaccggcuuucugaggaagugaagcaggccaaagagacgguugaaagaaucauccaggcguga

SEQ ID NO: 11450 - RNA, 3528 nt, Artificial Sequence
  Cas13b variant__Porphyromonas sp.__WP_039428968.1__Cas13b
augaccgagcagagcgaaagacccuacaacggcacauauuacacgcuggaggacaagcacuucugggccgcuuuucucaaucuggcccggcauaacgcguauaucacccuuacacacauugaucgccaacuggcuuacuccaaagccgacaucaccaaugaucaggacgugcucucuuucaaggcccuguggaaaaacuuugauaaugaccuugaaagaaagagccggcugcgcucccucauucugaaacauuucucuuuucuggagggggcugccuauggaaagaaacucuucgaaagcaaauccucuggcaacaagagcuccaaaaauaaggagcugacaaagaaggagaaggaggaacuucaggcuaacgcccugagccucgauaaucugaaaucuauccuuuuugacuuccugcagaagcucaaagauuuuagaaacuacuauucccacuaccggcauagcgaaucuuccgagcugccucuguucgacgggaauaugcuccaacgccuguacaacgucuuugauguuagcgugcagagagugaagcgggaccacgagcacaaugauaaagucgacccgcaucgccacuucaaccaucuugugagaaaggggaaaaaggaccgguauggccacaaugauaaccccucuuuuaagcaccauuucguugacuccgaagggauggugaccgaggcgggacuccuguucuuugucagccuguuccuugaaaaacgcgaugccauuuggaugcagaagaaaaucagaggcuuuaagggcgggacagagaccuaccagcaaaugacgaacgaaguguucugccggucccgcaucucucugccuaaacucaagcuggagagccugagaaccgacgauuggaugcuccuggacaugcuuaaugagcugguucggugucccaagccucucuaugauagacugcgcgaagacgaucgggcuugcuuuagagugcccgucgacauucuuccugaugaggacgacacagauggaggcggggaagacccguucaaaaacacccuggugcgccaccaggaucgguuucccuacuucgcccucagauauuuugaccugaagaaaguguucacaucccugcgcuuucauaucgaucucggaaccuaccacuucgcuauuuauaagaaaaugaucggcgagcagccugaagaccggcaucugacgagaaaucuuuacggguuuggacgcauucaggauuucgccgaggagcaccggcccgaagaguggaagagacugguccgcgaccucgauuacuucgaaacaggcgacaagccuuauaucagccaaaccacaccccacuaccauauugagaaaggcaagaucgggcugcgguuuguuccggaaggacagcaccuguggccuucucccgaggugggcaccaccagaacagggcgguccaaauaugcgcaggauaagcgccuuacggccgaggcuuuccucagcgugcaugaacugaugccuaugauguuuuacuauuuccugcucagagagaaauacucugaagaggucagcgccgagaaggugcaaggacggaucaagagaguuauugaagacguguaugcuaucuacgaugccuuugcccgcgacgagauuaacacccugaaagaacuugacgcuugucuggcggauaagggcauccggagagggcaccuccccaaacagaugauuggaauccugucccaggagcgcaaggacauggaagagaaagucagaaagaaacugcaggagaugaucgccgauacagaccaccggcuugauaugcucgaccgccaaaccgauagaaagauucggaucggccgcaagaaugcuggccugcccaaaucuggggugauugccgacuggcugguuagagauaugaugcgguuccagccuguggccaaggacacaagcggaaaaccgcucaacaauuccaaggcuaacagcaccgaauaccgcaugcugcagagagcccuugcgcuguuuggcggggagaaagaacggcucacgcccuauuuccgccagaugaaucugacaggaggcaacaauccucaucccuuucugcacgagaccagaugggaaucucauaccaacauccuuuccuucuaccggagcuaucucagagcucgcaaggccuuucuggagcggauugggagaucugaucgcgucgagaauugcccuuuccugcuccugaaggaacccaaaacagaccggcaaacccuuguggccggcuggaagggagaguuucaucugccgagaggcaucuucacagaagcuguccgcgauugucucaucgagaugggguacgacgaagugggauccuaucgggagguuggcuucauggccaaagcugugccucuguacuuugagagagccugcgaagaccgcguccagcccuucuaugauagcccuuuuaacgugggaaauucccugaagcccaaaaagggacgguuccuuucuaaggaggacagagcggaagagugggagcggggcaaagaacgcuuuagagaucucgaggccuggagccacuccgcugcccggcgcauuaaggacgcuuucgccgggaucgaauacgcgucuccuggcaacaaaaagaaaauugagcagcugcugagagaucucagccugugggaagccuuugaguccaaacuuaagguucgggcugacaaaaucaaccuggccaagcucaaaaaggagauucuggaagcucaggagcaccccuaccacgauuucaaaagcuggcaaaaguuugaaagagagcugcgccuugugaaaaaucaggacaucauuacguggaugaugugucgggaucugauggaagagaacaaggucgagggacucgacaccggcacacuguaucucaaggauaucagaccgaaugugcaggaacaggggucucugaacgugcuuaaucgcguuaaaccuaugcggcugcccgucgugguguacagagccgacucccgcggacauguccacaaggaggaagcuccccucgccaccguguauaucgaggaacgggacacaaaacugcugaagcaaggcaacuucaagagcuuuguuaaggauagacgccuuaaugggcuguucucuuucguggacaccggaggccucgcgauggagcaguacccuauuuccaagcugagagucgaguaugaacucgccaaauaccagacggcucgggugugcguuuuugagcugacccuucgccuggaagagagccuccugucuagauauccgcaucugcccgaugagagcuuccgggaaaugcuugaguccuggagcgacccucugcucgccaaguggcccgaacugcacgggaaagugcgccuccugaucgccgucagaaacgcuuuuucucauaaucaauacccuauguacgaugaggccguguucuccagcauucggaaguaugaccccuccucuccugaugcgaucgaagagagaaugggccuuaacauugcucaccgccugagcgaggaaguuaaacaggccaaggagacaguggaacggaucauccaggccuga

SEQ ID NO: 11451 - RNA, 3375 nt, Artificial Sequence
  Cas13b variant__Prevotella aurantiaca__WP_025000926.1__Cas13b
auggaggacgauaagaaaaccacaggcagcaucuccuacgaacugaaggacaaacacuucugggccgcuuuucucaaccuggccagacauaauguguauauuacgaucaaccacauuaauaaacuucuggagauccgggaaauugauaacgacgagaaaguccucgauaucaagacccuguggcagaaggggaauaaagaccuuaaccaaaaggcgcgccugagagaacucaugacaaaacauuuccccuuucuggagaccgcuaucuacacaaagaauaaagaggauaagaaggaaguuaaacaggagaagcaggccgaagcccagucucuggagagccucaaagacugccuguuccuuuuucuggauaagcuccaagaggcucggaacuauuacucccacuauaaauacucugaguucagcaaggagccugaauuugaggaaggacugcuugagaaaauguauaauauuuucggcaacaauauccagcuggugauuaacgacuaccagcauaauaaggauaucaacccggacgaggauuuuaagcaccucgaccgcaaagggcaguucaaguacuccuuugccgacaaugaaggaaacauuaccgagucuggccugcuguucuuugugagccucuuccuggaaaagaaggaugcuaucuggaugcaacagaaacuuaacggguucaaggacaaucuggagaacaagaaaaagaugacacacgaagucuuuuguagaucccggauucucaugcccaaacugcgccuugagagcacccagacgcaggauuggauccugcucgacaugcugaaugagcugaucagaugcccuaagucucucuaugaacggcugcaaggagaugaccgcgagaaauucaaggugcccuuugauccugccgacgaagauuacaacgcggagcaggaacccuucaagaauacccuuauuagacaucaggaccgguuuccuuauuucguucugcgcuacuuugauuauaacgagaucuucaaaaaucucagauuucaaauugaccugggcacauaccacuucuccaucuauaagaaacuuauuggcgggcagaaggaggaccggcaucugacccacaaacucuacggauuugaacgcauccaggaguucgccaagcagaacagaccggaugaauggaaggcuaucgugaaagaccuggauacauacgagaccagcaauaagcgguauauuucugagacgacaccccacuaccaucuggaaaaccagaaaaucggcauuagauuucgcaaugggaacaaggagaucuggccuucccucaaaaccaaugacgaaaacaaugaaaagagcaaauauaagcuggauaagcaauaccaggccgaggcuuuccuuucuguccacgaacugcuccccaugauguucuauuaccugcugcuuaaaaaggagaaaccuaacaacgacgaaauuaaugccuccaucguggagggauuuaucaagcgggaaauuagaaacaucuucaaacucuaugaugcguuugccaauggcgagauuaacaauaucgacgaucuggaaaaguacugugcugacaaggggauucccaaacgccaucugccgaagcagaugguugccauccucuacgaugagcacaaagacauggugaaggaggcuaaacggaagcaaaaggaaauggucaaagauacaaagaaacugcuugccacccuggagaagcagacccagaaagaaaaggaggacgacggaagaaacgugaagcuccugaaaagcggcgaaauugcccgcuggcuggugaaugauaugaugcgguuccagccuguccaaaaggacaacgagggcaaaccccuuaauaacuccaaggcuaauucuacagaguaucagaugcuccagagaagccuggcgcuguacaacaaugaagagaaaccuacgcgcuauuuucggcagguuaaccucaucgaauccaauaacccccaucccuuccugaaguggaccaaaugggaggagugcaacaauauccuuacauuuuacuauagcuaccugaccaagaagauugaguuccucaacaaacugaagccugaagauuggaaaaagaaucaauauuuucugaaacuuaaggaaccgaagacaaacagagagacccucgugcagggguggaaaaauggauucaaccugccccgcggcaucuuuacggaaccuauucgggagugguucaagagacaccagaauaacucuaaagaguacgaaaagguggaggcccuggaccgggucgggcucgugacaaaaguuaucccccuguuuuucaaggaagaguacuucaaggauaaagaagagaauuuuaaggaggacacccaaaaagaaauuaacgauugugugcagccuuucuauaauuuucccuacaacgucggaaauauccacaagccgaaagagaaggacuuccuucaucgcgaagagagaaucgaacugugggauaagaaaaaggacaaauuuaagggcuauaaagagaagauuaaguccaaaaagcucaccgagaaagauaaggaagaguuccggagcuaccuggaauuucagucuuggaacaaauucgagagagagcugcgccuugugcggaaucaggacaucguuacauggcuccugugcaaggaacugauugauaaacucaagaucgacgagcugaacauugaggaacuuaagaaacugagacucaacaauaucgacaccgauacagcuaagaaagaaaagaacaauauccugaaccgcgugaugccuauggagcugcccgucacgguguaugagauugacgauagccacaaaaucgucaaggacaagccucuucauaccauuuacaucaaagaagccgagacaaagcugcucaaacaagggaauuuuaaggcccuggugaaagauagacggcucaacggacuguucuccuuuguuaagaccaauucugaagcugagagcaagcgcaaccccauuuccaaacuuagaguggaauaugagcugggcgaguaccaggaagcccggaucgagaucauucaggacaugcucgcgcuggaagagaagcugaucaauaaauacaaggaucuuccuacaaacaaauucagcgaaaugcucaauucuuggcuggagggcaaggacgaggcugauaaggcccgcuuccagaacgacgucgauuuucugauugccgugagaaaugcuuucucccacaaccaauaucccaugcacaauaaaaucgaauuugccaacauuaagccguucagccucuacaccgcuaauaacucugaggaaaaagggcugggaaucgccaaccagcuuaaggacaaaacgaaggagaccacagacaaaauuaagaagaucgagaaaccuaucgaaaccaaggaguga

SEQ ID NO: 11452 - RNA, 3384 nt, Artificial Sequence; identical to SEQ ID NO: 11402
  Cas13b variant__Prevotella buccae__EFU31981.1__Cas13b

SEQ ID NO: 11453 - RNA, 3384 nt, Artificial Sequence
  Cas13b variant__Prevotella buccae__WP_004343581.1__Cas13b
augcagaagcaagacaaacuguucguggauagaaagaaaaacgccaucuuugcuuuccccaaguacauuaccaucauggagaaucaggaaaaaccugagccgauuuauuacgaacucacagacaagcacuuuugggccgcguuccugaaccuugcucggcauaaugucuauacgaccaucaaccacauuaaucgcagacuggagaucgccgaacucaaggaugacggcuacaugauggauaucaaagggagcuggaacgagcaggccaagaaacuggacaagaaaguucggcuucgcgaucugauuaugaagcauuuucccuuccucgaggcugccgcuuaugaaaucacaaauuccaagucuccuaacaauaaagagcagagagaaaaggagcaaagcgaggcccugucccugaacaaucucaaaaacgugcuguuuauuuuccuugaaaagcuccaggugcuccggaauuacuauucucacuacaaauacagcgaggaaucccccaagccuaucuuugagaccucucugcuuaaaaacauguauaaggucuucgacgcgaaugugcgccugguuaagagagauuacaugcaucacgaaaacauugacaugcagcgggauuuuacacaccucaaccgcaaaaagcaagugggaagaaccaaaaauaucauugacagccccaacuuccauuaucacuuugccgauaaggagggcaauaugacaaucgcugggcugcuguucuucgucucccucuuucuggacaaaaaggacgccaucuggaugcagaagaaacuuaagggauucaaagauggccggaaccugcgcgagcagaugaccaaugaaguguuuugcagaagccggauuucucucccuaagcugaaacuugagaacguucagacgaaggacuggaugcagcuggauaugcucaaugaacuggugcgcuguccgaagucccuguacgagagacuccgggaaaaagacagagagagcuucaagguccccuuugauaucuucucugacgauuaugacgcugaggaagaaccuuuuaaaaacacccuggugcgccaucaagaucgguuccccuacuuugugcuuagauauuucgaccugaaugaaauuuuugagcagcuccgcuuccagaucgaucuggggacauaccacuuuuccauuuacaacaagcggaucggagacgaagacgaggucagacaccuuacccaucaccuguauggcuucgcccgcauccaagauuucgcgcagcagaaucagccugagguuuggcggaaacucgugaaggaccuggauuacuuugaagccagccaagagcccuauauuccgaagacagcuccucauuaccaccuggaaaacgagaaaaucggcauuaaguucugcucuacccauaauaaccucuuucccucccugaaaacggagaagacauguaaugggagaagcaaauucaaccuuggaacccaguuuacagccgaggcuuuccuguccgugcacgagcuccugccuaugauguuuuauuaccugcuucucaccaaggacuauucucgcaaagaaagcgccgauaaggucgagggcaucauucggaaggaaaucuccaacaucuacgccauuuacgacgcuuucgcgaauggggagaucaacagcauugccgaucugaccugcagacugcagaaaacaaauauccuccagggacaucugcccaagcaaaugauuucuauccuugagggccgccagaaagacauggaaaaggaggcugaacggaaaauuggggagaugaucgaugacacgcagagacggcuggaucuccuguguaagcagaccaaccaaaagauccgcauuggaaaaagaaaugccggccugcuuaaguccggcaaaaucgccgacuggcucgugaacgauaugaugcgguuucagcccguucagaaggaccagaauaacauuccuaucaauaacagcaaagcuaauucuacagaauauagaaugcugcaacgcgcccuggcgcuguucgggagcgagaacuuucggcugaaggcuuacuucaaucagaugaaccuugugggaaaugacaacccgcaccccuuucuggccgagacccagugggaacaccaaacaaacauucucuccuucuauagaaauuaccuggaggcccgcaagaaauaucugaagggccuuaaaccucagaacuggaagcaguaccagcauuuccucauccugaaaguccaaaagaccaauagaaacacgcuggugacaggguggaaaaauucuuuuaaccucccccggggaaucuucacccagccuauucgcgaaugguuugagaagcacaauaacagcaagagaaucuaugaucagauucuguccuucgaccggguuggcuuuguggcuaaagccaucccccuuuacuucgcugaagaguacaaggauaauguccagccguuuuaugacuacccuuucaacauugggaauaaacugaagccccaaaaaggacaguuucucgauaagaaggagcgcguggaacuguggcagaaaaacaaggagcuguucaaaaauuauccuagcgaaaagaaaaagaccgaccuugccuaccucgauuuucugucuuggaagaaauucgagagagagcugcggcucaucaagaaccaggacaucgucacauggcugauguucaaagaacuuuuuaauauggcgaccguggagggccugaagauuggcgaaauccaccuccgcgauauugacacaaacacggccaacgaggaauccaauaacauccugaauagaauuaugcccaugaaacugccuguuaagaccuaugagacagauaacaaggggaauauccuuaaagagcggccccuggcuaccuucuacaucgaagagacagaaaccaaggugcucaaacaaggaaacuuuaagguccuggccaaagaccgcagacucaauggccugcuuagcuucgcugagacgaccgauauugaccuggaaaagaacccgaucacaaagcucucuguggaccaugagcugauuaaauaucagaccacacggaucuccauuuuugagaugacccuggggcuugaaaagaaacugaucaauaaguacccuacgcuccccacagauagcuucagaaacaugcuggagcgcuggcuccagugcaaagccaaucggcccgaacugaagaacuacguuaauucccuuauugcggugagaaacgccuuuucucacaaucaauauccuauguacgacgcuacccuguucgccgaggucaagaaauuuacacucuucccgagcguggauaccaagaaaaucgaacugaacaucgcuccccagcugcuugagauugugggaaaggccaucaaagagauugaaaaguccgagaauaaaaacuga

SEQ ID NO: 11454 - RNA, 3402 nt, Artificial Sequence
  Cas13b variant__Prevotella falsenii__WP_036884929.1__Cas13b
augaagaacgacaauaacagcaccaaauccacagauuacacgcugggcgacaagcacuucugggccgcuuuucucaaucuggccagacauaacguguauaucaccgucaaucacauuaacaaaguucuugagcugaagaauaaaaaggaucaggaaaucauuaucgacaacgaucaagacauucucgcgaucaagacacugugggggaaaguggauaccgacaucaauaagaaagaucggcuucgcgagcugauuaugaagcauuuccccuuucucgaagcugccacauaccagcagucuagcaccaacaauacaaaacagaaggaggaggaacaagccaaggcucaguccuucgagucucugaaagacugccuguuucucuuccuggaaaaacuuagagaggcccggaacuauuacagccacuauaaacauuccaagucucuggaggaaccuaaacucgaggaaaagcugcuugagaauauguacaacaucuuugauaccaaugugcagcuggucauuaaagacuaugaacacaacaaggauaucaacccggaggaagacuucaagcaccucggacgcgcugagggcgaguuuaauuacuacuucacgagaaacaaaaaggggaauauuaccgaaagcggacugcuguuuuucgugucccucuuucuggagaaaaaggacgccaucugggcgcagacaaaaauuaagggcuucaaggauaaccgggaaaauaaacaaaagaugacccaugagguuuucugucgcagcagaaugcuucugcccaaacuccggcuggaaucuacacagacccaggacuggauccuucuggauaugcucaacgagcugauccgcugcccuaagucccuguauaaaagacuccagggggagaagcgggaaaaguuucgcgugcccuucgacccugccgaugaggacuacgaugcugaacaagagcccuuuaaaaauacgcuggucagacaccaggaccgguucccuuauuuugcccuucgcuacuucgauuauaacgaaauuuuuacaaaucugagauuccagaucgaccucggaaccuaccauuuuagcauuuauaagaaacaaaucggcgauaagaaagaggaccggcaccugacacacaaacuuuacggcuucgagcgcauucaggaauuugcuaaggagaacagaccggacgaauggaaagcccuggugaaggaucucgacaccuucgaggagucuaaugaacccuacaucuccgagaccacaccucauuaucaccuggaaaaccagaaaaucgggauucggaauaagaacaaaaagaaaaagaagacgaucuggcccagccuggagaccaaaacaaccguuaaugaaagaucuaaguacaaccucggaaaauccuuuaaggcggaggccuuccugagcgugcaugagcuucugccuaugauguucuauuaccuccugcugaacaaagaggaacccaauaacggcaagauuaaugcuuccaaggucgaagggaucauugagaaaaagauccgcgauaucuauaaacuuuacggagccuuugcuaacgaagagauuaauaacgaggaggaacucaaggaauauugugagggcaaagacaucgccauucggcaucugccgaagcagaugaucgccauucugaagaaugaauacaaagauauggcuaagaaagcggaggacaagcaaaagaagaugaucaaggauacaaagaagagacucgccgcucuggacaaacaggugaagggggagguggaagauggaggccgcaacauuaaaccucuuaagucuggccggaucgccagcuggcuggucaaugacaugaugagauuccagcccguucagcgcgaucgggacggguacccucucaacaauuccaaagccaacagcaccgaguaucaacugcugcagagaacgcuugcucucuuuggaucugaacgcgagcggcuggcccccuacuucagacagaugaaucugaucggcaaggauaacccccacccuuuucucaaggacacaaaauggaaggagcacaauaacauucuguccuucuaucggagcuaccuugaagcgaaaaagaacuuucuggggucucucaaaccggaggacuggaagaagaaucaguauuuccugaaacugaaggaacccaaaaccaaccgcgagacccuugugcaaggauggaagaauggcuuuaaccucccuagagggaucuucacagaacccauucgggagugguuuaucagacaccagaaugagagcgaagaguacaaaaaggugaaggauuucgaccgcauuggacuggucgcuaaagugaucccucuguuuuucaaggaagauuaucagaaagagaucgaagacuacguucagcccuucuacggcuauccguuuaacgugggcaauauucauaacucccaagaggggaccuuccucaauaagaaagagcgggaggaacuguggaagggaaacaagacaaaauuuaaggauuacaaaacgaaggagaaaaauaaggaaaagaccaacaaagacaaguucaaaaagaaaacagaugaagagaaggaggaauuuagaucuuaucuugacuuccagagcuggaaaaaguuugagcgcgaacugagacucguccggaaucaggauaucgugaccuggcugcugugcauggagcuuauugacaagcucaaaaucgaugagcugaacauugaggaacugcaaaagcuccgccugaaagacaucgauacagacaccgccaagaaagaaaagaauaacauccuuaacagaauuaugccuauggagcugcccguuacgguguacgaaaccgacgauuccaauaacaucauuaaggacaaaccucuccacacaaucuauauuaaggaggccgagaccaaacugcugaagcagggcaauuucaaagcucuugucaaggaucggcgccugaacgggcucuuuagcuucguggaaacaucuuccgaggccgaacuuaagagcaaacccaucucuaagucccucgucgaguacgaacugggagaguaucagagagcucggguggagaucauuaaagacaugcuucgccuggaagagacccucaucggcaaugaugaaaagcugccuacgaacaaauuuagacagaugcuggacaaguggcuugagcauaagaaagaaacagaugacaccgaucugaagaaugacguuaaacuccugacagaggugcggaacgccuucagccacaaucaauaccccaugcgcgauagaauugcguucgccaacaucaagccguuuucccucucuagcgcuaauaccuccaacgaggaagggcugggcauugccaaaaagcugaaagacaagaccaaggagacaaucgaccggauuaucgaaaucgaggagcagacggcuaccaaaagauga

SEQ ID NO: 11455 - RNA, 3402 nt, Artificial Sequence
  Cas13b variant__Prevotella intermedia__BAU18623.1__Cas13b
auggaggacgauaagaaaaccacagacagcaucuccuacgaacugaaggauaaacacuucugggccgcuuuucucaaccuggccagacauaauguguauauuacggucaaccacaucaauaagguucuugagcugaaaaacaagaaggaccaggauauuaucauugacaaugaucaagacauccucgcgaucaaaacccauugggaaaaggugaacggcgaucugaauaaaacagagcggcuucgcgaacugaugaccaagcacuuccccuuucucgagacagcuauuuacucuaaaaacaaggaggacaaggaagaggugaaacaggaaaagcaggccaaagcccagagcuucgauucccugaagcauugccuguuucucuuccuggagaaacuucaagagaccagaaauuauuacucucacuauaaguacagcgaauccacaaaagagccuaugcuggaaaaggagcuccugaagaaaauguauaacaucuuugacgauaauauucagcuugucaucaaggacuaccagcacaacaaagacauuaauccggaugaagacuucaagcaucuggaucggaccgaggaggacuuuaacuacuauuucacgcgcaauaaaaaggggaacaucaccgaaucuggacuccuguuuuucgugagccuguuucucgagaagaaagaugcuauuuggaugcagcaaaagcugagaggcuucaaagacaaccgggaauccaagaaaaagaugacacacgagguuuucugucgcagcagaaugcuucugcccaagcuccggcuggaaucuacccagacacaggauuggauccuucuggacaugcucaaugagcugauccgcugcccuaaaucccuguacgagagacuccagggggaagaucgggagaaguuuaaagugcccuucgacccugccgaugaagacuaugacgcugagcaagaacccuuuaagaacacccugguccgccaucaggauagauucccuuacuuugcccuucgguauuucgacuacaaugagauuuuuacgaaccugcgcuuccagaucgaucucggaacauuucacuucagcauuuauaaaaagcugaucggcgggcaaaaggaggacagacaccuuacccauaaacuguacggauuugaacggauucaggaguucgcgaagcagaauagaccggaugaauggaaagccaucgugaaggaccucgauacauacgagaccucuaacgagcgcuauaucuccgaaaccacaccccacuaccaucuggagaaucagaaaauuggcauccgguuuagaaacgacaaugaugaaauuuggccuagccugaagacgaacggcgagaauaacgaaaaaucuaaguauaagcucgacaaacaauaccaggcugaggccuuccuguccguucacgagcuucugcccaugauguucuauuaccuccugcugaagaaagaggaaccuaauaacgauaagaaaaaugcuagcaucguggaaggguuuauuaagcgcgagauccgggacauguauaaacuuuacgaugccuucgcgaacggagaaaucaacaauauugacgaccucgagaaauacugugaggauaagggcauccccaaaagacaucugccgaagcagauggucgccauucuguaugacgaacacaaagauauggugaaggaggcuaagcgcaaacagcggaagauggugaaagacaccgaaaagcuccuggccgcucuugagaaacaaacacaggaaaagaccgaggaugggggaagaaacauccgccugcucaaguccggcgagauugcccgguggcuggucaaugacaugaugagauuucagccuguucagaaagauaacgaagggaauccccugaacaauucuaaggccaacagcacagaguaccaaaugcuucagcgcucccucgcucuguauaauaaagaagagaagccuacccgguacuucagacaggugaaccugaucaauagcucuaacccccaccccuuucucaaauggacgaagugggaggaaugcaauaacauucuguccuucuaucggagcuaccuuacaaagaagaucgaguuucugaauaagcucaaaccugaagacugggagaagaaccaguauuuccugaaacugaaggaaccgaaaaccaaccgcgagacccuugugcaaggauggaagaauggcuuuaaccuccccagaggcaucuucacagagccuauucgggaaugguuuaagagacaucagaaugauucuaaagaguacgaaaaggucgaggcgcuggaccgcguggggcugguuaccaaagugaucccccucuucuuuaagaaagaagauagcaaggacaaggaggaggaucugaaaaaggacgcccagaaagaaauuaacaauuguguccaaccuuucuacuccuuccccuauaacgugggaaauauccacaagccggacgagaaagauuuucuucaucgggaagagagaauugaacugugggacaagaagaaagauaaguucaaaggcuacaaggcuaaaguuaagucuaagaaacucacagacaaggagaaagaggaauaucgcagcuaccuggaguuucaguccuggaacaaguucgaaagagagcugcggcuugugcgcaaucaggauaucgucacguggcuccugugcaccgagcugaucgacaaacucaagguggaagggcugaacgucgaggaacuuaaaaagcugagacucaaggauauugacacagauaccgccaaacaggagaagaauaacauccugaaucgggugaugccuaugcaacugcccguuacaguguaugaaauugacgauagccacaacaucgucaaagaccgcccucuucacaccguguacauugaggagacgaagaccaaacugcucaagcagggaaauuuuaaggcccugguuaaagacagacggcucaacggccuguucucuuuuguggauacauccagcgaagcugagcuuaagucuaaccccaucuccaaaagccuggucgaauaugagcucggggaauaccagaaugcccgcaucgagaccauuaaggacaugcugcugcuugaggaaacacugaucgagaaauacaagaaccucccuaccgauaauuucuccgacaugcugaacggauggcucgaaggcaaggaugaggcggacaaagcuagauuucagaaugaugugaagcugcuuguggccguucggaacgccuucucucauaaucaauaucccaugcgcaacagaauugcuuuugccaauaucaacccguucagccuguccucugcugacacgagcgaagagaaaaagcucgauauugccaaucagcugaaagacaagacacacaagaucaucaaacggauuaucgagauugaaaagccuaucgagaccaaagaauga

SEQ ID NO: 11456 - RNA, 3405 nt, Artificial Sequence
  Cas13b variant__Prevotella intermedia__AFJ07523.1__Cas13b
augaagauggaggacgauaaaaagaccaaagaaagcacaaacaugcuggacaauaagcacuucugggccgcuuuucucaaccuggccagacauaauguguacaucacggucaaccacauuaauaaaguucuugagcugaagaacaagaaagaucaggacaucauuaucgauaaugaccaagauauucucgcgaucaagacccauugggaaaaagugaacggcgaccugaauaagacagagcggcuucgcgaacugaugaccaaacacuuccccuuucucgagacagcuaucuauaccaagaacaaggaggauaaagaagaggugaagcaggaaaaacaggccaaggcccaguccuucgacucucugaaacauugccuguuucucuuccuggagaaacuucaagaggcuagaaauuacuauagccacuacaaauauuccgaaucuacaaaggagccuaugcuggaaaaggagcuccugaaaaagauguacaacauuuuugaugacaauauccagcuugucauuaaagauuaucagcacaacaaggacaucaauccggacgaagauuucaaacaucuggaccggaccgaggaggaauuuaacuacuacuucacgaccaacaagaaggggaauauuacagccagcggacuccuguuuuucgugucccuguuucucgagaaaaaggaugcuaucuggaugcagcaaaaacugcgcggcuucaaggacaacagagaaucuaaaaagaagaugacccacgagguuuucugucggagccgcaugcuucugcccaaacucagacuggaauccacacagacccaggauuggauucuucuggacaugcucaaugagcugauccggugcccuaagagccuguaugagcgccuccagggggaauacagaaagaaguuuaacgugcccuucgauucugccgacgaggauuaugacgcggaacaagagccuuuuaaaaauacgcugguccggcaucaggaucgcuuccccuacuuugcccuuagauauuucgacuacaacgaaaucuuuacaaaucugcgguuccagauugaccucggaaccuaucacuuuuccaucuacaagaagcugauuggcgggcaaaaagaggaucgccaccuuacacauaagcuguacggauucgagagaauccaggaauuugcuaaacagaaccggaccgacgaguggaaggccauugugaaagauuucgacaccuaugaaacaagcgaggagccuuacaucucugaaacggcuccgcacuaucaucucgagaaucagaagaucggcauuagauuucgcaacgauaaugacgaaaucuggcccucccugaaaaccaacggcgagaauaacgaaaagcggaaguacaaacuggauaagcaauaucaggccgaggcguuccucagcguucacgagcugcuuccuaugauguucuacuaucugcuccugaaaaaggaagaacccaauaacgacaaaaagaacgccucuauuguggaaggguuuaucaagagagagauucgcgauaucuacaaacuguacgacgcuuucgccaauggagaaaucaacaauauugaugaccuugagaaguauugugaggauaaaggcaucccuaagcggcaucuccccaaacagauggucgcuauucuguacgacgaacacaaggacauggccgaggaagccaagagaaaacagaaggagauggugaaagauacaaagaaacugcucgcuacccuggaaaagcaaacacagggggagaucgaggacggaggccgcaacauucggcuucugaaguccggggaaaucgcgagauggcucgugaaugauaugaugcgcuuucagccgguccagaaagacaacgagggaaauccucugaacaauagcaaggccaacuccaccgaauaucaaaugcugcagcggucucuugcucucuacaauaaagaggagaagcccacgagauauuuccgccagguuaaccugauuaauagcuccaacccucaccccuuucugaaauggacaaagugggaagagugcaauaacauccucagcuucuaccggucuuaucugaccaaaaagaucgaauuucuuaacaagcugaaacccgaggauugggaaaagaaucaguacuuccucaaacugaaggagccuaaaaccaacagagagacacuggugcaaggcuggaagaauggcuuuaaccuuccgcgggggauuuucaccgaacccauccgcgagugguuuaagagacaucagaaugacuccgaagaguacgaaaaaguggagacacucgaucgggucggacuggugacgaagguuauuccucuguucuuuaaaaaggaggacagcaaagauaaggaagaguaucucaagaaagacgcccagaaggaaaucaacaauugugugcaacccuucuacggcuucccuuauaacgucgggaauauucacaaacccgaugagaaggacuuucugccgucugaagagagaaagaaacuuuggggagauaagaaauacaaguucaaaggcuauaaggccaaaguuaagagcaagaaacugaccgacaaggagaaagaagaguaccgcuccuaucucgaauuucagucuuggaacaaguucgagcgggagcugagacuggugcgcaaucaggacaucgugacauggcuucucugcaccgaacugaucgauaaacugaaggucgaggggcucaacguggaggagcugaaaaagcugagacuuaaggacauugauacagacaccgcuaaacaggaaaagaauaacauccucaaucgggucaugccuaugcaacugcccgugacgguuuacgagauugaugacagccauaacaucgugaaagaucgcccucugcacaccgucuacauugaggaaacaaagaccaaacuucugaagcagggaaacuuuaaggcccucgugaaagacagacggcugaauggccucuucuccuuuguugauacaagcucugagaccgaacugaaguccaaccccaucagcaaaucucuuguggaguaugaacugggcgaguaccagaaugcgcgcaucgagacgauuaaggacaugcuccugcuggaagagacacuuaucgaaaaauauaagacccugccuacagauaacuucuccgacaugcucaauggguggcuggagggaaaggacgaagcugauaaagccagauuucagaacgacgucaagcuccugguggccgugcggaaugcuuucagccacaaccaauaccccaugcgcaauagaauugccuuugcuaacaucaauccguucucccuuucuagcgccgauaccuccgaggagaaaaagcuggacauugcgaaccagcucaaagauaagacccauaagaucaucaaacggauuaucgaaauugagaagccuaucgaaacaaaagaguga

SEQ ID NO: 11457 - RNA, 3399 nt, Artificial Sequence
  Cas13b variant__Prevotella intermedia__WP_014708441.1__Cas13b
auggaggacgauaagaaaaccaaggaaagcacaaacaugcuggacaauaaacacuucugggccgcuuuucucaaccuggccagacauaauguguacaucacggucaaccacauuaauaagguucuugagcugaaaaacaagaaggaucaggacaucauuaucgauaaugaccaagauauucucgcgaucaaaacccauugggaaaaggugaacggcgaccugaauaaaacagagcggcuucgcgaacugaugaccaagcacuuccccuuucucgagacagcuaucuauaccaaaaacaaggaggauaaggaagaggugaaacaggaaaagcaggccaaagcccaguccuucgacucucugaagcauugccuguuucucuuccuggagaaacuucaagaggcuagaaauuacuauagccacuacaaguauuccgaaucuacaaaagagccuaugcuggaaaaggagcuccugaagaaaauguacaacauuuuugaugacaauauccagcuugucauuaaggauuaucagcacaacaaagacaucaauccggacgaagauuucaagcaucuggaccggaccgaggaggaauuuaacuacuacuucacgaccaacaaaaaggggaauauuacagccagcggacuccuguuuuucgugucccuguuucucgagaagaaagaugcuaucuggaugcagcaaaagcugcgcggcuucaaagacaacagagaaucuaagaaaaagaugacccacgagguuuucugucggagccgcaugcuucugcccaagcucagacuggaauccacacagacccaggauuggauucuucuggacaugcucaaugagcugauccggugcccuaaaagccuguaugagcgccuccagggggaauacagaaagaaauuuaacgugcccuucgauucugccgacgaggauuaugacgcggaacaagagccuuuuaagaauacgcugguccggcaucaggaucgcuuccccuacuuugcccuuagauauuucgacuacaacgaaaucuuuacaaaucugcgguuccagauugaccucggaaccuaucacuuuuccaucuacaaaaagcugauuggcgggcaaaaggaggaucgccaccuuacacauaaacuguacggauucgagagaauccaggaauuugcuaagcagaaccggaccgacgaguggaaagccauugugaaggauuucgacaccuaugaaacaagcgaggagccuuacaucucugaaacggcuccgcacuaucaucucgagaaucagaaaaucggcauuagauuucgcaacgauaaugacgaaaucuggcccucccugaagaccaacggcgagaauaacgaaaaacggaaguacaagcuggauaaacaauaucaggccgaggcguuccucagcguucacgagcugcuuccuaugauguucuacuaucugcuccugaagaaagaagaacccaauaacgacaagaaaaacgccucuauuguggaaggguuuaucaagagagagauucgcgauaucuacaagcuguacgacgcuuucgccaauggagaaaucaacaauauugaugaccuugagaaauauugugaggauaagggcaucccuaaacggcaucuccccaagcagauggucgcuauucuguacgacgaacacaaagacauggccgaggaagccaagagaaagcagaaagagauggugaaggauacaaagaagcugcucgcuacccuggaaaaacaaacacagggggagaucgaggacggaggccgcaacauucggcuucugaaguccggggaaaucgcgagauggcucgugaaugauaugaugcgcuuucagccgguccagaaggacaacgagggaaauccucugaacaauagcaaagccaacuccaccgaauaucaaaugcugcagcggucucuugcucucuacaauaaggaggagaaacccacgagauauuuccgccagguuaaccugauuaauagcuccaacccucaccccuuucugaaguggacaaaaugggaagagugcaauaacauccucagcuucuaccggucuuaucugaccaagaaaaucgaauuucuuaacaagcugaagcccgaggauugggagaaaaaucaguacuuccucaagcugaaagagccuaagaccaacagagagacacuggugcaaggcuggaaaaauggcuuuaaccuuccgcgggggauuuucaccgaacccauccgcgagugguuuaagagacaucagaaugacuccgaagaguacgaaaagguggagacacucgaucgggucggacuggugacgaaaguuauuccucuguucuuuaagaaagaggacagcaaggauaaagaagaguaucucaagaaggacgcccagaaagaaaucaacaauugugugcaacccuucuacggcuucccuuauaacgucgggaauauucacaagcccgaugagaaagacuuucugccgucugaagagagaaagaaacuuuggggagauaagaaguacaaauucaagggcuauaaagccaaggugaaaagcaagaagcugaccgacaaagagaaggaagaguaccgcuccuaucucgaauuucagucuuggaacaaauucgagcgggagcugagacugguucgcaaucaggacaucgugacauggcuucucugcaccgaacugaucgauaagcugaaagucgaggggcucaacguggaggaacugaagaaacuuagacugaaggacauugauacagacaccgcuaagcaggagaaaaauaacauccucaaucgggucaugccuaugcaacugcccgugacgguuuacgaaauugaugacagccauaacaucgugaaggaucgcccucugcacaccgucuacauugaggaaacaaaaaccaaacuucugaaacagggaaacuuuaaggcccucgugaaggacagacggcugaauggccucuucuccuuuguugauacaagcucugagaccgaacugaaauccaaccccaucagcaagucucuuguggaguaugaacugggcgaguaccagaaugcgcgcaucgagacgauuaaagacaugcuccugcuggaagagacacuuaucgaaaaguauaaaacccugccuacagauaacuucuccgacaugcucaauggguggcuggagggaaaggacgaagcugauaaggccagauuucagaacgacgucaaacuccugguggccgugcggaaugcuuucagccacaaccaauaccccaugcgcaauagaauugccuuugcuaacaucaauccguucucccuuucuagcgccgauaccuccgaggagaagaaacuggacauugcgaaccagcucaaggauaaaacccauaagaucaucaagcggauuaucgaaauugagaaaccuaucgaaacaaaggaguga

SEQ ID NO: 11458 - RNA, 3381 nt, Artificial Sequence
  Cas13b variant__Prevotella intermedia__WP_036860899.1__Cas13b
auggaggacgauaagaaaaccacagacagcaucagauacgaacugaaggauaaacacuucugggccgcuuuucucaaccuggcccggcauaauguguauauuacggucaaccacaucaauaagauucuugaggaaggcgagaucaaccgcgacggguacgaaaccacacugaaaaauaccuggaacgagauuaaggauaucaauaagaaagacagacucuccaagcugaucauuaaacauuuccccuuucuugaggcggcuacauaucggcugaacccuaccgauacaaccaagcagaaagaagagaagcaagccgaagcccagucucucgagagccugcgcaaguccuucuuuguuuucaucuacaaacugagagaccuccggaaucacuauucucauuacaagcacagcaaaucccuggagcgcccgaaguuugaagagggacuucuggagaaaauguauaacauuuucaaugcuucuaucagacucgugaaggaagauuaccaguacaacaaagacauuaaucccgaugaagacuuuaagcaccuggaucggacggaggaggaguucaacuauuacuuuaccaaggacaaugaaggcaacaucacagaaagcgggcuucuguucuuugugucccucuuccuggagaaaaaggacgccauuuggaugcagcaaaaacugcgcggauucaaggauaacagagaaaauaaaaagaagaugaccaacgaggucuuuugccggagccgcaugcuccugccuaaacuuagacugcagucuacacagacccaggacuggauccuccuggauaugcuuaaugagcugauccggugucccaagucccucuaugaacgccugagagaggaagaccgggagaaauucagagugccuauugaaaucgcugaugaggacuacgaugccgagcaagaacccuuuaagaacacgcugguucgccaucaggaccgguucccuuauuuugcgcucagauacuucgauuauaaugagauuuuuacaaaccugcgcuuccagaucgaccuuggcaccuaccacuuuagcauuuacaaaaagcagaucggggauuauaaggaaucucaucaccugacacacaaacucuacggauucgagcggauccaagaguuuaccaagcagaauagaccggacgaauggcgcaaauucgugaagaccuuuaacuccuucgagacaagcaaagaacccuauauuccugagacgacaccccauuaccaccuggaaaaucagaagaucggcauucgguucagaaacgacaaugauaagaucuggccuucucuuaaaaccaacuccgagaagaaugagaaaagcaaguauaaacuggacaaguccuuucaagccgaggcuuuccucucuguccaugaacugcugcccaugauguuuuacuaucuccugcuuaaaaccgaaaacacagauaaugacaacgagauugaaaccaagaagaaagagaacaagaaugauaaacaggagaagcacaaaaucgaagagaucauugaaaacaagaucacggagauuuacgcccuguacgacacauucgcuaauggcgaaaucaagagcauugaugagcucgaggaauauugcaaagggaaggacaucgagauuggacaucugccgaaacagaugaucgccauccugaaggaugaacacaaagugauggcgaccgaggccgagcgcaagcaggaagagaugcuuguugacgugcaaaagucccucgaaagccuggauaaccagauuaaugaggaaaucgagaacgucgagcggaaaaauucuucccuuaagagcggcaaaauugcuucuuggcucgugaacgacaugaugagauuucagccugugcagaaggauaaugaagggaaaccccugaacaauagcaaggccaacuccaccgaguaccaacuucugcagcgcacacucgcuuucuuuggaucugaacacgagcggcuggccccuuauuucaagcagaccaaacugaucgaaagcuccaauccccaucccuuucuuaaggacacagagugggagaaauguaacaauauucucagcuucuacagaucuuaucuggaagccaagaaaaacuuucuggagucccucaagccugaagacugggagaaaaaccaguacuuccugaaacuuaaggaaccgaaaacgaagcccaaaacccugguccaaggcuggaagaauggguuuaaccucccucggggaaucuucacagagcccauccgcaaaugguucaugaagcacagagagaauauuaccguugcugaacugaagcgggugggccugguggcgaaagucaucccucuguuuuucagcgaggaauauaaggauucugugcagcccuuuuacaacuaccauuucaauguuggcaacauuaauaaaccggacgagaagaacuuucucaauugcgaggaaagacgcgagcugcugcggaaaaagaaggaugaguucaaaaagaugacagacaaagaaaaggaagagaacccuuccuaucucgaguuuaaaagcuggaauaaguucgaaagagagcugcgccuugugagaaaccaggauaucgucaccuggcugcucuguauggaacuguuuaauaagaaaaagauuaaagagcugaacguggaaaagaucuaccuuaaaaauaucaacacgaacaccacaaagaaggagaaaaauaccgaggaaaagaacggggaggaaaagaauauuaaggagaaaaacaauauccucaaccggauuaugcccaugcgccugccuaucaagguuuauggaagagaaaauuucuccaaaaacaagaagaaaaagauucggcgcaauacauuuuucaccguguacaucgaggagaaaggcacgaagcugcucaaacaggggaacuucaaggcccuggaaagagaccggcgccuuggaggccuguuuucuuucgucaagacacccagcaaagcugaguccaagucuaauaccaucagcaaacucagaguggaauaugagcugggggaguaccaaaaggcccggauugaaaucauuaaagauaugcuggcccuugagaagacacugaucgacaaguauaacucccucgauaccgacaauuuuaacaaaaugcugaccgauuggcucgaacugaagggagagccugacaaagcuagcuuccagaaugaugucgaccuucugauugccgugcgcaacgcguuuucucacaaucaguaccccaugagaaaccggaucgcuuucgccaacauuaauccguuuucccucagcucugccaacacauccgaagagaagggccugggcaucgcuaaucaacugaaagacaagacgcacaagaccaucgagaaaauuaucgaaauugagaagccuaucgaaacaaaagaguga

SEQ ID NO: 11459 - RNA, 3363 nt, Artificial Sequence
  Cas13b variant__Prevotella intermedia__WP_061868553.1__Cas13b
auggaggacgauaagaaaaccacagacagcaucagauacgaacugaaggauaaacacuucugggccgcuuuucucaaccuggcccggcauaauguguauauuacggucaaccacaucaauaagauucuugaggaagacgagaucaaccgcgauggcuacgaaaauacccuggagaacuccuggaaugagauuaaagacaucaacaagaaggauagacucucuaaacugaucauuaagcauuuccccuuucuugaagcgacaaccuaucggcagaauccuacagacaccacaaaacaaaaggaggaaaaacaggcugaggcccagagccuggagucccucaagaagucuuucuuuguuuucaucuacaaacugcgcgaucugagaaaccacuauagccauuacaagcacuccaaaucucucgaacggccgaaguuugaggaagaccugcagaauaaaauguauaacauuuucgaugugagcauccaauuugugaaggaggacuacaaacacaauaccgauauuaaccccaagaaggacuucaaacaucuugaccgcaagagaaaagggaaguuucacuacuccuucgccgauaaugaaggaaacaucacggagagcggccugcucuuuuucgucucucuguuccuugagaaaaaggacgcuauuugggugcagaagaaacuggaaggguuuaagugcuccaacaaaagcuaucagaagaugaccaaugagguuuucugucggucucgcaugcuccugccuaaacugagacucgaauccacacagacccaagauuggauccugcuugacaugcugaacgagcucauccggugccccaagagccuguacgaacgccuucagggagugaauagaaagaaauuuuaugucucuuucgauccugccgacgaggauuacgacgcugagcaggaacccuuuaagaacacacuggugcggcaucaggaucgcuucccuuauuuugcccucagauacuucgacuauaaugagguuuuugcgaaccugcgguuccaaauugaucugggcaccuaccacuuuuccaucuacaaaaagcucauugggggacagaaagaagacagacaccugacgcauaaacuuuauggcuucgagcgcauccaggaauuugacaagcaaaaucggccggaugaguggaaagccauugugaaggacagcgauacauucaaaaagaaagaggaaaaggaggaagagaaacccuacaucuccgagaccacaccucacuaucaucuggaaaacaagaagaucggcauugcuuucaaaaaucacaacaucuggcccucuacccagaccgagcucacaaauaacaagagaaagaaguacaaucuggggacgagcauuaaagccgaggcuuuucuuuccguccaugaacugcucccuaugauguucuauuaccugcugcucaagaccgaaaacacaaagaaugacaacaaagugggaggcaagaaagagaccaagaaacaggggaagcacaagaucgaggccauuaucgaaagcaaaaucaaggauauuuaugcgcuguacgacgccuuugcuaacggagagaucaauucugaagaugagcuuaaagaauaccugaagggcaaagacauuaagaucgugcaccuccccaagcagaugauugccauccugaaaaacgagcauaaggauauggcugagaaagccgaagccaagcaagagaaaaugaagcuggcuacagaaaaucgccuuaaaacccucgacaagcagcugaaggggaaaauucagaacggaaagcgguauaauuccgcgccgaaaagcggcgagaucgccucuuggcuggucaacgauaugaugagauuccagccuguucaaaaggacgaaaauggcgagagccucaacaauuccaaagcuaacucuacggaguaccagcugcuucagcgcacacuggccuuuuucgggagcgaacacgagcggcucgcccccuauuuuaagcagaccaagcugaucgaauccagcaauccucaucccuuccugaacgauaccgagugggagaaauguucuaauauucuuuccuuuuacagaagcuaucucaaggcucgcaaaaacuuccuggaaucucugaagcccgaggacugggagaaaaaucaauacuuucucaugcugaaggaaccuaagacaaaccgggaaacccuugugcagggauggaaaaacggcuucaaucugccgagaggguuuuucacagagcccauccgcaagugguucauggagcacuggaaauccauuaagguggacgaucucaaacgggucggacugguggccaagguuacgccucuguuuuucagcgaaaaguauaaagacuccgugcagcccuuuuacaacuacccuuucaaugucggcgaugugaacaagcccaaagaggaagacuuucuucacagagaggaacggaucgagcucugggauaagaaaaaggacaaguucaaaggguauaaggcgaaaaagaaauuuaaggagaugaccgauaaagaaaaggaggaacaucgcucuuaccuggaguuccagagcuggaauaaguuugaaagagagcugcggcucguuagaaaccaagacauugugacauggcugcuuugcaccgagcugaucgauaaacucaagaucgacgaacugaauauuaaagagcugaagaaacuucgccucaaggauaucaacacagacaccgcuaagaaagaaaagaauaacauucugaaucgggucaugccgauggagcugccugugacggucuauaaagugaacaagggaggcuacaucauuaaaaauaagccccuccacaccaucuauaucaaggaggccgaaacaaaacugcuuaagcagggcaacuucaaagcccugguuaaggauagacgccucaaugggcuguuuuccuucgugaaaaccccuucugaggcugaaagcgaguccaaccccauuagcaagcugagagucgaauacgagcuuggaaaguaucagaacgcccggcuggacaucauugaggacaugcucgcucuggagaaaaagcucaucgauaaauacaauucucuggacacagauaacuuccauaauaugcuuaccggcuggcuggaacucaagggggaagccaaaaaggcgcgcuuucaaaacgacgugaaacugcugacggccguuagaaaugcuuucucccacaaccaguacccuauguaugaugagaaucuuuuuggaaacauugaacgguucagccugucuuccagcaauaucaucgagucuaagggccucgacauugccgcuaagcugaaagaggaagugagcaaggccgcgaaaaagauccagaacgaggaagauaauaaaaaggagaaggaaacauga

SEQ ID NO: 11460 - RNA, 3378 nt, Artificial Sequence
  Cas13b variant__Prevotella intermedia__KJJ86756.1__Cas13b
augaagauggaggacgauaaaaagaccacagaaagcacgaacaugcuggacaauaaacacuucugggccgcuuuucucaaccuggccagacauaauguguacaucaccgucaaccacauuaauaagguucuugagcugaaaaacaagaaggaucaggacaucauuaucgauaaugaccaagauauucucgcgaucaaaacacauugggaaaaggugaacggcgaccugaauaaaaccgagcggcuucgcgaacugaugacaaagcacuuccccuuucucgagaccgcuaucuauaccaaaaacaaggaggauaaggaagaggugaaacaggaaaagcaggccgaggcccagucccuggagucucugaaagacugccucuuccuguuucuugaaaagcugcaagaggcuagaaauuacuauagccauuacaaauauuccgaaucuacaaaggagccuaugcucgaagaggggcugcuugagaaaauguacaacauuuucgaugacaauauccagcuggucauuaaggauuaucagcacaacaaggacaucaauccggacgaagauuuuaaacaccucgaccggaagggacaguucaaauacagcuuugccgauaacgagggcaacauuacggaauccgggcugcuguucuuugugucucucuuccuggagaagaaagacgcuaucuggaugcaacagaaacuuaccggauuuaaggauaaucgcgaaagcaaaaagaaaaugacacaugagguuuucuguagacggcgcaugcugcuccccaagcugagacuugaguccacccagacacaggacuggauucugcucgauaugcugaacgaacugauccggugcccuaaaagccucuacgagcgccugcaaggcgaauauagaaagaaguucaaugugcccuuugacucugccgaugaggacuacgaugcggaacaggagccuuucaaaaacacccuuguccggcaccaggaccgcuuucccuauuucgcccugagauacuuugacuauaaugagaucuucacgaaccuccgguuucaaauugaucuggggacauaccauuucuccaucuauaagaaacuuauuggaggccagaaggaagaccgccaccugacccacaaacucuacggcuuugagagaauccaggaguucgcuaagcagaaucggccugaugaguggaaggcccuggugaaagaccuggauacauacgagaccagcaacgaaagauauauuucugagaccacaccgcauuaccaccucgaaaaucaaaagaucgggauccgcuuucggaacggaaauaaagagauuuggcccucccugaagacgaacggcgaaaauaacgagaaaagcaaguauaaacuugacaagccuuaccaggcugaggccuuccugucuguucaugaacuccugcccaugauguuuuauuaccugcuucucaagaaagaggaaccuaauaacgauaagaaaaacgcguccaucguggagggguucauuaagagagaaauccgcgacauguauaaacuguacgaugccuucgcuaauggagagauuaacaauaucggcgaccuggagaaguacugugaagauaaggggauccccaaacggcaccucccgaagcagauggucgccauucuguaugacgagccuaaagauauggugaaggaagcuaaaagaaagcagaaggagauggugaaagacaccaagaaacuucuggccacacucgaaaagcaaacccaggaggagaucgaagacggaggccgcaacauucggcugcugaaaagcggcgagaucgccagauggcuugucaaugauaugaugcgcuuucagcccguucagaaggacaacgaagggaauccucucaacaauuccaaggcuaacucuacagaguaccaaaugcugcagcggagccuggcgcucuauaauaaagaggaaaagcccaccagauacuuccgccaggugaaccugauuaauuccagcaacccccauccuuuucuuaaauggacgaagugggaggaaugcaauaacauccugucuuucuaucggaacuaccucaccaaaaagauugaguuucugaauaaacugaagccggaagauugggagaagaaccaguauuuccuuaaacucaaggagcccaaaacaaauagagaaacccuggugcaaggauggaagaacggcuuuaaucugccucgggggaucuucacagagcccauccgcgaaugguuuaaaagacaccagaacgacuccaaggaguacgaaaaggucgaggcccucaaacgggugggacugguuaccaaggugauuccucuuuucuuuaaagaggaauacuucaaggaggaugcucagaaagaaaucaauaacuguguccaacccuuuuauagcuucccguacaaugugggcaacauucacaagccugacgagaaggauuuccugcccucugaagagagaaagaagcucuggggagacaaaaaggauaaauuuaagggguauaaggccaaaguuaagagcaaaaagcugacagacaaagagaaggaagaguaccgcuccuaucuggaguuccagucuuggaauaaguuugaacgggagcuuagacucgugcgcaaccaggauaucgucacguggcugcugugcaccgaacucauugacaaaaugaagguggagggccugaaugucgaagaacuucagaaacugagacucaaggauaucgacacagacaccgccaaacaagaaaagaacaauauccugaaccggauuaugccuaugcagcugcccgugacaguuuacgagaucgaugacagccauaacauugugaaagaucgcccucuucacaccgucuauaucgaggaaacgaagaccaagcugcucaaacagggcaauuucaaggcucuggugaaagacagacggcucaacgggcuguuuuccuucguugauacaagcucuaaggccgagcuuaaagacaagcccauuuccaagagcguggucgaauacgagcugggagaauaccagaaugcgcgcaucgagaccaucaaagauaugcuccugcuggagaagacacuuauuaaaaaguaugaaaaacugccgaccgacaacuuuucugauaugcucaauggcuggcuggaggggaaggacgaauccgauaaggcuagauuccaaaacgacgugaaacuccugguggccguucggaaugccuuuagccauaaccaguacccuaugcgcaauagaaucgcuuucgccaacauuaaucccuuuucccuuucuagcgcugacaucuccgaggaaaagaaacuggauauugccaaccagcucaaggacaaaacgcacaagaucaucaagaaaauuaucgagauugagaagcccaucgaaacaaaagaguga

SEQ ID NO: 11461 - RNA, 3378 nt, Artificial Sequence
  Cas13b variant__Prevotella pallens__EGQ18444.1__Cas13b
augaaggaggaagagaaaggcaagacccccguggucagcacauacaacaaagacgauaagcacuucugggccgcuuuucugaaucucgccagacauaacguuuauaucacggugaaucacauuaacaaaauccugggggaaggagagauuaaucgggacggcuacgaaaacacccuugagaaguccuggaaugagaucaaggauauuaacaaaaaggaccgccugucuaaacucaucaucaagcauuucccuuuucuggaagugacaaccuaucagagaaauagcgcggauacaaccaaacaaaaggaggaaaagcaggcugaggcccagucccuugagucucugaaaaagagcuucuuugucuucauuuacaaacuccgggaccugcgcaaccacuauucccauuacaagcacucuaaaagccuggaaagaccgaaguuugaggaagaucuccaggagaaaauguauaauaucuucgacgccuccauucaacuggugaaggaagauuacaagcacaacacagacaucaaaaccgaggaggauuuuaagcaucuugaccggaaagggcaguucaaguacagcuuugcugauaaugaaggaaacauuacggagucuggccuccuguucuuuguuucccuguuccuugagaaaaaggacgccaucugggugcagaagaaacuggaaggguucaagugcagcaaugaaucuuaucagaaaaugaccaacgaggucuuuugucgcuccagaaugcuccugcccaagcugcggcuccaaagcacacagacccaggacuggauucugcuugauaugcugaacgagcucauccgcugcccuaaaucucuguacgaaagacuucgggaggaagaccgcaagaaguucagagugcccaucgagauugcugaugaagacuaugaugccgagcaggagccuuuuaaaaaugcgcugguucggcaccaagaccgcuuccccuacuuugcccucagauauuucgauuacaacgaaaucuuuacaaaucugcgguuccagauugaccugggaaccuaucauuuuuccaucuacaagaaacagauuggcgauuacaaggagagccaccaccucacgcauaaacuguauggcuucgaaagaauccaagaguuuacaaagcagaaccgcccugacgaguggcggaaguucgugaaaaccuuuaauuccuucgaaacaucuaaggagccguacauccccgaaaccaccccucacuaucaucuugagaaccagaaaauugggaucagauuccgcaaugauaacgacaagauuuggcccagccugaaaacaaauuccgaaaagaacgagaaaagcaaguacaagcucgacaaaucuuuucaggcugaggccuuccuguccguccacgaacuucugccuaugauguuuuauuaccuccugcugaagacggagaauaccgauaacgacaaugaaaucgagaccaaaaagaaagaaaacaagaaugauaagcaagagaaacauaagauugaggaaaucaucgagaacaaaauuacagaaaucuaugcucucuacgacgccuucgcgaacggaaagauuaauagcaucgauaaacuggaggaauacuguaagggcaaggacauugagaucgggcaccuucccaaacagaugauugccauccugaagucugagcacaaagauauggcuacagaagccaagcggaaacaggaggaaaugcucgcugacgugcaaaagagccuggagucccuggauaaccagaucaaugaggaaauugagaacguggaaagaaagaacucuagccuuaaauccggagagaucgccagcuggcucgucaaugacaugaugcgcuuucagccgguucagaaggauaaugaaggcaacccucugaauaacucuaaagccaauuccaccgaguaucagaugcugcaacggagccucgcucuguacaacaaggaggaaaaacccacgagauauuuccgccaggugaaucuuauugagucuuccaacccucaucccuuucugaauaacacagaaugggagaagugcaacaauauccucagcuucuaccgguccuaucuggaagcgaaaaagaacuuucuggagucucuuaagcccgaggacugggagaaaaaucaguacuuccucaugcugaaggaaccuaaaaccaacugugaaacccuggugcagggguggaagaauggauuuaaccucccgagaggcauuuucacagagcccauccgcaaaugguuuauggaacaccggaagaauaucaccgucgccgagcugaagagagugggccuuguugcuaaagugauuccucuguucuucagcgaggaauauaaggauuccguccaacccuuuuacaacuaccucuucaauguggggaacaucaauaaaccugacgagaagaacuuucugaauugcgaggaacggcgcgagcugcuucggaaaaagaaggacgaguucaaaaagaugacagauaaagaaaaggaagagaaccccucuuaucucgaauuucagagcuggaauaaauucgagagagagcugagacugguucgcaaccaggacauugugacguggcuccuguguauggaacuuuuuaacaagaagaaaaucaaggagcugaaugucgagaaaauuuaccucaagaacaucaauaccaacacaaccaaaaaggaaaagaauacagaagagaaaaacggagaggaaaagaucauuaaagagaagaauaacauccugaaucggauuaugccgaugagacugccuaucaaaguguauggccgcgaaaacuucuccaagaauaaaaagaagaaaauuagacggaacaccuuuuucacggucuacaucgaggaaaaggggaccaaacuucucaagcaaggaaauuuuaaagcccuggagcgcgauagacggcugggcggacucuucagcuucgugaagacacauucuaaggccgaguccaaaagcaacaccaucucuaagucccgcguugaauaugagcugggggaauaccagaaagcuagaauugagaucauuaaggacaugcuugcccuggaggaaacacucaucgauaaauauaauagccuggacaccgauaacuuucacaauaugcugacgggcuggcuuaagcugaaggacgagcccgauaaagcgucuuuccagaacgacguggaucuccugauugcuguccggaacgccuuuagccacaaucaguacccuaugcgcaacagaaucgccuucgcuaauauuaaccccuuuucccucagcucugccaauacauccgaagagaagggccuggggaucgcuaaccaacuuaaagacaagacccauaaaacaaucgaaaagauuaucgagauugagaagccuaucgaaaccaaagaguga

SEQ ID NO: 11462 - RNA, 3453 nt, Artificial Sequence
  Cas13b variant__Prevotella saccharolytica__EKY00089.1__Cas13b
augauggagaaggaaaacgugcagggcagccacaucuacuaugagcccaccgacaaaugcuucugggccgcuuuuuacaaucuggccagacauaacgcguaucucacaauugcucacaucaauuccuucgucaacucuaagaaagggauuaauaacgaugacaagguucuggauaucauugacgauuggagcaaauuugacaaugaucuucugaugggagcccggcucaacaagcugauccuuaagcauuucccuuuucugaaagccccgcucuaccaacuggcuaagcgcaaaacgagaaagcagcagggcaaagaacagcaagacuaugagaagaagggggaugaagaccccgaggugauccaggaggccauugcuaaugccuucaaaauggcgaacgugcggaagacccugcacgccuuucucaaacagcuggaagaucuucgcaaucauuucucccacuacaacuauaauucuccugcuaagaaaauggaggucaaguuugacgauggauucuguaacaaacuguacuacguguuugacgccgcucuccagaugguuaaggacgauaauagaaugaaccccgaaaucaacaugcaaacagacuucgagcaccuggugcggcuuggccgcaauagaaagauuccuaacaccuuuaaauauaauuucacaaacagcgaugggaccaucaauaacaauggacugcuguucuuugucucccuguuccuggagaagcgggacgccauuuggaugcagaaaaagaucaaaggcuuuaagggcgggacagaaaacuacaugcgcaugaccaaugagguguucugcagaaaccggaugguuauucccaagcuccgccuggaaacggauuaugacaaucaucagcuuauguuugauaugcugaacgagcucgugagauguccucugucucuuuacaaacggcugaagcaggaagaccaagauaaauuccgcgucccgaucgaguuucucgacgaggauaaugaagcggacaaccccuaucaggagaaugccaacagcgacgaaaacccuaccgaggaaacagauccccugaagaauacccuggugagacaccagcaucgguucccuuacuuugugcucagauauuucgaccugaacgaggucuuuaaacaacuucgcuuccagaucaaucugggaugcuaccacuuuuccauuuacgauaagacaaucggcgagcggaccgaaaagagacaccucacgcgcacacuguucggguucgaccggcuucagaacuuuagcguuaaacugcagcccgagcauuggaagaauauggugaaacaccucgauaccgaagagucuuccgacaagccguaucugagcgaugcuaugccucauuaccaaauugaaaacgagaaaaucggcauucacuuccugaagacagacaccgagaagaaagaaaccguguggcccucucucgaggucgaagagguguccagcaauagaaacaaguauaaaucugagaagaaucugacagccgaugcuuuucuuuccacgcaugaacugcucccuaugauguucuacuaucagcugcugagcuccgaggaaaagacccgcgccgccgcuggagacaagguucagggggugcuucagucuuaccggaaaaagaucuuugauaucuaugacgauuucgcgaacggaacaauuaauagcaugcaaaagcucgacgagagacuggccaaagacaaccugcuccgcggcaauaugccccagcagaugcuggcuauccuugaacaccaggagcccgauauggagcaaaaggccaaagaaaagcuggaccggcucauuaccgagaccaaaaagagaaucggcaagcuggaagaucaguuuaaacagaagguccgcauugggaaacggagagccgaccugccuaaggugggauccaucgcugauuggcuuguuaacgacaugaugcgguuccagccggccaaacgcaaugcggauaacacaggcgugcccgacagcaaggcuaacucuacggaguacagacuccugcaagaagcccuggccuuuuacuccgcuuauaaggaucggcucgagccuuacuucagacaggucaaucugaucgggggaacaaacccccacccuuuucuucaucgcguggacuggaaaaaguguaaucaccuccucagcuucuaucaugauuaccuggaggccaaagaacaguaucugucucaccuuagccccgcugacuggcaaaagcaccagcauuuucuccugcugaaaguccggaaggauauucagaacgagaagaaagacuggaagaaaucccucguggccggcuggaagaauggguucaaccugccgagaggacuuuucaccgaaucuaucaaaaccugguuuagcacagacgcggauaagguucagauuaccgacacaaaacuguucgagaaucgcgugggccucaucgccaagcugauuccucuguacuaugauaaggucuacaacgacaaaccccaaccuuuuuaccaguaucccuucaauaucaacgauagauacaagccugaagacacgcggaaacgcuuuaccgcugccuccagcaaacuuuggaaugagaaaaagaugcucuauaagaacgcucagcccgauucuuccgacaaaauugaguacccgcaguaucuggauuuccugagcuggaagaaacucgaaagagagcugcggaugcuucgcaaucaagacaugaugguguggcugaugugcaaggaucucuuugcccaguguacaguugaaggcguggaguucgcggaccugaaacugucucagcuugaggucgacgugaacgugcaggauaaucugaacguucucaacaaugucuccagcaugauccugccucucuccguguaccccucugacgcccaagggaacgugcugagaaauagcaagccccuucacaccgucuaugugcaggaaaacaauacaaagcugcucaaacagggaaacuuuaagucccugcugaaagaucggcgccuuaauggccuguucucuuuuaucgcugccgagggggaagaccuccaacagcauccucugaccaagaacagacucgaguacgaacugagcauuuaccagacgaugcggaucuccguuuucgagcagacccuucaacuggagaaagcuauucucacacgcaauaagacccugugcggaaacaauuucaacaaucugcuuaacagcuggucugaacacagaacagauaagaaaacccugcagccggacaucgauuuucucauugccgugcggaaugccuucucccauaaccaguaucccaugagcacgaauacagucaugcagggcaucgagaaguuuaacauccaaaccccuaaacuggaagagaaggacgggcucggcauugcuucucagcuggcgaaaaagacaaaggaugccgcuuccagacuucagaacaucauuaauggaggcaccaacuga

SEQ ID NO: 11463 - RNA, 3969 nt, Artificial Sequence
  Cas13b variant__Prevotella sp.__WP_036929175.1__Cas13b
augagcaaggagugcaaaaagcagagacaagagaaaaagcggcgccugcagaaagccaacuucuccaucucucucaccggcaagcacguguuuggggcuuacuucaauauggccagaacaaacuuugucaagacgauuaauuauauccugcccauugcgggaguucggggcaacuacagcgagaaucagaucaacaaaaugcuucaugcucuguuccucauucaggccgggcgcaaugaagaacugaccacagaacaaaagcagugggagaaaaagcucagacugaacccugagcagcagaccaaauuucaaaagcuccuguucaagcacuuuccggugcugggacccaugauggccgacguggcugaucauaaagccuaucucaauaagaaaaaguccacaguccagaccgaagacgagacauucgcuaugcugaaaggcgugucucuugccgauugucuggacaucaucugccucauggcggauacccugacggaaugucggaacuuuuacacccacaaggacccuuauaauaaacccagccagcuugccgaucaguaccugcaucaagagaugauugcuaagaagcucgacaaaguuguggucgccucccgcagaauccugaaggaucgggaggggcugucugugaacgaaguugaguuccucacaggaauugaccaucugcaccaggaagugcuuaaagaugaguuuggcaaugcuaaggucaaagacggcaaggugaugaagaccuucguggaauaugaugacuuuuacuucaaaaucagcgggaagcgccuggucaacggauacacaguuaccacgaaagacgauaagccugugaaugugaacacaaugcuccccgcccuguccgacuucggccuucuguauuuuugcguccucuuccugagcaaaccuuacgcgaagcuguuuauugaugaggugagacucuucgaguauucuccguuugacgauaaggaaaacaugaucauguccgagaugcugagcauuuaccggauccgcacccccagacuucacaaaaucgacucucacgauuccaaggccacacuggcuauggacauuuucggggaacuccggcgcuguccuauggagcuguauaaucuucuggauaaaaacgccggacagcccuuuuuccaugacgaaguuaagcacccuaauagccacacccccgaugugucuaaaagacuccgguacgacgacagauuuccgacccuggcucugcgcuauaucgaugagacagaacucuucaagcggauuagauuucaacugcagcuuggcuccuuccgcuacaaguuuuacgacaaagaaaacugcaucgaugggcgggucagagugcgccggauucagaaggagaucaauggauauggcagaaugcaggaaguugccgacaaacgcauggauaaguggggcgaccugauccaaaaacgggaggaaagaagcgugaagcucgagcaugaggaacuguacauuaaccuggaucaguuccuugaggacacggccgauuccaccccuuaugucacagaccgccggcccgcuuacaauauccacgcgaacagaauugggcucuauugggaagauucucagaauccuaaacaguacaagguguucgacgagaacggaauguauauccccgagcuggucgugaccgaagauaagaaagcccccauuaagaugccugcuccgcggugugcccugagcguuuacgaccuccccgccaugcuguuuuacgaguaucuucgcgaacaacaggacaaugaguucccuuccgcugaacaggugaucaucgaguacgaggaugacuauagaaaauuuuucaaggccgucgcggaaggcaaacugaagcccuuuaagcggccuaaagaguucagagauuuucucaagaaagaauaccccaagcugcgcauggcugacauuccgaaaaagcugcagcuuuuccucugcagccaugggcuguguuauaacaauaagccugagacaguguacgaacggcuggauagacucacccugcaacaccuugaggagcgcgaacugcauauccagaacagacucgagcacuaucagaaagaccgggauaugauuggaaauaaggacaaccaguacggcaaaaagucuuuuuccgauguucgccacggggcccuggccagauaccuggcucaaagcaugauggaauggcagcccacgaaacuuaaggacaaggagaaaggacaugauaagcucacaggccugaacuauaaugugcugaccgccuaccucgcuaccuauggccacccucagguccccgaagagggguucacaccucggacccuggagcaagugcuuaucaacgcccaucugauuggaggcucuaauccccacccguuuaucaacaaagugcucgcgcuggggaaucgcaacauugaggagcuguaccuucacuaucucgaagaggagcugaagcauaucagaagccggauccagucccugucuagcaauccuuccgacaaagcccucagcgcucugcccuucauucaccaugaucgcaugagauaccacgaacggacaucugaggaaaugauggcccuugcugcccgcuauacgaccauccagcugcccgacggacucuuuacaccuuacauucuggagauccugcagaagcauuacaccgaaaacuccgaccuucaaaaugcgcugagccaggauguuccggucaaacucaaccccacaugcaaugccgcuuaucugauuacccucuucuaccagacggugcugaaggacaacgcccagccuuucuaucuuucugauaagaccuacacaagaaauaaagacggcgagaaggcugaguccuuuagcuucaaacgggccuaugaacuguuuuccgugcucaacaauaacaagaaagauaccuuccccuuugagaugaucccucuguuccugacaucugacgaaauccaagagagacuuagcgccaagcugcucgauggggacggcaaccccgucccugaagugggagagaagggcaaacccgcuaccgauucccaggggaauacgauuuggaagcgccggaucuacucugagguugacgauuaugcggaaaaacugacagacagagacaugaagauuagcuuuaaaggagagugggaaaagcucccgcgcuggaagcaggauaaaaucauuaagcggagagacgagacccgccggcagaugagagaugaacugcuucaacgcaugccucgguacaucagagacaucaaagauaacgagcggacacugcgcagauacaagacccaggacauggugcuuuuccugcuggccgagaaaauguuuaccaauauuaucuccgaacagagcucugaguucaacuggaagcaaaugcggcuuuccaaggucuguaaugaggcuuuucugcgccagacacucacguucagagugcccguuaccgugggcgaaacaaccauuuaugucgagcaggaaaacaugagccugaaaaauuacggggaguucuaucgguuucucacagaugacagacugaugucucuucugaacaauaucguggaaacccugaagccuaacgagaauggagaucucguuauucgccacacggaccugauguccgaacuugccgccuacgaucaguaucggagcacaaucuucaugcugauccaaucuauugagaaccucaucauuaccaauaacgcugugcuggacgaucccgacgccgacggcuuuugggucagagaggaucucccgaaacgcaauaacuucgcgagccugcuugaacugaucaaccagcugaauaacguggagcucaccgacgaugaacggaagcugcuuguggcuauuagaaaugccuuuucccacaacagcuacaauaucgacuucucucugauuaaagaugucaagcaucucccugagguugccaaggggauccugcagcaccuccaguccaugcugggcguggaaaucacaaaauga

SEQ ID NO: 11464 - RNA, 3384 nt, Artificial Sequence
  Cas13b variant__Prevotella sp.__WP_007412163.1__Cas13b
augcagaagcaagacaaacuguucguggauagaaagaaaaacgccaucuuugcuuuccccaaguacauuaccaucauggagaaucaggaaaaaccugagccgauuuauuacgaacucacagacaagcacuuuugggccgcguuccugaaccuugcucggcauaaugucuauacgaccaucaaccacauuaaucgcagacuggagaucgccgaacucaaggaugacggcuacaugauggggaucaaaggaagcuggaacgagcaggccaagaaacuggauaagaaaguucggcuucgcgaccugauuaugaagcauuuucccuuccucgaggcugccgcuuaugaaaucacaaauuccaagucuccuaacaauaaagagcagagagaaaaggagcaaagcgaggcccugucccugaacaaucucaaaaacgugcuguuuauuuuccuugaaaagcuccaggugcuccggaauuacuauucucacuacaaauacagcgaggaaucccccaagccuaucuuugagaccucucugcuuaaaaacauguauaaggucuucgaugcgaaugugcgccugguuaagagagacuacaugcaucacgaaaacauugauaugcagcgggacuuuacacaccucaaccgcaaaaagcaagugggcagaaccaaaaauaucauugauagccccaacuuccauuaucacuuugccgacaaggaggggaauaugacaaucgcuggacugcuguucuucgucucccucuuucuggauaaaaaggacgccaucuggaugcaaaagaaacuuaagggcuucaaagacgggcggaaccugcgcgagcagaugaccaaugaaguguuuugcagaagccggauuucucucccuaagcugaaacuugagaacguucagacgaaggauuggaugcagcuggacaugcucaaugaacuggugcgcuguccgaagucccuguacgagagacuccgggaaaaagauagagagagcuucaagguccccuuugacaucuucucugaugacuaugaugcugaggaggaaccuuuuaaaaacacccuggugcgccaucaagaccgguuccccuacuuugugcuuagauauuucgaucugaaugaaauuuuugagcagcuccgcuuccagaucgaccugggaacauaccacuuuuccauuuacaacaagcggaucggcgaugaagacgaggucagacaccuuacccaucaccuguauggcuucgcccgcauccaagacuucgcgccucagaaucagcccgaggaauggcggaaacucguuaaggaucuggaccauuuugagacaagccaggaaccguacauuucuaagaccgccccucacuaucaucuggagaacgagaaaaucgggauuaaguucugcuccacgcacaauaaccucuuucccagccugaaaagagaaaagacauguaauggacgcuccaaauucaaccuuggcacccaauuuacagcugaggccuuccugucugugcacgaacuccugccuaugauguuuuacuaucugcuucucaccaaggauuacagccggaaagaguccgcugacaagguggaagggaucauuagaaaggagaucagcaacaucuaugccauuuacgaugccuucgcuaauaacgagaucaauucuauugcggaccugaccugccgccugcagaaaacaaacauccuccagggacaucugcccaagcagaugauuuccauccuugaaggccggcaaaaagauauggagaaggaagccgagagaaaaauuggggaaaugaucgacgauacgcagcggcgccuggaccuccuguguaagcagaccaaucagaagaucagaauuggaaaacggaacgcuggccugcuuaagagcggcaaaaucgccgauuggcucgucucugacaugaugagauuucaacccgugcagaaggauacaaauaacgccccuauuaauaacagcaaagcuaauuccaccgaguaccgcaugcugcagcacgcccuggcgcuguucgggucugagagcucccggcugaaggcuuauuuuagacagaugaaccuuguuggaaaugccaacccgcaucccuuccuggccgaaacacaaugggagcaccagaccaauauccucagcuuuuaccgcaacuaucuggaagcuagaaagaaauaccugaagggccuuaaaccucagaacuggaagcaauaucagcacuuccucauucugaaagugcagaagacgaaucggaacacacuggucaccggguggaaaaauucuuucaaccucccccgcggaaucuuuacccagccuaucagagagugguucgaaaagcauaauaacuccaagcggauuuacgaccaaauccugagcuuugaccgcgugggcuucguugccaaagcuauuccccuuuauuuugccgaggaguacaaggauaaugugcagccguucuacgacuauccuuuuaacaucgggaauaaacugaagccccagaaaggacaguuccucgauaagaaggaaagagucgagcuguggcagaaaaacaaggaacuguuuaaaaauuacccuucugagaagaacaaaacagaccuugcguaucucgauuuccuguccuggaagaaguuugagcgggaacugcgccucauuaaaaaucaggacaucgugaccuggcugauguucaaggagcuuuucaaaacaacgaccgucgaaggccugaagaucggcgagauucaccucagagauaucgacacaaacaccgccaaugaagagagcaacaacauucugaaucggaucaugcccaugaaacugccugugaagacauacgagaccgauaacaaggggaauauucuuaaagaacgcccccuggcuacguuuuauaucgaggaaaccgagacaaagguucucaaacagggaaacuucaaggugcuggccaaagacagacggcucaauggccugcuuuccuuugcugaaaccacagauaucgaccuggagaagaacccgauuaccaagcucucugucgauuacgagcugaucaaauaucagacgacaagaauuagcaucuucgaaaugacccuggggcuugagaagaaacugauugacaaguacuccacacucccuaccgacucuuuucgcaauaugcuggaacgguggcuccaaugcaaagccaacagacccgagcugaagaauuacgugaacagccuuaucgcgguucgcaaugccuucucccauaaccaguaucccauguacgaugcuacccuguuugccgaagugaagaaauucacacucuuuccuagcgucgacacgaagaaaauugagcugaauaucgcuccgcagcugcuugagaucgugggaaaggccauuaaagaaaucgagaagucugaaaacaaaaauuga

SEQ ID NO: 11465 - RNA, 3273 nt, Artificial Sequence
  Cas13b variant__Prevotella sp.__WP_044072147.1__Cas13b
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggagaaaacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccaggcuucucauuacaagaccuacgaugagaaacucaucgacggaugcgaguuucugacaagcaccgaacaaccucuguccggcaugauuaacaauuauuacacagucgcccuccgcaacaugaacgagagauauggguacaagaccgaagaucuggcuuucauccaggacaagcgguuuaaauucgugaaggaugccuauggcaaaaagaaaucucagguuaauacaggauuuuuccuuagccugcaggacuacaacggcgauacccaaaagaaacuccaccuguccggggugggaauugcgcuucugaucugucucuuucuggacaagcaguauauuaauaucuuccugagccgccuccccauuuucucuuccuacaacgcccagagcgaggaaagacggaucaucauucgcucuuuuggcaucaauuccauuaagcaaccuaaagauagaauccauagcgagaagucuaacaaauccgucgcuauggacaugcugaaugagauuaagcggugccccaacgaacuuuucgagacgcugagcgccgaaaaacagucccgcuuuagaaucaucucuaaugaccacaacgaggugcucaugaagcggagcuccgaucgcuucgugccucugcuucugcaguacauugacuaugggaagcucuuugaucacaucagauuccaugucaauaugggaaaacugcgguaccugcucaaggcugacaaaaccuguauugauggccagacaagaguucgcgugaucgaacaaccgcugaacggguuuggacggcuugaggagguggaaaccaugagaaagcaggagaauggcacauucggcaacagcgggauucgcauccgggacuuugaaaauaugaaaagagaugacgccaaccccgcgaacuauccuuacaucgucgauaccuauacgcacuacauucuggagaauaacaagguggaaauguucaucucugacgaggagacacccgccccucuccugcccguuauugaagaugaccgcuauguggucaagaccaucccguccugccggaugagcacacuugagauuccugcuauggccuuucauauguuccuguuuggaucuaaaaagaccgaaaaacucaucguggacguucacaauagauacaagcgccuguucaaagcuaugcagaaggaggaggugaccgccgaaaacauugccagcuucggcaucgcugaguccgaucugccccagaagaucauugaccucaucucugggaaugcgcacggaaaagaugucgacgccuuuauucggcugacaguggaugacaugcuugcugauacggaaagacgcaucaagcgguucaaagacgauagaaagagcauucgguccgccgacaacaaaaugggcaagcgcggguuuaaacaaaucagcaccggaaagcuggccgauuuccucgcuaaggacaucguccuguuucagccuucugugaaugauggcgagaacaaaauuacaggccugaauuacagaaucaugcaguccgccauugcgguuuauaacagcggggacgacuacgaagcuaagcagcaauucaaacuuauguuugagaaggcccggcucaucggaaaaggcaccacagagccccaucccuuccuguauaagguguuugucagaucuauuccugccaaugcuguggauuucuacgaacgcuaucugaucgagcggaaguuuuaccucaucgggcuguccaacgaaauuaaaaagggaaauagaguugacgugccguucauccgcagagaucagaacaaauggaagacccccgccaugaaaacgcuuggccggauuuaugacgaggaucugccugucgaacucccccgccagauguuugacaaugagaucaagagccaccugaagucccugccucagauggaggggauugauuucaacaacgcuaaugugacauaccuuaucgccgaauacaugaaaagagugcucaacgacgauuuccaaaccuuuuaucaguggaagcggaauuaccgcuauauggacaugcugagaggcgaguacgaucggaaaggaucucugcagagcuguuucaccuccguugaagaacgcgaaggccucuggaaggagagagcgucucggacagagcgcuauagaaaacuggccagcaacaagauccgguccaauagacaaaugcgcaacgcuagcucugaagagauugaaaccauccuugacaagcggcuguccaauagcagaaacgaguaccagaaaucugagaaggucauucgccgguauagagugcaggaugcccuccuguuucugcuugcuaaaaagacacucacggaacuggccgacuucgacggggagcgcuuuaaacugaaggaaaucaugcccgaugcggagaaaggcauucucuccgaaaucaugccgaugagcuucaccuuugagaagggagggaagaaauacacaauuaccucugagggaaugaagcugaaaaauuacggcgacuucuuugugcuugccagcgauaagcggaucgggaaccugcucgaacuggucggcuccgacacagugagcaaagaggauaucauggaagaguucaagaaguaugaccagugcagaccugaaauuucuuccaucguuuuuaaucuggagaaaugggcuuucgauaccuaccccgagcuuagcgcccgcguggaccgggaagagaaggucgauuucaaauccauucucaagauccugcugaacaauaaaaacauuaauaaggaacaaucugacauccucagaaagauccggaacgcuuuugaucauaacaauuauccugacaaaggagugguugagauucgcgcccugcccgaaaucgccaugagcauuaagaaggcuuucggcgaguacgcgaucaugaaauga

SEQ ID NO: 11466 - RNA, 3273 nt, Artificial Sequence
  Cas13b variant__Prevotella sp.__WP_042518169.1__Cas13b
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggaaaagacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaaccauuacaagacauacgaggagaaacugaucgauggaugcgaauuucugaccucuacagagcagccucucagcggcaugauuuccaaguauuacaccgucgcucugcgcaauacaaaggaaagauauggguacaaaaccgaggaccuugccuucauccaagauaacauuaagaaaaucacgaaggacgcuuauggaaaacggaagucucaggugaacaccggcuuuuuccugagccuccaggauuacaauggcgacacacagaaaaagcugcaccuuuccgggguuggaauugcccugcucaucugucuguuucuggauaagcaauauauuaacaucuuccucagccgccugcccaucuuuucuuccuacaaugcgcagagcgaagagagacggauuaucauucgcucuuucggcaucaacuccauuaaacuuccuaaggacagaauccauagcgagaaaucuaauaaguccguggccauggauaugcugaacgaagucaaacggugccccgacgaacucuucaccacacugagcgcugaaaagcagucccgcuuuagaaucauuucugacgaucacaaugaggugcuuaugaagcggagcaccgaccgcuucgugccucugcuccugcaauacaucgauuaugggaaacuguuugaccacauuagauuccaugucaacaugggaaagcuccgguaccugcuuaaagccgauaagacguguaucgacggccagacaagaguucgcgugauugaacagccgcugaauggguuuggacggcucgaggaggcugaaaccaugagaaaacaggagaacggcacauucggcaauuccgggauccgcauccgggauuuugaaaacgugaagagagacgaugccaaucccgcgaacuauccuuacauugucgacaccuauacccacuacauccuggagaauaacaagguggaaauguucauuagcgauaaaggaucuuccgcuccccuucugccucucaucgaggacgaccgcuauguugugaagacaauucccagcugccggaugucuacgcuggagaucccggccauggccuuucauauguuccuguuuggcagcaaaaagaccgaaaaacucauugucgaugugcacaacagauacaagcgccuguuccaagcuaugcagaaggaggaaguuacagccgagaauaucgccuccuuugggaucgcugagucugaccuuccucagaaaauucuggaucucaucagcggaaacgcgcacggcaaggacguggaugccuucauucggcugaccgucgacgauaugcugacagacaccgaaagacgcaucaaacgguucaaggaugacagaaaauccauucggagcgcugauaauaagauggggaaacgcggauuuaagcagaucucuacgggcaaacuugccgacuuccucgccaaagauaucgugcuguuucaacccuccgucaacgacggcgagaauaagauuacagggcugaacuacagaaucaugcagagcgcuauugccguguaugacucuggagaugacuacgaagcgaaacagcaguucaagcucauguuugagaaagcucggcugaucggcaaggggaccaccgaaccucaucccuuccuuuauaagguuuuugccagauccauucccgccaaugcuguggauuucuacgagcgcuaucugaucgagcggaaauuuuaccucacaggacuguguaacgaaaucaagagaggcaaucgcgucgacgugccuuucauuagacgggaucaaaacaaauggaagaccccggccaugaaaacacuggggcgcaucuauagcgaggaccuucccguugaacucccuagacagauguuugauaaugagauuaagucccaccugaagucucugccccagauggaaggcaucgacuucaacaaugcuaacgugacguaccucauugccgaguacaugaaacggguccugaaugaugacuuucagaccuucuaucaauggaagcgcaacuaccauuauauggauaugcuuaaaggagaguacgacagaaagggcagccugcagcacugcuucacauccguggaggagcgggaagggcucuggaaagagcgcgcgucuagaaccgaacgguaucgcaagcuggccagcaacaagaucagauccaaucggcagaugagaaacgcuagcucugaggagaucgaaacaauucuggauaaacgccuuuccaauugucggaacgaguaccaaaagagcgaaaaagugaucagacgcuaucggguucaggacgcccuccuguuucugcucgcuaagaaaacccugacggagcuugccgacuucgauggagagagauuuaagcugaaagaaauuaugccugacgcggagaagggcauccucucugaaauuaugcccauguccuucaccuuugagaaagggggaaagaaguacacaaucaccagcgaaggcaugaaacugaagaauuacggggauuucuuuguccuggccucugacaaacgcauuggcaaccuucucgagcuggugggaagcgauaucguguccaaggaggacaucauggaagaguucaauaaguaugaucagugccggccggaaauuagcucuaucgucuuuaaccuggagaaaugggcuuucgacacauacccugaacucuccgccagaguggaucgcgaggagaagguugacuuuaaaagcauucugaagauccuucugaauaacaaaaauauuaacaaggaacaguccgauauccuccggaagaucagaaaugcuuucgaccauaacaauuaucccgacaaaggcauuguggagaucaaggcccugccugaaauugccaugucuaucaaaaaggcuuucggggaguacgcgauuaugaaauga

SEQ ID NO: 11467 - RNA, 3273 nt, Artificial Sequence
  Cas13b variant__Prevotella sp.__WP_044074780.1__Cas13b
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggaaaagacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaaccauuacaagacauacgaggagaaacugaucgauggaugcgaauuucugaccucuacagagcagccuuucagcggcaugauuuccaaguauuacaccgucgcucuccgcaauacaaaggaaagauauggguacaaagccgaggaccuggcuuuuauccaagauaaccgguauaaguucaccaaagacgccuacggaaagcgcaaaucucaggugaacacgggcagcuuucuuucccugcaggauuauaauggcgacaccacaaagaaacuccaccugagcgggguuggaauugcgcuucugaucugucucuuccuggauaagcaguacauuaaccuguuucucucuagacugcccaucuucuccagcuacaaugcccaaucugaggaacggcgcauuaucaucagauccuucggcauuaacagcaucaagcagccuaaagaccggauucauucugagaaguccaauaaaagcguggcuauggauaugcuuaacgaagucaagcgcugccccgacgagcuguuuaccacacucuccgccgaaaaacagucuagauuccggaucauuagcgacgaucacaaugaggugcugaugaagcgcuccagcgacagauuugugccucuucugcuccaauauaucgauuacgggaagcuguucgaccacauccgguuucaugucaacaugggaaaacugagauaucuccugaaggcugauaaaaccuguauugacggccagacgcgcguucgggugaucgaacagccgcuuaauggguucggaagacuggaggagguggaaacaaugcgcaagcaggagaacggcaccuuuggcaauucugggauucggaucagagauuucgaaaacaugaaacgcgacgaugccaaucccgcgaacuacccuuauauugucgagacauacacccacuauauccucgaaaauaacaagguggagauguuuaucuccgacgaggaaaaccccaccccucugcuucccguuauugaggaugaccgguacguggucaagacaaucccgagcugcagaaugucuacgcuggaaauuccugccauggcuuuccauauguuucucuucggaagcgagaaaaccgagaagcugaucauugacgugcacgaucgcuacaaacggcuguuucaagccaugcagaaggaagagguuacagcugaaaauaucgccuccuucggcauugccgagucugaccucccccagaaaaucauggaucugaucagcgggaacgcucacggaaaggacguggaugcguucauuagacuuaccgucgacgauaugcugacagacaccgaacgccggaucaagagauuuaaagaugaccggaaguccauucgcagcgccgauaauaaaaugggcaagagaggguucaaacagaucucuacgggaaagcucgcugacuuucuggccaaagauauugugcuguuccaaccuuccgucaacgacggcgagaauaagaucacaggccuuaacuaucggaucaugcagagcgccauugcuguguacgacucuggggaugacuaugaggccaagcagcaguuuaaacucauguucgaaaaggcgagacugaucggaaaaggcaccaccgagccccaucccuuucuguacaagguuuucgugcgcuccauuccugcuaaugccgucgauuuuuaugaacgguaccucaucgagagaaaauucuaucugauugggcuuagcaacgaaaucaagaagggaaaucgcguggacguuccguuuaucagacgggaucaaaacaaauggaagacacccgccaugaaaacccugggccgcauuuacuccgaggaccucccuguggagcugcccagacagauguucgauaaugaaaucaagucucaccugaaaagccuuccucagauggaggggauugacuuuaacaaugcuaacgucacauaccucaucgccgaauauaugaagcgggugcugaaugaugacuuccagacguucuaccaauggaagcgcaacuauagauacauggauaugcugcggggcgaguaugaccgcaaaggaucccuccagcauuguuuuaccucuauugaagagagagagggccuguggaaggaacgggcuagccgcacagagagauaccggaaacuugccuccaacaagaucagaagcaaucgccagaugcggaacgcgucuuccgaagagaucgagaccauucuggauaaaagacucagcaauugccgcaacgaauaucaaaagucugagaagaucauucggagauaccgcgugcaggacgcccugcuguuccuucucgcuaaaaagacacugaccgaacuggccgacuuugauggggagcgguucaaacucaaggaaaucaugcccgacgcugagaaaggcauucuguccgagaucaugccgaugagcuuuacguucgaaaagggagggaaaauuuacaccaucacaucuggaggcaugaaacuuaagaauuauggggacuuuuucguucuggccagcgauaaaagaaucggcaaccuccuggagcuggucggauccaauaccgugagcaaggaagauauuauggaggaauuuaaaaaguacgaccagugucgcccugagaucucuuccauuguguucaaccuugagaaaugggcguuugauacauaucccgaacucccugcccgggucgacagaaaggagaagguggauuucuggagcauccuggacguucuguccaauaacaaagauauuaauaacgaacagucuuacauccuccggaagauccgcaaugcuuucgaccacaacaauuaucccgacaaaggcauuguggagaucaaggcccugccugaaauugcuaugagcaucaaaaaggccuuuggggaguacgccauuaugaaguga

SEQ ID NO: 11468 - RNA, 3438 nt, Artificial Sequence
  Cas13b variant__Psychroflexus torquis__WP_015024765.1__Cas13b
auggagagcaucauuggccuggggcucuccuucaaccccuacaagaccgccgacaaacacuauuuuggaucuuuccugaaucuuguggaaaacaaucugaacgcugucuuugccgaguucaaggaaagaaucagcuacaaagcgaaggaugagaauauuuccucucucaucgaaaaacauuuuauugacaacaugagcaucguugauuaugagaagaagaucuccauucugaauggcuaccuuccuaucauugacuuccuggaugacgagcucgaaaacaaucugaacacacgggugaaaaauuuuaagaaaaacuucaucauucuggcugaggccaucgaaaagcuccgcgauuauuacacgcacuuuuaucaugacccgauuaccuucgaggauaauaaagagccccugcuugaacugcucgacgaggugcugcuuaagacaauccuggaugucaagaaaaaguaccucaaaaccgacaagacaaaagaaauccugaaggauucucugagagaggaaauggaccuccuggugauucggaaaaccgacgagcuucgcgagaagaagaaaacaaacccuaagauccagcacaccgauagcucccaaauuaaaaauagcaucuuuaacgacgccuuccaggggcugcucuacgaagauaagggaaacaauaaaaagacgcagguuucucauagagcuaagacccggcugaaccccaaagacauucacaagcaggaggaacgcgauuuugagaucccucuuuccacaagcggccugguguuccucaugucucuguuccuguccaaaaaggaaaucgaggacuuuaaaagcaauauuaagggguucaagggaaaagucgugaaggaugagaaccacaauucucucaaauauauggccacccauagaguuuacuccauccuggcuuuuaagggccuuaaauaucggauuaagacagacaccuucagcaaggaaacgcugaugaugcaaaugaucgaugagcucuccaaagugcccgacugcgucuaccagaaccugucugaaacaaagcagaaagauuuuauugaggacuggaaugaauauuucaaggacaacgaggagaauaccgaaaaccuugagaauagccgcguggugcacccugucaucagaaaacgguacgaagauaaguuuaacuauuucgccauccgcuuucuggacgaguucgcgaauuuuaaaacacucaaguuccagguuuuuaugggcuacuacauucaugaucaaagaaccaagaccaucgggacaacgaacauuaccacagagcggaccgugaaagaaaagaucaauguguucggaaaacuguccaagauggacaaccugaaaaagcacuucuuuagccagcucucugaugacgagaacacagauugggaguucuuuccgaaucccuccuauaacuuccugacccaggccgacaauagcccugcuaacaauauucccaucuaccuugaacugaagaaccagcaaauuaucaaagaaaaggaugccaucaaagcugaggucaaucagacgcagaaccgcaauccuaacaagcccucuaaaagagaccuccugaauaagauucugaagacauaugaggauuuucaccaaggcgacccgaccgccauccuuagccucaacgaaauuccugcgcugcugcaucucuuccuggugaaacccaauaacaagaccgggcagcagaucgagaauauuauccggaucaaaauugaaaagcaguuuaaagccaucaaccacccuuccaagaacaauaagggcauucccaaaucucuuuucgcugauacaaacguuagagugaaugccaucaagcugaaaaaggaccucgaggcugaacuggacaugcugaacaaaaagcauauugccuuuaaagagaaucaaaaggccagcuccaacuacgauaaacuucucaaagagcaccaguucacccccaagaauaaacgcccugaacugcggaaguaugucuuuuacaaaagcgagaagggagaagaggcuacauggcuggcgaacgacaucaagagauucaugccgaaagauuuuaagacgaaauggaaggggugucagcauucugaacuccagcgcaaacuggccuucuaugaccggcacaccaagcaagauaucaaggagcuucuguccggaugcgaguucgaccacagccuccuggauauuaaugcuuacuuucagaaagacaacuucgaagacuuuuucucuaaguaccuggagaauagaaucgaaacacuugagggcgugcucaaaaagcugcaugauuuuaaaaacgagcccaccccucugaagggcguuuucaagaauuguuuuaaauuccucaagcgccagaacuaugugacagaaucccccgagauuaucaaaaagcggauucuggccaaaccuaccuuucuucccagaggggucuucgaugaacgcccgacgaugaagaagggaaagaauccucugaaggacaaaaacgaguuugccgaaugguucguggaguaccucgagaacaaggauuaucagaaauucuacaaugcugaagaguaucggaugagagacgccgacuuuaagaaaaacgcggucaucaagaagcaaaaacugaaggauuucuacacccugcagauggugaauuaucuucucaaagaaguuuuuggcaaggacgagaugaaccugcagcugagcgaacucuuccagacacgccaagagcggcugaaacuucaggggaucgcuaagaagcagaugaauaaagagaccggagauuccucugaaaacacaagaaaucaaaccuacauuuggaacaaggacgugcccgucagcuuuuucaauggcaaagugacgaucgauaagguuaaacugaagaacauugggaaguacaaacgguaugagcgcgacgaaagagugaagacauuuaucggauacgaggucgaugaaaaauggaugauguaucucccucacaauuggaaggaccgguacuccgugaaacccauuaacgugaucgaucugcagauucaggaguaugaggaaaucagaucucaugagcugcuuaaggaaauccagaaucuggagcaauacauuuaugaccacaccacagauaagaacauccuccugcaggacggcaauccuaacuucaaaauguacguucucaauggccugcuuauugggaucaagcaggucaacauucccgacuuuaucgugcugaaacagaacaccaauuucgauaagaucgacuuuaccggaauugccagcugcuccgagcucgagaaaaagacaaucauucugaucgccauucgcaacaaauucgcucacaaucaacugccgaacaagaugaucuacgaucuugccaaugaauuucugaagaucgagaaaaacgaaacguaugcuaauuacuaucucaaggugcugaaaaagaugauuagcgaccucgccuga

SEQ ID NO: 11469 - RNA, 2847 nt, Artificial Sequence
  Cas13b variant__Riemerella anatipestifer__WP_049354263.1__Cas13b
auguucuuuagcuuccacaacgcucagagagugaucuuuaagcaucuguacaaggcuuucgacgccucccuccggauggucaaggaggauuauaaagcgcacuuuaccguuaaucugacacgcgacuucgcucaucuuaacagaaagggcaaaaauaagcaagauaaccccgacuuuaaucgguaccgcuucgaaaaggauggguuuuucacggagucuggacugcucuuuuucaccaaccuguuucuugacaaaagagaugccuauuggaugcugaagaaagugagcggcuucaaggccucccacaaacagcgggaaaagaugacaaccgagguguucugccgcucucggauucuccugccuaagcugagacucgaaagccgcuacgaccauaaucagaugcugcuugauaugcuguccgagcucucuagauguccgaaacugcuuuaugagaagcugagcgaagagaacaaaaagcacuuucaggucgaagcugacggguuccucgaugagaucgaggaggaacaaaaucccuuuaaagacacacugauucggcaccaggaucgcuucccuuacuuugcccugagauaucucgaccugaacgaauccuucaagagcauccgguuucagguggaccuuggaaccuaccauuacugcauuuaugauaaaaagaucggcgacgagcaggaaaagcgccaccugacaagaacccuccugucuuucgggcggcuucaagauuuuacggagaucaauagaccccaggaguggaaagcucugaccaaggaccucgauuacaaagaaacauccaaccagccuuucauuagcaagaccacaccccauuaucacaucaccgacaauaaaauuggauuucgccugggcacgucuaaggagcuguacccuucccucgaaaucaaggauggcgccaaccggauugcgaaauauccguacaauagcggguucguugcccacgcuuuuaucucugugcaugagcugcuuccccugauguucuaucagcaccucacaggaaaguccgaagaccugcuuaaagagaccgucagacauauucaacgcaucuacaaggauuucgaggaggaacggaucaacacaauugaagaccuggagaaagccaaccagggcagacucccucugggggcuuuucccaagcagaugcugggacuccugcaaaauaagcagccugaucuuagcgaaaaagccaagaucaaaauugagaagcugaucgcggagaccaaacuccugucccaccgccugaacaccaaacuuaagucuagccccaaacucggcaagcggagagaaaaacugauuaagacaggggugcuggccgacuggcucguuaaagacuucaugcgcuuucagccgguggcuuacgaugcccagaaucaaccuaucaaguccagcaaagcuaacucuacggaguucugguuuauccggagagcccuggcccuuuauggaggcgaaaagaaucgccuggagggcuacuucaagcagaccaaccucauugggaauacaaacccccauccuuuucugaauaaauucaacuggaaggcuugucggaaucuggucgacuuuuaucagcaguaccuugagcaaagagaaaaauuccucgaggcgaucaagaaccagcccugggaacccuaucaguacugccugcugcucaaaauuccuaaggagaaucggaagaaccuggugaaaggaugggaacagggcgggaucucccuuccgcgcggacuguuuaccgaggccauuagagagacacucagcgaagaucugaugcugucuaagcccauccggaaagagaucaagaaacacggcagagugggguucauuagccgcgcuaucacccuuuauuuuaaggaaaaguaccaagacaaacaccaguccuucuacaaucucucuuauaagcuggaggccaaagccccucugcucaagcgggaggaacauuacgaguauuggcagcagaacaaaccccaaagcccuacggaaucccagagacuggagcuucacacaagcgaucgcuggaaggacuaccugcucuauaagagauggcagcaucuggagaaaaagcugcggcuuuaccgcaaccaagaugucaugcucuggcugaugacccuggaacucaccaaaaaucacuucaaggaacugaaccuuaauuaucaccagcugaaacucgagaaccuggcuguuaaugugcaggaggccgacgcgaagcugaacccccuuaaucagacacugccgauggugcucccugucaaaguguaccccgcuaccgccuuuggagaaguucaauaccauaagacaccuauuagaacgguguauauccgggaggaacacaccaaggcccugaaaaugggcaacuucaaggcucucgucaaagaucgcagacugaauggccuguuuucuuucauuaaggaggagaacgacacacagaaacaucccaucucccagcuucggcuccgcagagaacuggagauuuaccagagccugcggguggaugccuuuaaggaaacccuuucucuggaggaaaagcuccugaauaaacacacaucccucagcucccuggagaacgaguuccgcgcccuucuggaagaguggaagaaagaauaugcugcgucuagcaugguuaccgacgagcauaucgccuuuaucgcuuccgugagaaaugccuucugucacaaccaauacccuuuuuauaaggaagcucuccacgcccccauuccgcuguucacggucgcgcagccuaccacagaggagaaagaugggcugggaaucgccgaagcccuucugaaggugcuccgggaguacugcgaaauugucaagucucagaucuga

SEQ ID NO: 11470 - RNA, 3288 nt, Artificial Sequence
  Cas13b variant__Riemerella anatipestifer__WP_004919755.1__Cas13b
auggagaagccccugcucccuaacguguacacccugaaacacaaguucuuuuggggcgccuuccuuaauaucgcuagacauaacgccuuuauuacaaucugccacauuaaugaacagcuggggcucaaaacgccgagcaacgacgauaagaucgucgacguugugugugagaccuggaauaacauucugaauaacgaucaugaccuucugaaaaagucccaacucacagaacugauccugaagcacuuccccuuucucaccgcgaugugcuaucauccucccaaaaaggagggaaagaagaaaggccaccagaaggaacagcagaaggagaaagagucugaagcucaaagccaggccgaggcccugaauccuuccaaacuuaucgaagcucuggagauucucgugaaccagcugcacucucuucggaauuacuauagccauuacaaacacaagaaacccgaugccgagaaggacaucuucaaacaucuguauaaggcuuuugaugccucccuccgcauggucaaggaagacuacaaagcgcacuucacagugaaccugaccagagauuuugcccaccugaaucggaaggggaaaaacaagcaggacaauccugauuucaaccgcuauagauuugagaaagacggauucuuuacagaaucuggccuccuguucuucaccaaccuuuuucuggauaagcgggacgcuuacuggaugcucaagaaaguuagcggguucaaggccucccauaaacaacgcgagaagaugacgaccgaaguguuuuguagaagccggauucugcuuccgaaacugcgccucgagucuagauacgaccacaaucagaugcugcuggauaugcucuccgagcugagccggugccccaaacuucuguaugaaaagcucucugaggaaaacaaaaagcauuuccaggucgaggcugacggauuucuggaugaaaucgaggaggaacagaauccuuucaaagacacacuuauucgccaccaagauagauuucccuacuucgcccugcgguaucucgaccugaacgaguccuuuaagagcauccgcuuccagguggaucugggcaccuaccauuauuguauuuacgacaaaaagaucggcgaugaacaggagaagagacaccucacacggacccugcuuucuuuugggagacugcaagacuucacggaaaucaaucgcccucaggaguggaaagcgcucacaaaggaucuggacuauaaagagaccuccaaccagcccuuuauuagcaagacaaccccgcacuaccauaucaccgacaauaaaauuggauuccggcugggcacauccaaggaacuuuacccuucucucgagaucaaagauggggccaacagaauugcuaaguaucccuacaauagcggauucguugcccacgcuuuuaucuccgugcaugaacugcugccucucauguucuaucagcaccugacgggcaagagcgaggaccuucugaaagagaccguccgccacauccaacggauuuacaaggauuuugaagaggaaagaaucaacacaauugaggaccucgaaaaagccaaucaggggcgccugccccugggagccuuccccaagcagaugcuuggccuccugcagaacaaacaaccugaucugucugagaaggcuaagaucaaaauugagaagcucaucgcggaaaccaaacugcuuucccaucggcugaauacaaagcucaaaagcucuccgaagcugggcaagagacgcgagaaacugaucaagaccggggugcuugccgacuggcucgugaaagauuuuaugcgguuccagcccgucgcuuaugacgcccagaaccagccuauuaagagcuccaaagccaauucuacggaauuuugguucaucagacgcgcucuggcccuguacggaggcgagaagaaccggcucgaaggguauuuuaagcaaacaaaccugauuggaaauaccaacccccacccuuuccuuaauaaauuuaacuggaaggcgugcagaaaucugguugauuucuaccagcaguaccucgagcagcgggagaaauuucuggaagcuaucaagaaccaacccugggagccguaucaguacugucugcuucucaaaauuccuaaggaaaaucgcaaaaaccuggugaagggcugggagcaagggggaaucagccugcccagaggccucuucaccgaagccauucgggagacacuguccgaggaccuuaugcugagcaagccuaucagaaaagaaaucaagaaacauggccgcgugggguucauuucucgggccaucacccucuauuuuaaggagaaauaccaggauaagcaccaguccuucuauaaucugagcuacaagcuggaagcuaaagcuccccuucugaagagagaggagcauuaugaauacuggcagcagaacaaaccucaaucucccacagagucccagcgccucgaacugcacacgagcgacagauggaaggauuaccuccuguauaaacgguggcagcaccuugagaagaagcugcgccucuacagaaaucaggacgucaugcuguggcugaugacccuugaacugacaaagaaccauuuuaaggagcucaaucugaacuaucaccaacucaaacuggagaaucuugccgugaacguucaggaagccgacgcgaagcugaacccgcucaaucagacccugccuauggugcugcccgucaaaguguaccccgccacagcuuucggagagguucaguaucauaagaccccuauucggacgguguacauccgcgaggaacacaccaaggcccuuaaaaugggcaacuuuaaggcucuggucaaagauagacggcucaaugggcuguucuccuuuauuaaggaagagaacgacacacaaaaacauccgaucucucagcuccgccugagacgggagcuugaaaucuaucagagccugcgcguggaugccuucaaggagacccugucccucgaagagaagcugcuuaauaaacacacaucucugagcucccucgaaaacgaguuuagagcgcugcucgaggaauggaagaaagaguacgccgcuagcucuauggucaccgacgaacacauugccuucaucgcuuccgugcggaaugccuuuugccauaaccaauaccccuucuauaaggaggcccugcacgcuccuauuccccuuuucacgguugcgcagccuacaaccgaggaaaaagauggacugggcaucgccgaggcucugcucaaggugcugagagaauacugugagauugucaaaagccagaucuga

SEQ ID NO: 11471 - RNA, 3288 nt, Artificial Sequence
  Cas13b variant__Riemerella anatipestifer__WP_064970887.1__Cas13b
auggagaagccccugccuccgaacguguacacccucaaacacaaguucuuuuggggcgccuuccugaauaucgcuagacauaacgccuuuauuacaaucugccacauuaaugaacagcuugggcugacgacacccccuaacgacgauaaaaucgcggacgucguuuguggaaccuggaauaacauucucaauaacgaucaugaccugcuuaagaaaagccaacugaccgagcucauccugaagcacuuccccuuucuggcugccaugugcuaucauccucccaagaaagaaggcaagaaaaaggggucccagaaagagcagcagaaggaaaaggagaaugaggcccaaucucaggcugaagcccucaacccuagcgagcugaucaaagugcuuaagacacuggugaaacagcuccggacccugcgcaauuacuauucccaccacucucauaagaaaccggaugcugaaaaggacauuuucaaacaccuuuacaaggccuuugaugcgagccugagaauggucaaggaggacuauaaagcccauuucacagugaaccucacccaggauuuugcucaccugaaucggaaggggaaaaacaagcaagacaaucccgauuucgaccgcuacagauuugagaaagauggcuucuuuacggaauccgggcuccuguucuucaccaaccuguuucuugacaagcgggacgccuauuggaugcugaagaaaguuucuggauucaaggcuagccacaaacaguccgagaagaugacaaccgaaguguuuugucgcagcagaauccuccugccuaaacuucggcuggagucucgcuacgaucauaaccagaugcuccuggacaugcuguccgaacucagcagauaccccaagcugcuuuaugagaagcugucugaggaagauaaaaagcgguuccaggucgaggccgacggcuuucucgaugaaauugaggaggaacaaaauccuuucaaagacacacugauccgccaccaggauagauuucccuacuucgcgcuucgguaucuggaccucaacgaguccuuuaagagcauucgcuuccagguggaucugggcaccuaccauuauugcaucuacgacaaaaagauuggggaugaacaagagaagagacaccugacgcggacacuccugucuuuuggaagacuucaggacuucaccgaaaucaaucgcccgcaggaguggaaagcccugacaaaggaccucgauuauaaagaaaccuccaagcagccuuuuaucagcaaaaccacaccccauuaccacauuacggacaacaagaucggcuuccggcuggggaccuccaaagagcuguacccuucucuugagguuaaggauggagcuaauagaauugcccaauaucccuacaacagcgacuucguggcucacgccuuuaucuccguccaugaacuccugccccugauguucuaucagcaccucacaggcaagagcgaggaucugcuuaaagaaaccgugcgccauauucagcggaucuacaaggacuuugaggaggaaagaaucaauacaauugaggaucuggaaaaagccaaccaggggcgccucccucugggagcuuucccgaagcaaaugcugggccuucuccagaauaaacagcccgaccugucugagaaggcgaagaucaaaauugaaaagcugaucgccgagaccaaacuccugucccaccggcuuaacacgaagcugaaaagcucuccuaagcucggcaagagacgcgagaaacugauuaagacaggggugcuggcugauuggcuugucaaagacuuuaugcgguuccagcccguugccuaugaugcccaaaaucagccuaucgaaagcuccaaggcuaacucuaccgaguuucagcucauccagagagcccuggcgcuguacggaggcgagaaaaaucgccucgaaggguauuucaagcaaaccaaccugauuggaaauacaaacccccacccguuucuuaacaaguucaauuggaaggcuugucggaaccugguggacuuuuaccagcaguaccucgaacaaagagagaaauuccuggaggccaucaaaaaucagccuugggaacccuaucaguacugccugcuucucaagauuccuaaagagaaccggaagaaucuggugaaaggcugggaacagggaggaaucagccugccccgcggccucuuuaccgaggccauuagagaaacacuguccaaggaucuuacgcugagcaagccuauccggaaagagauuaagaaacauggcagagucggguucaucucucgcgcuaucacccucuauuuccgggagaaguaccaagacgaccaccaguccuuuuaugaucugcccuacaaacuggaagccaaggcuagcccgcuuccuaagaaagagcauuaugaauacuggcagcagaacaagccccaaucucccacagagcugcagagacucgagcugcacaccuccgaccgcuggaaagauuaccuccuguauaagagauggcagcaucuugagaaaaagcugcggcucuaccgcaaucaggacgugaugcuguggcugaugacacuugaacugaccaagaaccacuucaaagaacucaaucugaacuaucaccaacucaagcuggagaaucuugccguuaacgugcaggaagcggaugccaaacugaauccucucaaccagacgcugccgaugguccugcccgugaagguuuacccugcuaccgccuuuggagaggugcaauaucaggagacacccauuagaaccgucuacauccgggaggaacagacaaaagcucuuaagaugggcaauuucaaggcccuggugaaagaccgcagacucaacgggcuguuuagcuucauuaaggaagagaacgauacccagaaacauccuaucucccaacuccggcugcgcagagaacuugagauuuaucagucucugcgggucgacgcguuuaaggagacgcugaaucucgaagagaaacugcuuaagaagcacacaagccuguccucuguggaaaacaaauuccgcauccuccuggaggaauggaagaaagaguacgccgcuagcuccaugguuaccgaugagcauaucgccuuuauugcuagcgugagaaaugccuucugucacaaccaguaccccuuuuaugaagaggcccuccaugcuccuaucccccuguucacagucgcgcagcaaaccaccgaagagaaggacggacuuggcauugccgaggcucugcugcgggugcucagagaauacugcgagaucguuaaaucucagauuuga

SEQ ID NO: 11472 - RNA, 2853 nt, Artificial Sequence
  Cas13b variant__Riemerella anatipestifer__WP_061710138.1__Cas13b
auguucuuuagcuuccacaacgcccagagagugaucuuuaagcaucuguacaaggcuuucgacgccucccuccggauggucaaggaggauuauaaagcgcacuuuaccguuaaucugacacgcgacuucgcucaucuuaacagaaagggcaaaaauaagcaagauaaccccgacuuuaaucgguaccgcuucgaaaaggauggguuuuucacggagucuggacugcucuuuuucaccaaccuguuucuugacaaaagagaugccuauuggaugcugaagaaagugagcggcuucaaggccucccacaaacagucugaaaagaugacaaccgagguguucugccggagccgcauucuccugccuaagcugagacucgaaucccgguacgaccauaaucagaugcugcuugauaugcugucugagcucagccgcuguccgaaacugcuuuaugagaagcuguccgaaaaagacaagaaaugcuuucaggucgaggcugauggguuccucgacgaaaucgaggaggaacaaaaccccuuuaaggauacacugauuagacaccaggaccgguucccuuacuuugcccugcgcuaucucgaccugaaugagagcuucaaaucuaucagauuucagguggaucuuggaaccuaccacuacuguauuuaugacaagaagaucggcuacgaacaggagaaacggcaucugacacgcacccuccugaacuucgggagacuucaagauuuuacggaaaucaaucggccccaggaguggaaggcucugaccaaagaccucgauuauaacgagacauccaaucagccuuucauuagcaagaccacaccccacuaccauaucaccgacaacaaaauuggauuuagacugcgcacgucuaaggaacuguauccuucccucgagguuaaggauggcgccaaucggaucgcgaaauacccguauaacagcgacuucguggcccacgcuuuuauuucuaucuccguccacgaacugcuuccccugauguucuaccagcaucucacaggcaagagcgaggaucugcuuaaagaaaccgugagacacauucaacgcaucuacaaggacuucgaggaggaacggaucaacacaauugaggaucuggaaaaagccaaucaggggagacucccucugggagcuuuucccaagcagaugcugggccuccugcaaaacaagcagccugaccuuuccgagaaagccaagaucaaaauugaaaagcugaucgcggagaccaaacuccugucucaucgccugaauaccaaacuuaagagcucccccaaacucgggaagcggagagagaaacugauuaagacaggaguucuggccgacuggcucgugaaagauuucaugcgcuuucagccggucguguaugacgcucagaaccaaccuaucaagagcucuaaagccaauuccacggaaagccggcugaucagacgcgcucuugcccuguacggcggggagaagaaccggcucgaaggauauuucaagcagaccaaucugauuggcaacacaaauccccacccuuuucugaacaaauucaauuggaaggccugcagaaaccuuguggauuuuuaccagcaguaucucgagcaacgggagaaauuccuggaagcuaucaagcaucagcccugggagcccuaccaguauugucugcuccugaaagucccuaaggaaaaucgcaagaaccuuguuaaaggcugggagcaagggggaauuucucugccgagaggccucuuuaccgaagcgauccgggagacacugagcaaggaccugacccuuuccaaacccauuagaaaggagaucaaaaagcacgggcgcgugggauucaucucucgggccauuacgcucuacuuuaaggaaaaauaccaggauaagcaccagagcuucuauaaucuguccuacaaacuggaggcuaaggccccucuccugaaaaaggaggaacauuaugaauacuggcagcagaacaagccccaaagcccuacagagucucagagacuugagcugcacaccuccgaccgcuggaaagauuaucuccuguacaagagauggcagcaucuggaaaagaaacuucggcucuaucgcaaccaagacaucaugcuguggcugaugacccucgagcugacaaagaaucacuuuaaggaacuuaaccugaauuaccaccagcucaaacuggagaaccuggccgugaauguccaggaagcugaugccaaacuuaacccccugaaucagacccucccgauggugcugccuguuaagguguaccccacaacggcguucggcgagguccaauaucaugagaccccuauuagaacaguguacauccgggaggaacagaccaaagcucucaagauggggaacuucaaagcccugguuaaggaccgccaccuuaauggacuguuuagcuucauuaaagaagagaacgauacacagaagcaucccaucucucagcucagacugcggcgcgagcuggaaauuuaucaaucccuuagaguggacgccuuuaaggagacccugagccucgaagagaaacugcucaauaagcacgcuucccugucuagccuugaaaacgaguuccggacgcugcucgaggaauggaaaaagaaauacgccgcuuccucuauggucaccgauaagcauaucgccuuuaucgcgagcgugcgcaaugccuucugccacaaccaguauccuuuuuacaaggagacacugcacgcucccauucugcuuuucaccgucgcccagccgacaaccgaagagaaagacggccugggcaucgcugaagcccuccugagagugcuccgggaguauugugagauuguuaagucccagaucuga

SEQ ID NO: 11473 - RNA, 2850 nt, Artificial Sequence
  ARMAN Cas9 variant__Candidatus Micrarchaeum acidiphilum__OJI07263.1__Cas9
augagagacagcaucaccgcuccccgguacuccucugcccuggccgcgcgcauuaaggaguucaacagcgcuuuuaaacucggcaucgaucuggggacaaagacgggaggcguggcccuugucaaagacaauaagguucugcucgccaaaaccuuccuggauuaucacaagcagacacuugaagagagacggauucaucgcagaaaccggcgcuccagacuggcucggcgcaagagaaucgcccggcuccgcucuuggauucugagacaaaagaucuacgggaagcagcugccugacccguauaaaaucaagaaaaugcagcuccccaauggagugcggaagggcgaaaacuggauugaucugguggucagcgggcgcgaccuuuccccugaggcuuuugugagagccaucacccugauuuuccagaagcggggacaaagauacgaagagguugcgaaagagaucgaagagaugucuuauaaggaauuuagcacacacauuaaagcccucaccuccgugacagaggaggaguucaccgcucuggccgcugaaaucgaacgccggcaggaugucguggacacggauaaggaggccgaaagauacacccagcuuagcgagcugcucucuaaaguuuccgagagcaagucugaauccaaagaccgcgcgcagcggaaggaggaucugggcaagguggucaaugccuuuugcagcgcucauagaauugaagacaaagauaagugguguaaagagcugaugaagcuccuggaccgccccgugcggcacgccagauuccuuaacaaagugcugauccgcugcaauaucugugaccgggcuacaccuaagaagucuagacccgauguccgcgaacuccuguauuuugacaccguucggaacuuccuuaaagccggcagaguggagcaaaauccugaugugauuuccuacuacaagaaaaucuauauggacgccgaggucauucgggugaagauccugaacaaagaaaagcucacagaugaggacaagaaacagaagcgcaaacuggcuagcgaacugaauagauacaagaacaaagaguauguuaccgaugcgcagaagaagaugcaggaacaacucaaaacgcugcuuuuuaugaagcugacagggcgguccagauacugcauggcccaucucaaagagcgcgcugccggaaaggacguggaggaaggccugcacggggucgugcagaaacggcacgauagaaauauugcccagcgcaaccaugaccuuagaguuaucaaucugaucgagucucuccuguucgaucaaaacaagagccuguccgacgcuauucggaaaaacggacucauguaugugaccaucgaagccccggagcccaagacaaagcacgcgaaaaagggcgcugccgucgugcgcgacccuagaaaacugaaggagaaacuuuuugaugaccagaauggggucuguauuuacaccggacugcagcucgauaagcuggaaaucagcaaguaugagaaagaccauauuuuccccgauucucgggacggcccuuccauccgcgauaaccuggugcuuaccacaaaggaaaucaauagcgacaaaggcgauagaacgcccugggaguggaugcacgacaacccggaaaaguggaaagccuucgagcggcgcguugcugaguuuuacaagaaggggagaauuaaugaacggaaacgcgagcuccugcugaacaagggaaccgaauacccuggcgauaaucccacagagcucgccagagggggagcucgggugaacaauuucaucaccgaauuuaacgacagacugaaaacacacggcguccaggagcuucaaaccauuuucgagcgcaauaagccuaucgugcagguugugagaggggaagagacgcagcggcugcgccggcaguggaacgcccucaaucaaaacuuuauuccccugaaagauagagcgaugucuuucaaucaugccgaagacgcugccaucgcugccagcaugcccccuaaguuuuggcgcgagcagauuuaucggacagcguggcacuucggaccguccggcaacgaaagacccgacuuugcccuggcugagcuugccccucaguggaacgauuucuuuaugaccaagggcgggcccaucaucgcuguccucggaaaaaccaaguacucuuggaaacauagcauuaucgacgauacaauuuauaagccuuucuccaaaagcgccuacuaugugggcaucuacaagaaacccaaugccauuaccucuaacgcuaucaaggugcugcgcccgaagcugcucaauggggagcacacaauguccaaaaacgcgaaguauuaccaucagaaaaucggaaaugaacgguuucugaugaaaagccaaaaaggcgggucuauuaucacgguuaagccucacgacggccccgagaagguccuucagauuuccccuaccuacgaaugcgccgugcugacaaaacacgauggaaagaucauugugaaauucaagcccaucaaaccucucagagacauguaugcucggggcgucaucaaggccauggauaaggagcuggagaccagccuguccucuaugagcaaacaugccaaguacaaagaacuucacacacaugacauuaucuaucuccccgcuaccaagaaacacguggauggguacuucauuaucacgaagcuguccgccaagcacggaauuaaagcgcugccggagucuaugguuaaggugaaauauacccagaucggcagcgaaaacaauuccgaggucaagcucacaaaaccuaagcccgaaaucacccuggacagcgaggauauuacaaacaucuacaauuuuacccgcuga

SEQ ID NO: 11474 - RNA, 2904 nt, Artificial Sequence
  ARMAN Cas9 variant__Candidatus Parvarchaeum acidiphilum__APG80630.1__Cas9
augcugggcagcuccagauaccuccgguauaaccugaccucuuucgaggggaaggaacccuuucuuaucaugggauacuauaaagaguacaauaaggaacugagcuccaaagcccagaaggaguucaacgaccaaauuucugaauuuaauagcuauuacaaacucggcaucgaucugggggacaagacaggaauugcuaucgugaagggcaacaaaauuauccuugccaagacgcugaucgaucuccacucccagaaacuggacaagcgcagagaggcgcggcgcaauagacggacccgccugucuagaaagaagcggcucgcucgccugagaagcugggucaugcggcagaagguugggaaccagcgccuuccugauccguauaaaauuaugcaugacaauaaguacugguccaucuacaacaaaagcaauucugccaacaagaaaaauuggauugaucugcucauccacuccaacagccugucugccgacgauuucgugagaggacuuacaauuaucuuucggaagcgcggcuaucuggcuuucaaauaccucuccagacugagcgacaaggaguuugaaaaguauauugauaaucugaaacccccuaucucuaaguacgaguaugacgaagaucucgaggagcuguccagccggguggaaaacggcgagaucgaagagaaaaaguucgaagggcuuaaaaauaagcuggacaagauugacaaagaguccaaggauuuucaagucaaacagagagaggaagugaagaaagagcucgaagaccugguugaucuuuucgccaagucuguggacaacaagaucgauaaagcucgcuggaagcgggagcugaacaaucuccuggacaaaaaggucagaaaaauucgcuuugauaaccgguucauccugaagugcaagauuaaaggauguaauaagaacacccccaaaaaggaaaaagugagagacuuugagcucaagaugguucugaauaacgcccgcagcgauuaccagaucuccgacgaggaucuuaauagcuuccggaacgaagugaucaauauuuuccagaaaaaggagaaccugaagaaaggcgaacucaagggggucacaaucgaggaccugagaaaacaacuuaauaagaccuuuaacaaagcgaagauuaagaaaggaauccgcgaacagauucggucuaucguguucgagaagaucuccggcagaagcaaauuuugcaaggagcaucugaaagaguucucugagaagccugcccccagcgaccgcauuaauuauggggugaacuccgcucgggaacagcacgauuuuagaguccucaauuucaucgacaagaaaauuuuuaaggauaaacugaucgacccuucuaagcugcgguacauuacaaucgagagcccggagcccgaaaccgagaaacucgaaaagggacagauuuccgaaaagagcuucgaaacgcugaaagagaaacuugccaaagagaccggcggcaucgauaucuacacaggggaaaagcugaaaaaggacuuugagauugaacauaucuucccucgcgcuagaaugggacccucuauucgggagaacgaaguugccuccaaccucgagaccaauaaagagaaggcggauagaacaccuugggaaugguuuggccaagacgagaagcgcuggagcgaguucgagaaacgggugaacucucuguauuccaagaaaaagaucagcgaaagaaaacgcgagauucugcuuaauaaguccaacgaguaccccgggcucaauccgaccgaacugucuagaaucccuagcacgcuguccgauuuuguggagucuauccggaagauguucgucaaauauggauacgaagaaccccagacacucgugcagaagggcaaaccuauuauccaaguugugcgcgggagagacacccaggcccugcgguggcgcuggcacgcucuugauagcaacauuauccccgagaaggacagaaaauccagcuucaaucacgccgaagaugcugucauugccgccuguaugcccccuuauuaccugcggcagaagaucuuucgcgaggaagcuaagaucaaaagaaaggugucuaacaaagagaaggaaguuacacggccggacaugcccaccaaaaagauugcgccuaauugguccgaguucaugaagacccgcaacgagcccgugaucgaagucauuggaaaagugaagccuagcuggaaaaauucuaucauggaccagacauuuuauaaguaccuccugaaacccuucaaggauaaccugauuaagaucccgaaugucaaaaacacguacaaguggaucggcgugaauggccaaaccgacucccuuagccucccuucuaaaguucugagcauuuccaacaagaaaguggauagcucuacaguccugcucgugcaugacaagaaagggggaaagagaaacuggguucccaaguccaucggcgggcugcuuguguauauuaccccuaaagauggacccaagcggaucguccaggugaaaccugccacacagggccugcucauuuacagaaaugaggacgggcgcguggaugcuguucgggaauuuaucaaccccgucauugagauguauaauaacggcaagcuggccuucguggaaaaagagaaugaggaagaacugcuuaaguacuuuaaccuccuggaaaagggacagaaauucgagagaauccgccgguaugacaugaucaccuacaauagcaaguuuuauuacgugacgaaaauuaacaagaaucacagagucacaauccaagaagaguccaaaauuaaggccgagucugauaaggugaaaagcuccucuggcaaggaauacacccgcaaagagaccgaggagcugagccuccagaagcuggcugagcuuaucuccauuuga

SEQ ID NO: 11475 - RNA, 2850 nt, Artificial Sequence
  ARMAN Cas9 variant__Candidatus Micrarchaeum sp.__OJT94500.1__Cas9
augagagacagcaucaccgcuccccgguacuccucugcccuggccgcgcgcauuaaggaguucaacagcgcuuuuaaacucggcaucgaucuggggacaaagacgggaggcguggcccuugucaaagacaauaagguucugcucgccaaaaccuuccuggauuaucacaagcagacacuugaagagagacggauucaucgcagaaaccggcgcuccagacuggcucggcgcaagagaaucgcccggcuccgcucuuggauucugagacaaaagaucuacgggaagcagcugccugacccguauaaaaucaagaaaaugcagcuccccaauggagugcggaagggcgaaaacuggauugaucugguggucagcgggcgcgaccuuuccccugaggcuuuugugagagccaucacccugauuuuccagaagcggggacaaagauacgaagagguugcgaaagagaucgaagagaugucuuauaaggaauuuagcacacacauuaaagcccucaccuccgugacagaggaggaguucaccgcucuggccgcugaaaucgaacgccggcaggaugucguggacacggauaaggaggccgaaagauacacccagcuuagcgagcugcucucuaaaguuuccgagagcaagucugaauccaaagaccgcgcgcagcggaaggaggaucugggcaagguggucaaugccuuuugcagcgcucauagaauugaagacaaagauaagugguguaaagagcugaugaagcuccuggaccgccccgugcggcacgccagauuccuuaacaaagugcugauccgcugcaauaucugugaccgggcuacaccuaagaagucuagacccgauguccgcgaacuccuguauuuugacaccguucggaacuuccuuaaagccggcagaguggagcaaaauccugaugugauuuccuacuacaagaaaaucuauauggacgccgaggucauucgggugaagauccugaacaaagaaaagcucacagaugaggacaagaaacagaagcgcaaacuggcuagcgaacugaauagauacaagaacaaagaguauguuaccgaugcgcagaagaagaugcaggaacaacucaaaacgcugcuuuuuaugaagcugacagggcgguccagauacugcauggcccaucucaaagagcgcgcugccggaaaggacguggaggaaggccugcacggggucgugcagaaacggcacgauagaaauauugcccagcgcaaccaugaccuuagaguuaucaaucugaucgagucucuccuguucgauccgaacaagagccuguccgacgcuauucggaaaaacggacucauguaugugaccaucgaagcccccgagccuaagacaaagcacgcgaaaaagggcgcugccgucgugcgcgaccccagaaaacugaaggagaaacuuuuugaugaccaaaauggggucuguauuuacaccggacugcagcucgauaagcuggaaaucagcaaguaugagaaagaccauauuuucccugauucucgggacggccccuccauccgcgauaaccuggugcuuaccacaaaggaaaucaauagcgacaaaggcgauagaacgccgugggaguggaugcacgacaacccugaaaaguggaaagccuucgagcggcgcguugcugaguuuuacaagaaggggagaauuaaugaacggaaacgcgagcuccugcugaacaagggaaccgaauaccccggcgauaauccuacagagcucgccagagggggagcucgggugaacaauuucaucaccgaauuuaacgacagacugaaaacacacggcguccaggagcuucagaccauuuucgagcgcaauaagcccaucgugcaaguugugagaggggaagagacgcagcggcugcgccggcaguggaacgcccucaaucagaacuuuauuccccugaaagauagagcgaugucuuucaaucaugccgaagacgcugccaucgcugccagcaugccuccgaaguuuuggcgcgagcaaauuuaucggacagcguggcacuucggacccuccggcaacgaaagaccugacuuugcccuggcugagcuugcuccccaguggaacgauuucuuuaugaccaagggcgggccuaucaucgccguccucggaaaaaccaaguacucuuggaaacauagcauuaucgacgauacaauuuauaagcccuucuccaaaagcgccuacuaugugggcaucuacaagaaaccgaaugccauuaccucuaacgcuaucaaggugcugcgcccuaagcugcucaauggggagcacacaauguccaaaaacgcgaaguauuaccaucagaaaaucggaaaugaacgguuucugaugaaaagccagaaaggcgggucuauuaucacgguuaagccccacgacggcccugagaagguccuucaaauuucccccaccuacgaaugcgccgugcugacaaaacacgauggaaagaucauugugaaauucaagccuaucaaaccccucagagacauguaugcucggggcgucaucaaggccauggauaaggagcuggagaccagccuguccucuaugagcaaacaugccaaguacaaagaacuucacacacaugacauuaucuaucucccggcuaccaagaaacacguggauggguacuucauuaucacgaagcuguccgccaagcacggaauuaaagcgcugccugagucuaugguuaaggugaaauauacccagaucggcagcgaaaacaauuccgaggucaagcucacaaaacccaagcccgaaaucacccuggacagcgaggauauuacaaacaucuacaauuuuacccgcuga

SEQ ID NO: 11476 - RNA, 2961 nt, Artificial Sequence
  CasX variant__Deltaproteobacteria bacterium__OGP07438.1__CasX
auggagaagagaaucaacaaaauucggaagaaacugagcgccgacaaugcuaccaagcccgugucccgcucuggcccuaugaaaacacuccuggucagaguuaugacggaugaccuuaagaagcggcuggaaaaacgcagaaagaaaccggaggugaugccccaggugaucagcaacaaugccgcgaacaaucuccggaugcugcuugaugacuacaccaagaugaaagaagcuauucugcaagucuauuggcaggaguucaaggaugaccacguggggcucaugugcaaguuugcccagccugccuccaaaaagaucgaucagaacaaacugaagcccgaaauggacgagaaaggaaaucugacaaccgcuggcuucgccuguucucaaugcgggcagccucucuuuguuuacaagcuggaacaggugagcgagaaaggaaaggcuuauacaaacuacuucggccgcuguaaugucgccgagcaugaaaagcucauucugcucgcgcagcugaaacccgagaaggauuccgacgaggccgugaccuauucucuugggaaauuuggacaaagagcucuggauuucuacagcauccacguuacaaaggaauccacccauccugugaaaccgcucgcccagaucgcuggcaaccgguaugccagcggccccgucgggaaggcgcugucugacgccugcaugggaacgauugcuuccuuucugagcaaguaccaggauaucauuaucgagcaccagaaaguggugaagggcaaucaaaaacgccucgaaucucugagagagcuugccgggaaggaaaaccuggaguacccuuccgucacccuucccccucagccccauacaaaagagggaguugacgcuuauaaugaagugauugcccgggugcgcaugugggucaaccugaaucuuuggcagaagcugaagcucagcagagacgaugccaaaccgcugcugcggcucaagggcuucccuucuuuucccgugguugagcgcagagaaaacgagguggacugguggaacaccaucaaugaagucaaaaagcugauugaugcuaaacgggacauggggagaguguucugguccggaguuacagcggagaagcgcaacaccauccuugagggcuacaauuaucugccuaacgaaaaugaucacaagaaacgggagggcagccucgaaaaccccaagaaacccgccaagagacaauuuggggaccugcuucuguaccucgagaaaaaguaugcuggagauuggggcaaaguguucgacgaagccugggagcgcaucgauaagaagauugccgggcugacgucccacaucgagcgggaagaggcuagaaaugccgaagacgcgcagucuaaagcuguccugacagauuggcuccgcgccaaggccagcuuugugcuggagcggcuuaaagagauggacgaaaaggaguucuacgcuugugaaauucagcugcagaaaugguauggagaccucagaggcaacccuuucgccgucgaggcugaaaaucgcgugguugauaucuccggguuuagcauuggaucugacggccauuccauccaauaccggaaccugcuggccuggaaguaccuugagaauggcaagagagaguucuaucuccugaugaacuacgggaaaaagggacgcauccgguuuaccgauggcacagacauuaaaaagagcgggaaauggcagggacugcucuauggcgggggcaaggcgaaggugaucgaucugaccuucgacccggaugacgaacagcuuauuauccugccccucgccuuuggaaccagacagggccgggaguucauuuggaaugaucugcugucucuugaaacagggcucaucaaacuggcuaacggacgcgucaucgagaagacgauuuacaauaaaaagaucggcagagacgaaccugcccuguuuguggcucucaccuucgagcggagagagguuguggaucccagcaacauuaaaccugucaaccugaucgggguggaccgcggagaaaauauucccgccgugaucgcgcuuacagauccggagggcugcccucugcccgaauuuaaggacuccucugggggcccuaccgacauucuccggaucggagagggcuauaaggaaaaacaaagagccauccaggcugccaaggagguugagcagcgcagagcugggggauacagccggaaauucgccuccaagagccgcaaccuggccgaugacauggucagaaauucugcucgggaucuguuuuaucacgcggugacacaugacgccgugcuugucuucgaaaaccucucccgcggcuuugggagacagggaaaacggaccuucaugacggagcgccaauacacaaagauggaagauuggcugaccgcuaaacuggccuacgagggccucaccagcaagacauaucugucuaagacccuugcccaguacacauccaaaacguguagcaauugcggguucaccauuacaaccgcugacuaugauggcaugcuggugagacucaagaaaacauccgacggaugggccaccacgcugaacaauaaggagcugaaagcggaaggccagaucaccuacuauaaccgguacaagcgccagacaguugagaaggaacuuucugcugagcucgauagacugagcgaagaguccgggaauaacgacauuucuaaauggaccaagggacggagagaugaggcccuguuucuccugaaaaagcgcuucagccaccggcccgugcaagaacaguuugucugucuugacugcggccacgaggugcaugccgaugaacaggcugcccugaauaucgcgagauccuggcuguuccucaacagcaauucuacagaguuuaaauccuauaagagcgggaagcaaccuuucguuggagcuuggcaggccuuuuacaaacgccggcugaaggaaguguggaaacccaacgccuga

SEQ ID NO: 11477 - RNA, 2937 nt, Artificial Sequence
  CasX variant__Planctomycetes bacterium__OHB99618.1__CasX
augcaggagaucaagagaauuaacaaaauccggcgcagacuggugaaggacagcaauaccaaaaaggccggcaaaacagggcccaugaagacgcuccugguccggguuaugaccccugaucuucgcgaaagacuggagaaccuccggaagaaaccggaaaauauuccccaaccuaucuccaacacaucucgcgcuaaucugaacaaacuucugaccgacuacacagagaugaaaaaggccauucuccacguguauugggaagaguuccagaaagaucccgugggacugaugagcagagucgcgcagccugcucccaagaauaucgaccagcggaagcugaucccugugaaagauggcaacgagcgccucaccuccucuggguuugccugcagccaauguugccagccgcuguacguuuauaaacuugaacaggugaaugacaaaggaaagccccauacaaacuacuucggcagauguaaugucuccgagcacgaacggcugauucuccugucuccucauaaacccgaggccaacgaugagcuugugaccuauagccuggggaaguuuggacagcgcgcucucgacuucuacuccauccacguuacgagagaaagcaaucauccugugaaaccccuggagcaaauuggcggcaacucuugcgccuccgggccggucggaaaggcucugagcgaugccuguaugggcgcgguggccucuuuucucaccaaguaucaggacaucauucuggaacaccagaaagugaucaagaaaaaugagaagcggcuugcuaaccugaaagauauugccuccgcuaacgggcucgccuucccuaagaucacacugcccccucagccccacaccaaggaaggaaucgaggcguacaauaacgucguugcccaaauugugaucugggugaaucuuaaccuguggcagaaacucaagauuggccgcgacgaggcuaaaccccugcagagacugaagggguuuccuagcuucccgcucgucgaacggcaagccaaugagguggauuggugggacaugguuugcaacgugaaaaagcugaucaaugaaaagaaagaggacggaaaggucuuuuggcagaaccuugcuggcuacaaaagacaggaagcccugcuccccuaucugucuuccgaggaggaucgcaagaaaggcaagaaguucgcccgguaccaguuuggggaccuucugcuccaucuggaaaagaagcacggagaggauuggggcaaaguguaugacgaggcuugggaaagaauugauaagaaaguugaagggcugagcaagcauaucaaacucgaggaggaacgccgguccgaggacgcgcaaucuaaggccgcucugacagauuggcuuagagccaaggccagcuucgugaucgaaggacugaaagaggcugacaaggaugaguuuugucgcugcgaacucaaacugcagaagugguacggcgaccugcgggggaaaccuuucgccauugaggcggaaaauuccauccuugauauuagcggauucucuaagcaguauaacugugcuuuuaucuggcagaaggacggcgucaaaaagcucaaucuguaccugauuaucaacuauuucaaaggcgggaagcucagauuuaaaaagaucaagcccgaggccuucgaagccaaucgcuuuuacaccgugauuaacaaaaaguccggagagaucgucccuauggaggugaauuucaacuuugacgaucccaaccugauuauccuuccgcuggcuuucggcaaacggcaagggagagaauuuauuuggaaugaccuccugagccuggagacgggaucucuuaagcucgccaacggccgcguuaucgaaaagacacuguacaaucggagaacccggcaggaugagccugcucuguucguggcccucacauuugaacgcagagagguccuggacagcuccaacauuaagcccaugaaucuuaucgggaucgaucggggcgagaacauuccugcggugaucgcccugaccgaccccgaaggaugcccucucucuagauucaaggauagccugggcaaucccacccacauucugcgcaucggggaguccuauaaagaaaagcagcggacaauucaggcugccaaagagguugaacaaagacgcgcuggaggcuacagcagaaaguaugccucuaaagcgaagaaccuugccgacgauauggugcggaauacggcucgcgaccuccuguacuaugccgucacccaggaugcuaugcugaucuuugagaaccucuccagaggguucggacggcagggcaaacgcacauucauggccgagagacaguacacccggauggaagacuggcugacagccaaacuugcuuaugaggggcugccgagcaagaccuaccucucuaagacgcuggcgcaauacacauccaagaccuguagcaauugcggcuuuaccaucacauccgccgauuaugaccgcgugcuggaaaaacuuaagaaaaccgcuacaggauggaugacgaccauuaacggcaaggagcucaagguggaggggcagaucacauacuauaauagauacaaacggcagaacguugucaaggaccugucuguggaacuggaucgccucagcgaggaauccgugaauaacgacauuucuagcuggaccaaaggaagauccggcgaggcccugagccuucugaagaaacgguucucucacagaccuguccaagaaaaguuugugugccucaacuguggguucgagacacaugccgaugagcaggcugcccugaauaucgcgcgcuccuggcuguuucuucggagccaggaauauaagaaauaccagaccaacaagacgaccggaaauacagacaaaagagcuuucguugagaccuggcaaucuuuuuaucgcaagaaacugaaggaaguguggaagcccgccgucuga

SEQ ID NO: 11478 - RNA, 3378 nt, Artificial Sequence
  CasY variant__Candidatus Katanobacteria bacterium__OJI08769.1__CasY
augagaaagaaacuguucaagggcuacauccuccacaacaaacggcugguguauaccgggaaggccgcuauucgcagcaucaaauacccccuugucgccccuaauaagacagcgcugaacaaucucuccgagaagauuaucuaugacuacgaacaucuguuuggaccgcuuaacguugcuucuuaugccagaaauagcaaccgguacucccugguggauuucuggauugacucucuccgcgccggcgugaucuggcagagcaaauccacgucucugaucgaucugauuagcaagcucgagggguccaaaagccccucugaaaagaucuuugagcaaauugacuucgaacugaaaaauaaacuugauaaggagcaguuuaaagacaucauucugcucaacaccggaaucagauccagcucuaauguccggucccugcgcggcagauuccuuaagugcuuuaaagaggaguuccgggauacagaggaagugauugcuuguguugacaaguggagcaaagaucugaucguggaggggaagucuauccucgucuccaaacaguuucuguauugggaggaagaguucggaauuaagaucuuuccucacuucaaggacaaccaugaucugcccaaacucaccuuuuucguggaaccuagccuggaguucagcccccaccuuccucuggccaauugccucgaacgccugaagaaauuugacauuucuagagagagccuucugggccucgauaacaauuucuccgcuuuuagcaacuacuucaaugagcuguuuaaccugcucucucggggcgaaaucaagaaaauuguuacagccgugcuggcggucuccaagagcugggagaacgaaccggagcuugaaaagcgccugcauuuccucucugagaaagccaagcugcuuggguaccccaaacugaccagcuccugggcugacuauagaaugaucaucggaggcaagauuaaaucuuggcacagcaauuacacagagcagcucaucaaggugcgggaagaccugaagaaacaccaaauugcccuggauaagcuccaggaggaccugaaaaagguggucgauuccagccuucgcgaacagaucgaggcucagagagaagcccugcucccucugcuggacaccaugcuuaaagagaaggauuuuucugacgaucucgagcuguaucgguucauucuguccgacuuuaagagccuccugaacgggucuuaccaaagauauauccagacggaagaggaacgcaaagaggaucgggacguuaccaagaaauacaaggaucuuuauuccaaucugagaaacaucccccgcuucuuuggagagagcaaaaaggaacaguucaauaaauuuauuaacaagucccucccuacaaucgacgugggccugaagauucuggaggacauccggaaugcgcuugaaaccgugucugucagaaaacccccgagcauuacagaggaauacgugaccaagcagcucgagaaacugucccgcaaguacaaaaucaacgccuucaauucuaaccgguucaagcaaauuacggagcagguucugagaaaguauaauaacggggaacucccuaaaaucagcgagguguuuuaccgcuauccccgggaaucccaugucgcuauccggauucugccugugaagaucagcaauccccgcaaagauauuucuuaccuucuggacaaguaucagaucucccccgauuggaaaaacagcaauccuggagagguuguggaccucauugaaaucuacaagcugacacugggcuggcuucucucuuguaacaaggauuucuccauggacuuuagcucuuaugaucugaaacuguucccggaggccgcuagccucaucaagaacuuuggcuccugccugagcggguacuaccuuucuaaaaugauuuucaauuguaucaccuccgagauuaagggaaugaucacacuguauacccgggacaaauuugucgugagauacgucacccaaaugauuggcagcaaccagaaguucccccuccugugccuggugggggaaaagcagacaaagaauuuuucccggaacuggggaguucuuaucgaggaaaagggcgaucucggggaggagaaaaaucaggaaaagugucugaucuucaaagacaagacggauuuugccaaagccaaggagguggaaauuuucaagaacaauaucuggcgcauuagaaccucuaaauaucaaauccaguuucugaacagacucuucaagaaaacaaaggagugggaccugaugaaucuuguccugagcgaaccuucccucgugcuggaggaggaauggggaguuucuugggauaaagacaagcugcuuccccugcucaagaaagaaaagagcugcgaagagagacuguacuauucccucccucugaaccuugugcccgcuaccgacuacaaagaacagucugcggagauugagcagcgcaauacauaucugggccucgaugucggcgaguucgggguggccuacgcugugguucggaucgucagagaccgcaucgaacugcugagcuggggauuucuuaaggauccggcccugagaaaaauucgggaacgcgugcaagacaugaagaagaaacaggugauggccgucuucuccuccucuuccaccgcuguggccagaguucgggagauggcgauccacagccuccgcaaccagauucauucuaucgcucuggccuacaaggccaaaauuaucuaugaaauuuccaucagcaauuuugagacgggcgggaacagaauggcuaagaucuaccggucuauuaaaguguccgaugucuaucgcgagagcggagccgacacacucguguccgaaaugaucuggggcaagaagaauaaacagauggggaaccacauuagcucuuacgcuaccagcuauaccuguugcaacugugccagaacaccuuucgagcugguuaucgauaaugacaaggaauacgagaaaggcggagaugaauuuauuuucaacgugggcgacgagaagaaaguccggggguuucuucaaaagucccugcucggaaagaccaucaaaggcaaggaggugcugaaaucuaucaaggaauaugcgcgcccucccauuagagagguucugcuugaaggggaggauguggagcagcugcucaaacggagaggaaauagcuacaucuaccgcugccccuucugcggcuauaagacagacgccgauauucaggcugcccugaacaucgcuugucggggguacauuuccgacaaugccaaagacgcggucaaggaaggcgagagaaagcucgauuauauccuggaagugcgcaaacuuugggagaagaacggagccgugcugcggucugcuaaauuucuguga

SEQ ID NO: 11479 - RNA, 3864 nt, Artificial Sequence
  CasY variant__Candidatus Kerfeldbacteria bacterium__OGY82221.1__CasY
augaagagaauccugaacagccucaaaguggccgcucugcggcuucuguuccgcggcaagggguccgagcucgucaaaaccguuaaguacccccuggugucuccugugcagggagccgucgaggaacuugcggaagcuauuagacacgacaaucugcaucucuuuggccaaaaagagaucguggaucugauggaaaaggacgaggggacacagguuuauagcguggucgauuucuggcuggacacgcuccggcugggaauguuuuucuccccgucugccaacgcccuuaagauuacccugggcaaauuuaauagcgaucaggugucccccuuccgcaagguucucgagcagucucccuuuuuccuggcugggagacuuaaaguggaacccgccgagcggauccugagcgucgaaauucgcaagaucggaaaaagagagaaccggguggagaauuacgcugccgacguggaaacaugcuuuaucggccaacucuccagcgaugagaagcagucuauucagaagcuggcgaacgacaucugggauuccaaagaccacgaggaacagcgcaugcugaaggccgauuucuuugcuauuccucucaucaaagaccccaaggccgucaccgaagaggauccugagaaugaaacagcuggcaaacaaaagccgcuggagcuuuguguuugccuggugcccgaacucuauaccagaggguucggaagcauugccgacuuucuggugcagcggcuuacacugcuccgcgacaaaaugucuaccgauacggcggaggacugucuggaauacgucggcaucgaggaggaaaaggggaacggaaugaauagccugcucggcaccuuccugaagaaccuucagggggauggauucgagcagauuuuucaauucaugcugggcagcuaugugggcuggcaggggaaagaagacguucucagagagcggcuggaucuucuggccgaaaaggugaaacgccucccuaagcccaaauuugcuggagaguggucuggccauagaauguuccugcacgggcagcugaaguccuggagcuccaacuuuuuccggcucuuuaaugagacaagagaacugcuugagucuaucaagagcgacauccaacaugccaccaugcugauuuccuacgucgaagagaaaggaggcuaucacccucagcuccugagccaguaccgcaagcugauggagcagcuucccgcucuccggacaaaagugcuggauccggaaaucgagaugacccacaugucugaagccguuagauccuacauuaugauccauaagagcguggccggguuccugccugaccuccuggagucucuugaucgcgacaaagaucgggaauuucugcucagcauuuuccccagaaucccuaagaucgacaagaaaacgaaggagauugucgcuugggagcugcccggagaacccgaggaaggcuaucuguuuacagcgaauaaccuuuuccgcaauuuucucgagaacccuaaacacgugccgcgguucauggccgaaagaauccccgaggacuggacccgccugcgguccgcuccugucugguucgauggcauggugaagcaauggcagaaaguugugaaccagcuggucgagucucccggggcccucuaccaguuuaaugaauccuuccugagacaacgccuucaggccaugcugacaguguauaagcgggaccuccagaccgagaaguuucugaaacugcuugcugauguuugcagaccucucguggacuucuuuggacugggcgggaacgauauuaucuucaaguccugucaggacccccggaaacaauggcagaccgucauuccgcugagcgugccugccgauguguacacagcgugcgaaggacucgcuauccgccugagagagacgcuuggcuuugaauggaagaaucugaaagggcaugagcgggaggacuuccucagacugcaccagcugcuuggcaaccuccuguuuuggauccgcgaugccaagcugguugucaaacucgaagacuggaugaauaaccccugugugcaggaguauguggaagcccggaaggcuauugaucugccucuugagaucuucggauuugagguccccauuuuccugaauggcuaccucuuuucugaacugagacaacuggagcuucugcuccgcagaaaguccgugaugaccagcuauucuguuaaaacaaccggguccccuaaccggcuguuccagcucguguaccugccccuuaauccgagcgacccugaaaagaaaaacuccaauaacuuccaggagcgccuggauacacccaccggacucucuagacgguuucuggaccugacgcuugacgccuucgcuggcaagcugcucacagaucccgucacccaagaacugaaaaccauggccggguuuuacgaccaccucuucggauuuaagcugccuugcaaacuugcggccaugagcaaucauccgggcuccucuagcaagauggugguucuggcuaagcccaaaaaggggguggccuccaacaucggcuucgagccuauucccgauccugcucaccccgucuuucgcgugagaagcucuuggccugagcucaaauaucuggaaggacugcuuuaccugcccgaggacacaccgcucaccaucgaacuggccgagacauccguuagcugucagucuguguccagcgucgcguucgaucucaagaaucugacgaccauucuuggccgggugggggaauuucgcgugacagccgaccagccuuucaagcugacccccaucaucccugagaaagaggaaucuuuuauuggaaagacauaucugggccucgaugcuggggagagaagcggagucggcuucgccaucguuaccguggacggggauggcuacgaagugcagcggcugggaguccaugaggacacgcaacuuauggcucugcaacagguggccuccaaaagccucaaggaacccguuuuccagccgcugcgcaaaggcaccuuuagacagcaggagcggauuagaaagucucuccgcgggugcuauuggaacuucuaccacgcccugaugaucaaguaucgggcuaaagugguccaugaggaauccgugggaagcuccggccuuguugggcaguggcugagagcguuucagaaggaucugaaaaaggccgacgugcucccuaaaaagggaggcaaaaacggggucgauaagaagaaacgcgagucuagcgcucaagacacacuguggggcggagccuucuccaagaaagaggaacagcagauugccuuugaggugcaagcugccggcucuagccaguucugucuuaagugcggguggugguuucagcugggaaugcgggaaguuaauagagugcaggaguccggcgucgugcucgacuggaaccgcucuaucgugaccuuccugaucgaaagcuccggggagaaagucuacggauuuagcccccaacagcucgaaaagggcuuccggccugauauugagacauuuaagaaaaugguuagagacuucaugcgcccucccauguuugaucggaagggcagaccugcggcugccuacgagcgguucgugcuggggcgcagacaccggcgcuauagauucgacaaaguguuugaggaacgguucggaagaucugcccuuuuuaucugcccgcgcgucggcugugggaauuucgaucacuccagcgaacagucugcugugguucuggcccugauuggauacaucgcggacaaggagggcauguccgggaaaaagcucguguauguccggcuggcugaacuuauggccgaguggaagcugaaaaagcucgagagaagccgcguggaggaacagucuuccgcccaauga

SEQ ID NO: 11480 - RNA, 3579 nt, Artificial Sequence
  CasY variant__Candidatus Komeilibacteria bacterium__OJI06454.1__CasY
auggccgagagcaagcagaugcaaugcagaaaauguggcgcuuccaugaaguacgaagugaucgggcugggaaagaagucuugccgguauaugugucccgacugcggcaaccacaccagcgcccgcaaaauucagaauaagaagaaaagagauaagaaauacggguccgcgucuaaggcucagagccagcggaucgccgucgccggagcucucuauccugacaaaaagguucaaacaauuaagacguacaaauauccggccgaucugaacggcgaggugcaugaccgcgggguggcugaaaagaucgagcaggccauucaggaagaugagaucggacuucugggccccuccucugaguacgcguguuggaucgccagccagaaacaauccgaaccuuauagcgucguggacuucugguuugaugcuguuugcgccggcgggguguucgcuuacucuggagccagacuccuguccaccguccuucagcugagcggcgaggaaucugugcuccgggcggcccuggcuuccagccccuuuguugacgauauuaaucuggcccaggcugagaaguuccucgccgugucucgcagaacagggcaggacaaacugggaaagcggaucggcgaguguuuugccgaagggcgccuugaggcucugggaauuaaagauagaaugcgggaguucguccaagcgaucgacguggcccagaccgcuggccagcgcuuugccgccaagcucaagauuuucggcaucucccaaaugccugaggcuaaacaguggaacaaugauagcgggcugacagugugcauucuucccgacuacuaugucccugaagagaacagagccgaccagcugguugugcuccugcggcgccugagagagaucgcguacuguaugggaaucgaagaugaggcuggcuuugaacaccucgggauugacccgggagcccuguccaauuucucuaacggcaaucccaagcggggguuucuuggaagacugcucaacaaugauaucauugcccuggcuaacaauaugagcgccaugaccccuuauugggagggccgcaaaggcgaacuuaucgagcggcuggcuuggcucaagcauagagccgaggggcuguaccugaaagaaccccacuucggaaacuccugggcggaccaucgcagccggauuuuuagcagaaucgccggcuggcucuccgggugcgcuggaaagcugaagaucgccaaagaucagauuagcggcgugcgcacagaccuuuuccugcucaagcggcugcuugaugcugucccucaaucugcccccagcccggacuucaucgcguccauuucugcccuggauagauuucucgaggcugccgaaagcucccaggacccugcugaacaggugcgcgcccuguaugccuuccaccugaaugcucccgcgguucggagcaucgccaacaaagcugugcagagaucugauucccaagaauggcucauuaaggagcuggacgccgucgaccaccuugaguuuaacaaagccuuccccuuuuucagcgauaccgggaagaagaaaaagaaaggcgcuaauucuaacggagcccccuccgaagaggaauacacggagaccgagagcauccagcagcccgaagacgcggagcaggaagugaauggccaagaggggaacggagcuuccaagaaucagaaaaaguuucagcgcaucccucgguucuuuggcgaagggucuagaagcgaguaucggauucugacagaggccccgcaguacuucgauauguuuuguaacaauaugcgcgccaucuucaugcaacucgaaucccagcccagaaaggcuccucgggacuuuaaaugcuuccugcagaacagacugcaaaaacuuuacaaacagaccuuccucaaugcccgcucuaacaagugccgggcgcugcuggagagcguucucauuuccuggggagaauuuuauacauacggcgcuaaugagaaaaaguucagacugcgccaugaagccagcgagagaucuuccgaucccgacuaugugguccagcaggcccuugagaucgcucggcgccuguuucucuucggguuugaauggagagauuguagcgccggcgagcggguggaccuggucgaaauucacaaaaaggcuaucucuuuccugcuugccauuacccaagcggagguguccguuggaagcuacaacuggcucggcaauucuacggugagccgcuaucuguccgucgccgggacagauacccuguacggaacacagcucgaagaguuucugaacgcuaccgugcuuagccagaugagaggccuggccauccggcucucuucccaggagcugaaggacggguucgauguucaacuggaaagcuccugccaggacaaucuucagcaucuccugguguaucgcgcuucuagagaucuggccgccuguaaacgggcuaccugcccugcggagcucgaccccaagauccugguccuuccggccggagcuuuuauugccagcgugaugaaaaugaucgaacgcggcgacgagccucuggccggggcuuaccucagacaccggccccacuccuucggcuggcagauuagagugcgcggaguugccgaggucggcauggaucaagggacagcgcuggcuuuucagaagccuacggaaucugagcccuucaaaaucaagccuuuuagcgcccaguacggacccgugcuguggcuuaacuccucuagcuauucccaaagccaguaccucgacggcuuccugucucagccgaagaacugguccaugcgggugcugccucaggccgggagcgucagaguggaacaacgcguugcucucauuuggaaucugcaggccggaaaaaugcggcuugagagaucuggcgcgcgcgcuuucuuuaugcccgugcccuucuccuuucggccuagcgggucuggcgaugaagccguccuggccccgaacagauaucucggacuguucccccauuccggcgggaucgaguacgcugugguugacgugcuggauagcgccggauuuaagauccuugagcgcggcaccauugcugucaauggguucucccagaaacggggagaaagacaggaggaagcccaccgggagaagcaacgcagaggcaucagcgacauuggccggaaaaagccugugcaggcggaaguugaugccgcuaacgagcugcaucgcaaguauacagacguggccaccagacucgggugucggaucgucgugcagugggcuccccagccuaaacccggaacagccccuaccgcccaaacgguguacgcuagagcgguccgcacagaggccccucggucuggcaaucaggaagaucacgcuagaaugaagucuuccuggggguauaccuggucuaccuacugggagaaacgcaagccggaagacauucugggaaucagcacacagguuuacuggaccggcgggaucggagaguccugcccugccguggccguggcucuccugggccauauucgggccacaucuacgcagaccgaaugggagaaagaggaagucguguuuggcagacuuaagaaguucuuucccagcuga

SEQ ID NO: 11481 - RNA, 3633 nt, Artificial Sequence
  CasY variant__Candidatus Parcubacteria bacterium__APG80656.1__CasY
augagcaagagacacccccggaucuccggcgugaaaggguaccgccugcaugcccagagacucgaguauaccggaaagucuggcgcuaugcggacaauuaaauacccucuguauagcuccccgucugggggacgcacgguccccagagaaaucguuagcgccauuaacgacgauuacgugggccuuuaugggcuguccaauuucgacgaucucuacaacgcggagaagcggaaugaagagaaaguguauucuguccuggacuuuugguacgauugcgugcaauacggagcuguuuucagcuauaccgccccuggccuucugaagaacguggccgaaguccgcggcggguccuacgagcucacaaagacccugaaaggaagccaccuguaugacgagcuccagaucgauaaggugauuaaauuucugaauaagaaagaaaucucuagagcuaacggcucccuugacaagcugaagaaagauaucauugacuguuucaaggccgaguaccgggaacgccauaaagaucagugcaauaagcucgcugacgauaucaaaaacgccaagaaagacgcgggggccagccugggagagagacagaagaaacuuuuucgggacuucuuuggcauuucugagcaauccgaaaaugauaaacccagcuucacaaacccucugaaucucaccuguugccugcugcccuuugacacaguuaacaauaaccgcaauagaggggagguccucuucaacaagcugaaagaauaugcucagaaacuugauaaaaacgagggaucucuggaaaugugggaguacaucggcauuggcaauuccgggaccgccuuuagcaacuuccucggagagggcuuucuggggcggcuucgcgaaaauaagaucacggagcugaagaaagcuaugauggacauuaccgaugccuggagaggacaggaacaggaggaggagcucgagaagcggcugagaauccuggcggcccucacaaucaaacugcgcgaaccuaaguucgacaaccacuggggcggguaucgguccgauauuaauggaaaacuuucuagcuggcugcaaaacuacaucaaucagaccgugaagauuaaggaggaccucaaaggccauaagaaagaucugaagaaagcuaaggaaaugaucaacagauucggcgaguccgacacaaaggaagaggccguggugagcucucuucuggaguccauugaaaagaucgucccggaugacagcgcugacgaugagaagcccgacaucccugccauugccaucuaccgccgguuucucucugaugggagacugacccugaaucgcuucguucagcgggaagacgugcaggaggcucucauuaaagagagacuggaagcggagaagaaaaagaaacccaagaagcgcaaaaagaaaagcgaugccgaagacgagaaggaaacgaucgauuuuaaagagcuuuucccucaccuggcuaagccccucaagcuggugccgaacuuuuauggagacuccaaacgggagcuguacaagaaauauaagaaugccgccauuuacacagaugcucuuuggaaagccgucgaaaagaucuauaagucugcguucagcuccagccucaaaaacuccuuuuucgacaccgauuuugacaaggauuucuuuaucaaaagacugcaaaagauuuucucuguguaccgccgguuuaauacagacaaauggaagccuaucguuaagaacagcuucgcucccuauugugacauugugucucuggccgagaaugaaguccucuacaaaccuaagcaguccagaagccggaaauccgccgcuaucgauaagaaccgcgugagacugcccucuaccgagaacauugccaaagcuggcaucgcccuugcgcgggaacugagcguugccggguucgacuggaaggaucuccugaaaaaggaggagcacgaagaguacauugaccugaucgaacuucauaagaccgcucucgcccugcugcucgcugugacagagacgcagcuggauaucuccgcccuugacuuugucgaaaauggaaccgugaaagauuucaugaagacaagagacggcaaccugguccucgaggggcgcuuucuggagauguucucucaaagcauuguguuuuccgaacugcggggccuugcgggacucaugagcagaaaagaguucaucacccgcucugccauucagacaaugaauggcaagcaggcugaacugcuguauaucccccacgaguuucaguccgccaaaauuaccacgccuaaggagaugagcagagcuuuccucgaucuggccccggccgaauuugcuacaucucuugagcccgaaucccugagcgagaagucucuccugaaacugaagcaaaugcgguacuauccucauuacuucggguaugaacuuacccgcaccggacagggcaucgacgggggaguugcggagaacgcccucagacuggagaaaagccccgugaagaaacgggaaaucaagugcaagcaguacaaaacacugggccgcgggcagaauaagauuguccucuaugugagauccagcuacuaccaaacccaguuucuggagugguuccuucaccggccuaaaaacguucagacagauguggcugucucuggcuccuuucugaucgacgaaaagaaagugaagacgcgcuggaauuaugaugcccucaccguggcccuggagcccguuagcggauccgaaagagucuucgugucucagccguucacaauuuuuccugaaaagagcgcugaggaagagggccaacgguaccuggggaucgacauuggagaauauggcaucgccuacaccgcgcuugagaucacaggggacuccgcuaaaauucuggaucagaacuucaucucugacccccagcucaagacccugcgcgaagaggugaaaggacucaagcuggaucagagacggggcacguuugccaugccuagcaccaaaauugccagaauccgcgagucccuuguccacucucugcggaaucgcauucaucaccucgcucugaagcauaaggccaaaaucguguaugaacuggagguuagccgcuucgaagaggggaagcaaaagaucaagaaaguguacgcgacacuuaagaaagcugacgucuauuccgagauugaugccgacaagaaccugcagaccacaguguggggcaagcucgccguugcuagcgaaaucucugccuccuacaccagccaguuuuguggagcuugcaaaaagcuguggcgggccgagaugcaaguggaugaaacgauuacaacccaggagcucaucggcacagucagagugauuaaagggggaacccugaucgacgcgauuaaggauuucaugagacccccuaucuuugacgaaaaugauacccccuucccgaaauaccgggacuuuugugacaagcaccauaucucuaagaaaaugagaggcaacuccugccuuuucauuuguccuuuuugccgcgccaaugcugaugccgacauccaggcuagccagacaauugcccugcuccgguauguuaaggaggagaaaaagguggaagauuacuucgagagauuccggaaacugaagaacaucaagguccuggggcaaaugaaaaagauuuga

SEQ ID NO: 11482 - RNA, 3681 nt, Artificial Sequence
  CasY variant__Candidatus Vogelbacteria bacterium__OJI07455.1__CasY
augcagaaggugagaaaaacccugagcgagguccacaagaaccccuacggcacaaaaguucggaaugccaagacgggguauucccuccaaaucgaacgccugucuuacaccggaaaagagggcaugagauccuucaagauuccucuugaaaacaagaauaaagagguguuugacgaguucgugaagaaaauccggaacgauuauauuucccaggucgggcugcucaaucugucugacugguacgaacauuaucaggagaagcaggaacacuacagccuugcugauuuuuggcuggacucccuccgcgccggagugaucuucgcgcauaaagagacagaaauuaagaaccugaucucuaagaucagaggcgauaaaagcauuguugacaaguuuaaugcuuccaucaaaaagaaacacgccgaucuguaugcccucguggacauuaaggcucuguacgauuuccuuaccagcgacgcccggcgcgggcugaaaacagaggaggaauuuuucaacucuaagagaaauacccucuuuccgaaguuccggaaaaaggauaacaaagcugucgaccugugggugaagaaauuuaucggacuugauaauaaggacaagcugaacuucacgaaaaaguuuauuggcuucgaccccaauccucaaaucaaauacgaucauaccuucuuuuuccaccaggacauuaacuuugaucucgagcgcaucacgacccccaaggaacugaucuccacauauaaaaaguuccugggcaagaauaaagaccucuacgggagcgaugagaccacagaagaccagcugaagaugguucuuggauuucacaacaaccauggcgccuucucuaaauauuuuaaugcgucccuggaggccuucagagggcgggauaacagccucguggagcagauuaucaauaacucuccuuacuggaauagccaccgcaaggaacuggagaaaagaauuaucuuucuucaaguccagagcaagaagauuaaagaaaccgagcugggaaagccccaugaauaucucgcuuccuucggcgggaaauuugagucuugggugagcaacuaccugcggcaggaggaagaggugaagcgccagcuguucggauaugaagagaauaaaaagggccaaaagaaguuuaucgucggcaacaagcaggaacucgacaaaaucauuagagggacggaugaguacgagaucaaggccauuuccaaagaaacaaucggacugacccagaagugccuuaaacugcucgagcaacugaaggacagcguugaugacuacacacuuucucuguaucggcagcucauuguggaacugagaauccgccugaauguggaguuccaggagaccuacccugaacucaucggcaaguccgagaaagacaaggaaaaagaugcuaagaacaaacgggccgacaagagauauccgcagauuuucaaggauaucaaacugauucccaauuuucuuggggagaccaagcaaauggucuacaaaaaguucauccgcagcgcggacauucuguaugaaggaaucaacuuuauugaucagaucgacaaacagaucacacagaaucuccugccuuguuucaagaacgauaaggagcggauugaguuuacggaaaaacaauucgagacccugagacgcaaguacuaucuuaugaacucuagccgguuucaccacgugaucgaaggcauuaucaauaacagaaaacucauugagaugaagaaacgcgaaaauuccgagcugaagacauucucugacagcaaauuuguucuguccaaacucuuccugaagaaagggaagaaauacgagaacgaaguguacuauaccuuuuacaucaaucccaaggcccgggaucagagacgcaucaaaauuguccuugacaucaacggaaauaacagcgugggcauucugcaggaucucguucagaagcugaagccuaaaugggacgauaucauuaagaaaaaugacaugggcgagcugaucgacgcuaucgaaauugagaaggugcggcuugggauccucauugcccuguauugcgaacauaaauucaagaucaagaaagagcugcucucucuggaucuuuuugcuuccgccuaccaauaucuggagcucgaagacgaucccgaggaacugagcggaacaaaccugggcagauuccuucagucucucgucuguuccgagauuaagggggccaucaauaaaaucagccggaccgaguacauugaacgcuauacggugcagccgaugaacacagagaagaauuacccucugcugaucaacaaagaaggaaaggcuaccuggcacauugcggccaaggacgaucucuccaaaaagaaaggcgggggcaccgucgcuaugaaucagaagaucggcaaaaacuucuuuggaaagcaagacuacaagacaguguucaugcugcaggauaaaagauuugaccuucugaccucuaaguaucaucuccaguuccugagcaaaacacuggauacagggggaggcuccugguggaagaauaaaaacauugaccuuaaccucucuagcuacuccuuuaucuucgagcaaaagguuaaaguggaaugggaucugaccaaucuggaccaccccauuaagaucaagccuagcgagaacucugaugaccggagacucuuugucuccauccccuucgugauuaaacccaagcagacaaaacgcaaggaccugcagacccggguuaauuauauggggaucgauauuggagaguacggccuugccuggacaaucauuaacaucgaccugaaaaauaagaagaucaacaaaauuagcaagcagggguuuaucuaugaaccucucacccauaaagugagagauuacgucgccacgauuaaggacaaucaagugcgcggcaccuucggaaugccggauacaaaacuggcuagacugcgggagaacgccaucaccucucuucgcaaucaggugcacgacauugcgaugagauaugaugcuaagcccguuuacgaauuugagaucuccaacuucgaaacaggcagcaauaaggucaaagugaucuacgacucugugaagcgggccgauauugggcgcggacagaacaauaccgaggccgacaacacggaggucaaucugguguggggcaaaacaagcaagcaguucgggucccaaaucggagcuuaugccaccagcuacauuugcucuuuuuguggcuauuccccuuacuaugaguucgaaaacagcaaauccggggaugaagagggcgcuagagacaaccucuaccagaugaagaagcugucucggcccagccucgaagacuuucugcagggaaauccuguuuauaaaacauuccgcgauuuugacaaguacaaaaacgaucagagacuucaaaagaccggcgacaaagauggggaguggaagacccaccggggaaauacagccaucuacgcgugccagaaaugucgccauauuuccgacgccgauauccaggcuucuuauuggauugcccugaagcaaguggucagagacuucuacaaggauaaagagauggacggcgaucucauccagggggacaacaaggauaaacggaaggugaaugaacugaacagacugaucggaguucacaaagacgugcccauuaucaauaagaaccuuauuacgagccuggacaucaaucuccuguga

SEQ ID NO: 11483 - RNA, 3603 nt, Artificial Sequence
  CasY variant__Candidatus Vogelbacteria bacterium__OJI09436.1__CasY
augaaggccaaaaagagcuucuacaaccagaaaagaaaguuuggcaaacggggguaucgccugcacgacgagagaaucgcuuacuccggaggcauugggucuaugcggagcaucaaguaugaacucaaggauuccuacggaauugccggccugcgcaauagaaucgcggacgcuaccauuucugauaacaaauggcuuuaugggaauaucaaccugaaugacuaccucgaguggcggagcuccaagacagauaaacaaaucgaagacggagaucgcgagucuagccugcuuggcuucuggcuggaagcccucagacugggcuuuguguucuccaagcagagccaugcccccaacgacuuuaaugagacggcucugcaggaucucuucgagacccuggacgaugaccuuaaacacguccuggaucggaagaaguggugcgacuuuauuaaaaucgggacaccuaagaccaacgaccagggacgccucaaaaagcaaauuaaaaaucugcuuaagggcaacaaaagagaagagaucgaaaagacacugaaugagucugaugacgagcucaaggagaaaauuaaccggaucgccgauguuuucgcuaagaauaaauccgacaaguauaccauuuuuaaacuggauaagccgaacacagagaaguacccccgcaucaaugacguccagguggccuucuuuugucauccugauuucgaagagaucaccgaaagagaccggacgaaaacccuggaucucauuaucaaccgcuuuaacaagagauacgagauuacagagaauaaaaaggacgauaaaaccagcaaccggauggcgcuguauucucuuaaucagggguacauccccagagugcugaacgaccucuuccuguucgugaaggacaaugaagaugacuuuucccaguuccuuagcgaucuggagaacuuuuucucuuuuuccaaugaacaaauuaagaucaucaaagagcgccucaagaaacugaagaaauaugccgaaccuauucccggaaagccucagcuggcugacaagugggaugacuacgccagcgauuucggcgggaaacucgaguccugguauucuaaccggaucgagaagcugaaaaagauuccggaaagcguuuccgaccuuagaaauaaccuggagaaaauccgcaaugugcucaagaaacagaacaaugcuagcaagauucuggaacuuucucagaagaucaucgaguacauucgggauuauggagucuccuuugaaaaacccgagaucauuaaguucagcuggaucaacaaaacaaaggacggccagaaaaagguguuuuacguugccaagauggcggauagagaguucauugaaaaacuggaccucuggauggccgaucugcgcucucaacugaaugaguacaaccaggacaacaaggugagcuuuaaaaagaaaggcaagaagaucgaagaacucgggguccuggacuucgcucuuaauaaagccaagaaaaacaaguccaccaaaaaugagaacggauggcaacagaagcugucugaaagcauucaguccgcuccucucuuuuucggcgaggggaaucgggugagaaacgaagagguguauaaucugaaggaucugcuuuucagcgaaaucaaaaacgucgagaauauccucaugucuuccgaggccgaagaccugaagaacauuaaaaucgaguacaaggaagauggagccaaaaagggcaauuauguucugaacgugcucgcucgcuuuuacgcgcgguucaaugaggacggguauggaggcuggaacaaagugaagacgguccuggaaaauauugccagagaggcuggcacagauuuuagcaaguacgggaacaacaauaaccgcaaugccggacgguucuaucuuaacggcagagagcgccagguguuuacccugaucaaauucgaaaagucuauuacaguugagaaaauccucgaacuggugaagcugcccucccuucucgacgaggccuaccgggaucuggucaaugaaaacaaaaaucacaagcugagagacgugauccaacucagcaagaccauuauggcucugguucuuucccauucugauaaagagaagcagaucgggggaaacuacauucacagcaaacuguccggcuauaaugcccucaucucuaagcgggacuuuauuagcagauacuccgugcagaccacaaacgggacgcagugcaaacuggcgaucggcaagggaaagagcaaaaagggcaaugagaucgaucgcuauuucuacgcuuuucaauucuuuaaaaacgacgauucuaagauuaaucugaaagucaucaagaacaauucccacaagaacauugacuucaacgacaaugaaaacaaaaucaaugcccuucagguguauagcucuaacuaccagauucaguuucucgauugguucuucgagaagcaucaagggaaaaagaccucccuggaagucggaggcagcuuuacaaucgccgagaaaucucugaccaucgacuggagcggguccaauccucgggugggauucaagagaagcgauacagaggaaaagcgcguuuuugugucucagcccuucacccucauuccggacgaugaggacaaagaaagacggaaggagcgcaugaucaaaacgaagaacagauuuauuggcaucgauauuggggaauauggccuggcuuggucccuuaucgaggucgacaauggagauaaaaacaaucggggcauucgccagcuggagagcggguucaucacagacaaccagcaacaggugcucaagaaaaauguuaaguccuggagacagaaccaaauccggcagaccuuuaccucuccugauacaaagauugcccgccugagagaaagccugaucggauccuacaaaaaucagcuugagucucucaugguggcuaagaaagccaaccugagcuucgaauacgaggucuccggcuuugaaguugggggaaagcggguggcgaaaauuuaugacucuaucaagcgcggcagcgugagaaagaaagacaauaacucccagaaugaucaaagcugggggaagaaaggcauuaacgaguggucuuucgagaccacagccgcuggaacgucccaguuuuguacccacugcaagcgguggagcucucuggccaucgucgacaucgaagaguacgaacucaaagauuauaacgacaaucuguucaaggugaagauuaacgauggcgaggugagacuucuggggaaaaagggauggcgcuccggcgagaaaaucaaggggaaagaacucuucggacccgucaaggacgcuaugcggccuaauguggauggccuggggaugaagauuguuaaaagaaaguaccugaaacuugaccugcgcgauugggugagccgguauggcaacauggccaucuuuauuugucccuacgucgacugccaucacaucucucacgcggauaagcaggccgcuuucaauaucgccgugagaggauaucucaaauccguuaaccccgaccgcgcuauuaagcauggcgauaaagggcugagccgggacuuucucugucaggaggaaggaaagcugaauuucgagcaaaucggccuucuguga

SEQ ID NO: 11484 - RNA, 3462 nt, Artificial Sequence
  CasY variant__Candidatus Vogelbacteria bacterium__PIP58309.1__CasY
augcagaaggugagaaaaacccugagcgagguccacaagaaccccuacggcacaaaaguucggaaugccaagacgggguauucccuccaaaucgaacgccugucuuacaccggaaaagagggcaugagauccuucaagauuccucuugaaaacaagaauaaagagguguuugacgaguucgugaagaaaauccggaacgauuauauuucccaggucgggcugcucaaucugucugacugguacgaacauuaucaggagaagcaggaacacuacagccuugcugauuuuuggcuggacucccuccgcgccggagugaucuucgcgcauaaagagacagaaauuaagaaccugaucucuaagaucagaggcgauaaaagcauuguugacaaguuuaaugcuuccaucaaaaagaaacacgccgaucuguaugcccucguggacauuaaggcucuguacgauuuccuuaccagcgacgcccggcgcgggcugaaaacagaggaggaauuuuucaacucuaagagaaauacccucuuuccgaaguuccggaaaaaggauaacaaagcugucgaccugugggugaagaaauuuaucggacuugauaauaaggacaagcugaacuucacgaaaaaguuuauuggcuucgaccccaauccucaaaucaaauacgaucauaccuucuuuuuccaccaggacauuaacuuugaucucgagcgcaucacgacccccaaggaacugaucuccacauauaaaaaguuccugggcaagaauaaagaccucuacgggagcgaugagaccacagaagaccagcugaagaugguucuuggauuucacaacaaccauggcgccuucucuaaauauuuuaaugcgucccuggaggccuucagagggcgggauaacagccucguggagcagauuaucaauaacucuccuuacuggaauagccaccgcaaggaacuggagaaaagaauuaucuuucuucaaguccagagcaagaagauuaaagaaaccgagcugggaaagccccaugaauaucucgcuuccuucggcgggaaauuugagucuugggugagcaacuaccugcggcaggaggaagaggugaagcgccagcuguucggauaugaagagaauaaaaagggccaaaagaaguuuaucgucggcaacaagcaggaacucgacaaaaucauuagagggacggaugaguacgagaucaaggccauuuccaaagaaacaaucggacugacccagaagugccuuaaacugcucgagcaacugaaggacagcguugaugacuacacacuuucucuguaucggcagcucauuguggaacugagaauccgccugaauguggaguuccaggagaccuacccugaacucaucggcaaguccgagaaagacaaggaaaaagaugcuaagaacaaacgggccgacaagagauauccgcagauuuucaaggauaucaaacugauucccaauuuucuuggggagaccaagcaaauggucuacaaaaaguucauccgcagcgcggacauucuguaugaaggaaucaacuuuauugaucagaucgacaaacagaucacacagaaucuccugccuuguuucaagaacgauaaggagcggauugaguuuacggaaaaacaauucgagacccugagacgcaaguacuaucuuaugaacucuagccgguuucaccacgugaucgaaggcauuaucaauaacagaaaacucauugagaugaagaaacgcgaaaauuccgagcugaagacauucucugacagcaaauuuguucuguccaaacucuuccugaagaaagggaagaaauacgagaacgaaguguacuauaccuuuuacaucaaucccaaggcccgggaucagagacgcaucaaaauuguccuugacaucaacggaaauaacagcgugggcauucugcaggaucucguucagaagcugaagccuaaaugggacgauaucauuaagaaaaaugacaugggcgagcugaucgacgcuaucgaaauugagaaggugcggcuugggauccucauugcccuguauugcgaacauaaauucaagaucaagaaagagcugcucucucuggaucuuuuugcuuccgccuaccaauaucuggagcucgaagacgaucccgaggaacugagcggaacaaaccugggcagauuccuucagucucucgucuguuccgagauuaagggggccaucaauaaaaucagccggaccgaguacauugaacgcuauacggugcagccgaugaacacagagaagaauuacccucugcugaucaacaaagaaggaaaggcuaccuggcacauugcggccaaggacgaucucuccaaaaagaaaggcgggggcaccgucgcuaugaaucagaagaucggcaaaaacuucuuuggaaagcaagacuacaagacaguguucaugcugcaggauaaaagauuugaccuucugaccucuaaguaucaucuccaguuccugagcaaaacacuggauacagggggaggcuccugguggaagaauaaaaacauugaccuuaaccucucuagcuacuccuuuaucuucgagcaaaagguuaaaguggaaugggaucugaccaaucuggaccaccccauuaagaucaagccuagcgagaacucugaugaccggagacucuuugucuccauccccuucgugauuaaacccaagcagacaaaacgcaaggaccugcagacccggguuaauuauauggggaucgauauuggagaguacggccuugccuggacaaucauuaacaucgaccugaaaaauaagaagaucaacaaaauuagcaagcagggguuuaucuaugaaccucucacccauaaagugagagauuacgucgccacgauuaaggacaaucaagugcgcggcaccuucggaaugccggauacaaaacuggcuagacugcgggagaacgccaucaccucucuucgcaaucaggugcacgacauugcgaugagauaugaugcuaagcccguuuacgaauuugagaucuccaacuucgaaacaggcagcaauaaggucaaagugaucuacgacucugugaagcgggccgauauugggcgcggacagaacaauaccgaggccgacaacacggaggucaaucugguguggggcaaaacaagcaagcaguucgggucccaaaucggagcuuaugccaccagcuacauuugcucuuuuuguggcuauuccccuuacuaugaguucgaaaacagcaaauccggggaugaagagggcgcuagagacaaccucuaccagaugaagaagcugucucggcccagccucgaagacuuucugcagggaaauccuguuuauaaaacauuccgcgauuuugacaaguacaaaaacgaucagagacuucaaaagaccggcgacaaagauggggaguggaagacccaccggggaaauacagccaucuacgcgugccagaaauguuga

SEQ ID NO: 11485 - RNA, 3480 nt, Artificial Sequence
  Cas13a variant__Leptotrichia buccalis__WP_015770004.1__Cas13a
augaaaguaacaaaaguaggaggaauaucacacaagaaauacacauccgaaggcagauuagucaaaucagaauccgaagaaaacagaacggaugaaagacucucagcacuucuaaacaugagacuagauauguacauuaaaaauccaucuaguacagaaacaaaagaaaaucaaaaacgaauaggaaaacuaaagaaauuuuucucaaacaaaaugguauaccuaaaagacaacacucuaucucucaaaaacgggaagaaagaaaauauagaucgcgaauacagugaaaccgacauccuagaaucugacguacgagauaagaaaaauuuugcuguccuaaagaaaauauaccuaaacgaaaacgucaauucagaagaacuugaaguauuuagaaacgacauuaaaaagaaauuaaauaaaauaaacucacuaaaauauucauuugagaaaaauaaagcuaauuaccagaaaaucaacgaaaacaacauagaaaaaguugaaggaaaauccaaacgaaacauaaucuaugacuacuaccgugaaucagcaaaaagagaugcauacguaucaaacguaaaagaagcauucgauaaacuauacaaagaagaagacaucgccaaacugguucuagaaaucgaaaauuuaacaaaacuggaaaaauacaaaauacgggaguucuaucacgaaaucauaggcaggaaaaacgacaaagaaaacuucgcaaaaauaauauaugaagaaauacaaaaugucaacaacaugaaagaauuaauagagaaaguuccggacaugagugaacuaaagaaaagucaaguauucuacaaauacuaucuagacaaagaagaauuaaaugauaaaaacaucaaauaugcauucugccauuuuguagaaauagaaaugucacaacuacucaaaaacuacguauauaaacgauuaucaaauauaucaaaugauaaaaucaaacgaaucuucgaauaucaaaaucucaagaaauuaauagaaaacaaacuacuaaacaaacuagacaccuaugucagaaacuguggaaaauacaauuauuaccuccaagauggagaaauagccacaucugacuucaucgccagaaacagacaaaacgaagcauuccuccgaaacauuauaggaguuucauccguagccuauuucuccuuacgaaacauucuagaaacagaaaacgaaaaugauauaaccggacgaaugcgaggaaaaacagucaaaaacaauaaaggagaagaaaaauacguaucuggagaaguagacaaaauuuauaaugaaaacaagaaaaacgaagucaaagaaaaccugaaaauguucuauagcuacgauuucaacauggacaauaaaaacgaaauugaagacuucuucgccaauauagacgaagcaauaucaagcauccgccacgguauaguccacuuuaaucucgaacuagaaggcaaagacauuuucgccuuuaaaaacauagcaccuucagaaaucucuaagaaaauguuucaaaacgaaaucaaugagaagaaacugaaacuaaaaauauuucgacaauugaacagcgcuaauguauucagauaucuagaaaaauauaaaauucucaauuauuuaaaacgcaccagauucgaauuuguuaacaaaaacauaccauuuguaccauccuuuacaaaauuauacagucgcauagacgaccucaaaaauagucucgguauuuacuggaaaacaccaaaaacaaaugaugacaacaaaacaaaagaaaucaucgaugcucaaauauaucuccugaaaaauauuuacuacggugaguuccuaaacuacuucaugagcaacaacgggaacuuuuucgaaauaucuaaagaaaucaucgaacuaaacaaaaacgacaaaaggaaccuaaaaacaggcuucuacaaauuacaaaaauucgaagauauacaagagaaaauacccaaagaauacuuagcaaauauccagagcuuauauaugauaaacgcaggaaaccaagacgaagaagaaaaagacacauacauagacuucauccagaaaauauuccugaaaggauucaugacauaccuagcaaauaacggaagacucagccucauauacauugggagcgaugaagaaacaaacaccucacuagcagagaagaaacaagaguucgacaaauuccucaagaaauaugaacaaaauaacaacaucaaaauaccguaugaaauaaaugaguuccuaagagaaauaaaacugggaaacaucuuaaaauacacagaaagacuaaacauguucuauuuaauacuuaaauuacuuaaccacaaagaacuuacuaacuuaaaaggcucacucgaaaaauaccaauccgccaacaaagaagaagcauucucggaccaacuagaauuaaucaaucuacuaaaccucgacaacaauagggugaccgaagacuucgaacuagaagcggaugaaauagguaaauuucuagacuucaacggaaauaaagucaaagacaacaaagaacuaaagaaauucgauaccaacaaaauuuacuucgacggagaaaauauuaucaaacaccgcgcauucuacaauaucaagaaauacggaaugcuaaaccuacuagagaaaauagcagacaaagccggauauaaaauaaguauagaagaauuaaagaaauacucaaauaagaaaaacgaaauagagaaaaaccauaaaaugcaagaaaaccuacaccgaaaauacgcacgcccacgaaaagaugagaaauucacagacgaagacuacgaaagcuacaaacaagcaauagaaaacauagaagaauacacacauuuaaagaacaaaguugaauuuaaugaacuaaaccuacuucaaggcuuacuauuacgaauacugcaccgccuaguaggauauacauccauaugggaaagagauuuacgauuccgccuaaaaggagaguuuccagaaaaccaauauauagaagaaauauucaacuuugaaaacaagaaaaacgucaaauauaaaggcggccaaauaguagaaaaauacauaaaauucuacaaagaacuacaccaaaacgacgaaguaaaaaucaacaaauacucgucagcaaacaucaaaguucucaaacaagagaagaaagacuuauacauacguaacuacaucgcucacuuuaacuauaucccacaugcagaaauaucucuccuugaaguucuagaaaauuuaagaaaauuacucaguuacgacagaaaacuuaaaaaugccguaaugaagucagucguagauauauuaaaagaauacggauucguagcaacauuuaaaauaggagccgacaagaaaauaggaauccaaacauuagaaagcgagaaaauaguccaccucaaaaaucuuaaaaagaagaaauuaaugaccgauagaaacucugaagaacucugcaaacuuguaaaaaucauguucgaauauaaaauggaggagaaaaagagugaaaacuga

SEQ ID NO: 11486 - RNA, 3480 nt, Artificial Sequence
  Cas13a variant__Leptotrichia buccalis__WP_015770004.1__Cas13a(R472A,H477A)
augaagguaacuaaaguaggcggaauuagccauaaaaaauacacaucugagggccgauuaguuaaaucagaauccgaagaaaacaggaccgaugaaagacugagugcacuacugaacaugagacuugacauguauauaaaaaacccaucaaguacagaaacaaaagagaaccaaaaaaggauaggaaagcuaaaaaaauucuuuaguaacaaaaugguauaucuuaaagauaacacccucucauuaaaaaacggcaaaaaagaaaacauagaccgagaauacagugaaacggacauccuagaauccgauguccgcgauaaaaaaaauuucgcuguacucaaaaaaauauaccuaaaugaaaacguaaauucugaagaacuagaaguuuuccgaaaugacauaaagaaaaaacuaaauaaaauaaacagccuaaaauacuccuucgaaaaaaacaaagcuaacuaccaaaaaaucaaugaaaacaacauagaaaaaguagaaggaaaaucaaaaagaaacauaauauacgacuauuaucgagaauccgccaagagagacgcuuacguauccaacguaaaagaagcauucgauaaacuuuacaaagaagaagacauagcgaaacuaguucucgaaauagaaaacuuaacaaaacuagaaaaauacaaaauccgagaauuuuaccaugaaaucauugguagaaaaaacgacaaagaaaauuuugcaaaaauaauuuaugaagaaauucaaaaugucaacaacaugaaagagcugaucgaaaaagucccugacaugucagagcucaaaaaaucccaaguauucuacaaauauuaccuagacaaagaagaacuuaacgacaaaaacauuaaauacgcguucugccacuucguagagauugaaaugagccaauuauuaaaaaauuacguauacaaaagacucucaaacauauccaacgauaaaaucaaaagaauauucgaauaccagaaccucaagaaacuaaucgaaaacaaauuauuaaacaaacuagacacuuacguaagaaauugcggcaaguauaauuacuaccuacaagacggagaaaucgcaacaagugacuuuauagccagaaaccgccaaaaugaagcguuccuaagaaacaucauaggaguaucaaguguagcauacuucagucugagaaacauacucgagacagagaaugaaaacgacauaacuggcagaaugagaggcaaaacaguaaaaaacaacaaaggugaagaaaaauacguauccggcgaaguagacaaaaucuauaacgaaaauaaaaaaaaugaagucaaagaaaacuuaaaaauguucuacucauacgauuucaacauggacaacaaaaacgaaauagaagauuucuucgcuaacauagaugaagcaaucagcucuauagcccacggaaucguagcauucaauuuagaacuagaaggaaaggacaucuuugcauucaaaaauauagccccaagugaaauaaguaaaaaaauguuccaaaaugaaauaaacgaaaaaaaacugaaauuaaaaauuuuucgacagcucaacagcgcaaacguguuccgauacuuggaaaaauacaagauacuaaacuaucuuaaaagaacuagguuugaguucguaaacaaaaacaucccauuuguaccaucauucacaaaacuauauucgaggaucgaugaccuuaaaaauucauuaggcaucuacuggaaaacaccaaaaaccaaugaugacaacaaaacaaaagaaauaauagaugcacaaauauaucuacuaaaaaacaucuauuauggcgaauucuuaaacuacuucaugaguaacaacggaaacuuuuuugaaauauccaaagaaaucauagaacucaacaaaaaugauaagcgaaaccuaaaaacaggauucuauaaacuacaaaaauucgaagacauacaagaaaagauaccaaaagaauaccuagcuaacauacaaagucucuacaugauaaacgccggaaaucaggacgaagaagaaaaagacacauauauagacuucauccaaaaaauauuccuaaaaggguucaugaccuacuuagcaaacaacgguagacuaagccucauauacaucgggucagacgaagaaacaaacacaaguuuggcagaaaaaaaacaagaauuugacaaauuuuuaaaaaaauaugaacaaaauaacaacauaaaaauucccuacgaaauaaacgaauuuuuacgagaaauuaaacugggaaacauacuaaaauauaccgaaagacuaaacauguucuacuuaauuuuaaagcuacuaaaucacaaagaacuaaccaauuuaaaaggcaguuuagaaaaauaucaaagcgcgaacaaagaagaagcauucagcgaucaacuagaacuaauaaaccuauuaaaccuagacaauaacaggguuaccgaagacuucgaacucgaagcagacgaaaucgguaaauuccuagacuucaacggaaacaagguaaaagauaacaaagaacucaaaaaauucgacacaaacaagauauacuucgauggugaaaacauaauaaaacacagagccuuuuacaacauaaaaaaauacggaauguuaaaccuccucgaaaaaauagcagacaaagcaggauacaaaauuucaauagaggagcucaagaaauacucaaacaaaaaaaacgaaauagaaaaaaaccacaaaaugcaagaaaaccuucaccgcaaauacgcuaggccgaggaaagaugaaaaauuuaccgacgaagacuaugaauccuauaaacaagccauagaaaacauagaagaauacacucaccuuaaaaacaaaguagaauucaacgaacuaaauuugcuccaagggcucuuacuacguauacuacaccgccugguaggauacacaaguauaugggaaagagaccugagauuuagguugaaaggggaauuuccagaaaaccaauauauagaagaaauauucaacuuugaaaauaaaaaaaacgucaaauacaaaggcggacaaauaguagaaaaauauauaaaauuuuacaaagaauuacaccaaaacgacgaagucaaaauaaauaaauacagcucagcuaacauaaaaguacuaaagcaagaaaaaaaagaucuauacauaagaaauuacauagcucauuuuaacuacauuccucaugcagaaaucagccuccuagaaguacuagagaaucuuagaaaacuacucucuuaugaucgcaaauugaaaaacgcaguaaugaaaucaguaguagauauacuaaaggaauauggcuucgucgccacauucaaaaucggagcagauaaaaaaauagguauccaaacccucgaaagugaaaagauaguacacuuaaaaaaucuuaaaaaaaaaaaacuaaugacagacagaaacucagaagaauuaugcaaacuugucaaaauaauguuugaauacaagauggaagagaaaaaaagcgaaaacuaa

SEQ ID NO: 11487 - RNA, 3480 nt, Artificial Sequence
  Cas13a variant__Leptotrichia buccalis__WP_015770004.1__Cas13a(R1048A,H1053A)
augaaaguuacaaaaguaggaggaauaagccauaagaaauacacaagugaaggaagguuaguaaaaagcgaaucagaagaaaacagaacagacgagcgucuaucagcccuacuaaacaugagacuagacauguacaucaaaaaccccucaagcacagaaacaaaagaaaaccaaaaacguauagguaaacucaagaaauuuuucagcaauaaaauggucuaccuaaaagacaacacacuaagucucaaaaauggaaagaaagaaaacauugacagagaauauuccgaaaccgauauacuagaaagcgacguaagagacaagaaaaauuucgcagugcuaaagaaaauauaccuaaaugaaaacgucaacucagaagaacuagaaguguucagaaacgauaucaaaaagaaauuaaacaaaauaaauagucuuaaauauucauucgagaaaaauaaagcaaacuaucagaaaauaaacgaaaacaacauugaaaaaguagaagguaaaucaaaacgaaacauuauauaugauuacuaucgagaaucugccaaaagggacgcauacguaaguaacgucaaagaagcauucgauaaauuguacaaagaagaagauauagcaaagcuaguccuagaaauagaaaauuuaacaaaacuagaaaaauauaaaauacgcgaauuuuaccacgaaaucaucggaaggaaaaaugauaaagagaacuuugcaaaaauaaucuacgaagaaauccaaaacgucaauaacaugaaagaacuaaucgaaaaaguaccagauaugucagaacuuaagaaaucccaaguuuucuacaaauauuaucuagauaaagaagaauuaaacgacaaaaauaucaaauaugcauuuugccacuucguagaaaucgaaaugucgcaacuacucaaaaauuacgucuacaaaaggcuaucaaacauaaguaacgauaaaauaaaaagaauauuugaauaucaaaaccucaagaaauugaucgagaacaaacuacuuaacaaacuagacacauacguuagaaacugcggaaaauacaauuacuaccuacaagauggugaaaucgcaacuucagauuuuauugcacgaaacagacaaaacgaagcauuucuaagaaacauaaucggaguaucauccgucgcauauuucucacuaagaaauauacuagaaaccgaaaaugaaaaugauauaacaggcagaaugagaggaaaaacagucaaaaacaauaaaggagaagaaaaauacgucucaggcgaaguagacaaaaucuacaaugaaaauaagaaaaacgaagucaaagaaaacuuaaaaauguucuauucguacgauuuuaauauggacaauaaaaacgaaauagaagacuucuuugcaaacauagaugaagcaauaagcucaauacgacauggcaucguccauuucaaccuggaauuagaaggaaaagacauauuugcauuuaaaaacauagcaccaucagaaaucagcaagaaaauguuccaaaacgaaauaaaugagaagaaacuaaaacugaaaauauucagacaacuaaauagcgcaaacguuuucagauaccucgaaaaauauaaaauacuaaacuaucucaaaagaacacguuucgaguucguuaauaaaaacauaccguucguuccaucuuucacaaaacuuuacucccgaauagacgaucucaaaaacagucuaggaaucuauuggaaaacuccuaaaacaaacgacgacaauaaaacaaaagaaauaauagacgcucaaauauaucuauuaaagaauauauauuacggagaguuccugaacuauuucaugagcaacaacgguaacuuuuucgaaauaaguaaagaaauaaucgaacuaaauaaaaaugacaaacggaaucuuaaaacaggauuuuacaaacuucaaaaauucgaagacauacaggagaaaauaccaaaagaauauuuagccaacauacaaucucuguauaugauaaacgcgggaaaccaagacgaagaagaaaaagauaccuacauugacuucauacagaaaauauuucuaaaaggcuuuaugacauacuuagccaauaacggaagauugucacucauauauaucggcucagaugaagaaaccaauacaagucuagcagaaaagaaacaagaguucgauaaauuccucaagaaauaugaacaaaauaacaauauaaaaauaccauaugaaauaaacgaauuucuaagagaaauuaaacucgguaacauuuuaaaauacacagaaaggcuaaacauguucuaccuuauacuaaaacuacuaaaucauaaagaacuaacgaaccuaaaaggaucacuggaaaaauaccaauccgcaaauaaagaagaagccuucagugaucaacuggaacuaauaaaccuacucaaucuagacaacaaccgaguaacugaagacuuugaacuugaagcagaugaaauaggaaaauuccuagacuucaacgguaacaaaguaaaagacaauaaagaacuaaagaaauucgauacaaauaaaauauauuucgacggugaaaacauaauaaaacaucgcgcauucuacaacauuaagaaauauggcaugcucaaccuccuagaaaagaucgcggacaaagcaggauauaaaauaagcaucgaagaauugaagaaauauagcaacaagaaaaaugaaaucgagaaaaaccacaagaugcaagaaaacuuacauagaaaauacgcgagaccuagaaaagaugaaaaauuuaccgaugaagacuacgagucauacaaacaagcaauagaaaauauagaagaauauacacaccucaaaaauaaaguagaauuuaacgaacugaacuuguuacaaggauuacuacuccgcauccuccacaggcucgugggauacacaagcaucugggaaagagaucugagauucagauuaaaaggagaauuuccagagaaccaauacauugaagagauauucaauuucgaaaacaagaaaaauguaaaauauaaaggaggccaaauaguagaaaaauauauaaaauucuauaaggaacuacaccaaaacgacgaaguaaaaauaaacaaauacucaucugcuaauauuaaagugcucaaacaagagaagaaagacuuauacauugccaacuacauagcagcguuuaauuacauaccacaugcugagaucucccuacuagaagugcuggaaaaccuaaggaaacuacuaaguuaugacagaaaacucaaaaacgccguuaugaaguccguaguagauauacuaaaagaauauggauucguggcgacauucaaaauaggggccgauaagaaaaucggcauucaaacucucgaaagcgagaaaauaguccaccucaaaaaucuaaagaagaagaaauugaugacagacagaaauagugaagaauuguguaaauuaguuaaaauaauguucgaauacaaaauggaggagaagaaaucagaaaacuaa

SEQ ID NO: 11488 - RNA, 3480 nt, Artificial Sequence
  Cas13a variant__Leptotrichia buccalis__WP_015770004.1__Cas13a(R472A,H477A,R1048A,H1053A)
augaaaguaacaaaaguaggggggauaucucacaaaaaauacacaagugaaggaagauugguaaaaucggaaucagaagaaaacagaacagacgaaagacucuccgcacuacugaauaugcgacuugacauguacaucaaaaaccccucaucuaccgagaccaaagaaaaucaaaaacgaauaggaaaacucaaaaaauuuuucagcaacaaaaugguuuacuuaaaagauaacacacucucgcuaaagaacggcaagaaagaaaacauagacagagaauauuccgaaacggauaucuuagaaucagacgucagagacaaaaaaaacuucgccgugcuaaaaaaaaucuaucucaacgaaaaugucaacuccgaagagcuagagguuuucagaaacgacauaaagaaaaaacugaacaagauaaacucucuaaaauacucauuugaaaaaaacaaagcaaauuaccaaaaaauaaacgaaaacaauauugaaaaagucgaagguaagagcaaacgaaacaucaucuaugauuauuacagggaaucagcuaaaagagacgcguacgucagcaacguaaaagaagcauuugauaagcucuauaaagaagaagacauagcaaaauuaguccuagaaauagaaaaccuaacuaaacuagaaaaauacaaaauaagagaauucuaucacgaaauaauaggccgaaaaaaugacaaagaaaacuucgccaaaauaauuuaugaagaaauucaaaacguaaacaacaugaaagaacuaauagaaaaagucccugacaugagcgaauuaaaaaaaucacaaguauucuacaaauacuaccuagacaaagaagaacuaaacgacaaaaacauaaaauacgcauucugccauuuugucgaaauagaaaugucacaacuacucaaaaacuacgucuauaaacggcuaagcaacauaucaaacgacaaaauaaaaagaaucuuugaauaccaaaaucuaaagaaacuaauagaaaauaaguuauuaaacaaacucgacacauacguacgaaacugcggcaaauacaacuacuaccuacaagauggagaaauagcaaccucugacuucaucgcaagaaaccgacaaaacgaagcauuucuaagaaacaucauaggcguaagcagcgucgccuacuucucauuaagaaacauacuagagacagagaacgagaacgacauuacagguagaaugagaggaaaaaccgugaaaaacaacaagggagaagaaaaauaugugucuggagaagucgacaaaauauauaacgagaacaaaaagaaugaaguuaaagaaaauuuaaaaauguucuacucuuacgauuuuaacauggacaauaaaaaugaaauagaagacuuuuuugccaacaucgaugaagcuauaucaaguaucgcacacggcauaguugccuucaaucuagaacuagaaggaaaagauauauuugcauucaaaaauauagcaccaucagaaaucuccaaaaaaauguuccagaacgaaauuaacgaaaaaaaauuaaaauugaaaauauuucgacaacuuaacucugcaaacguauuccgauaccucgaaaaauacaaaauacuaaauuaucuaaagagaaccagauuugaauucguaaacaaaaacauacccuucguuccuucauucacaaaacucuacucacgaaucgacgaccuaaaaaauucacuaggaauauauuggaagacaccgaagacuaaugacgauaacaaaacuaaggaaaucauugacgcccagauauaccuacuaaaaaacauauacuacggagaauucuuaaauuacuuuaugucgaacaauggaaauuuuuuugaaauaagcaaagaaauaaucgaauuaaauaaaaacgauaaaagaaaccuaaagacaggcuuuuauaaacuacaaaaguuugaagacauacaagaaaagaucccuaaagaauaccuagcaaacauucagucacuauacaugauaaacgcuggaaaccaggacgaagaagaaaaagacaccuacaucgauuucauacaaaaaaucuuccuaaaagguuucaugaccuaccuggcaaacaauggacgccuauccuugaucuacaucggauccgaugaagaaacaaacacaagccuagccgaaaaaaaacaggaauucgacaaauuccuaaaaaaauaugaacaaaauaacaacauaaagauaccauacgaaauuaacgaauuccucagagagaucaaacuaggaaauauacuaaaauacaccgaacgauuaaacauguucuacuuaauccucaaacuccucaaucauaaagaacuaacuaacuuaaagggaagccuagaaaaauaucaaagcgccaauaaagaagaagcuuucucagaccaacuagaacuaauaaacuuauuaaauuuagacaacaaccgagucacagaagacuucgaauuagaggccgaugaaauaggaaaauucuuagacuucaauggaaacaaaguaaaagacaacaaagaacuaaaaaaguucgauaccaauaagauauacuuugacggcgagaauauaauaaaacaucgugcauucuauaacauaaaaaaauacgguauguuaaaucuuuuagaaaagaucgcagauaaagcaggauacaagauaagcauagaagaacuaaaaaaauacagcaauaagaagaaugaaauagaaaaaaaucacaaaaugcaagaaaacuugcaccgaaaauacgcuagaccaagaaaggacgaaaaauucacggaugaagacuacgaaagcuacaaacaagcaaucgagaacauagaagaguacacacacuuaaaaaauaaaguagaauucaacgaacuuaaccuucuccaaggacuacuccuucgaauuuuacaccgacuaguaggcuauacaucaaucugggaaagggaccuaagauucaggcuaaaaggagaauucccugaaaaucaauacauagaagaaauauucaauuucgaaaauaaaaaaaacguaaaauacaaaggaggccagauugucgaaaaauacaucaaauucuacaaagaacuacaucaaaacgaugaagucaaaauaaauaaguacucaucagcuaacaucaaaguacuuaaacaagagaaaaaagaccucuauauagcaaauuauauugcagcuuuuaauuacauuccacaugcagaaaucagccuuuuagaaguacuugaaaaccuaagaaaacugcugucauacgauagaaaauuaaaaaacgcaguaaugaaaucaguaguugacauccuaaaagaauauggcuuuguagcaacguucaaaauuggagcagacaaaaaaauaggcauccaaacacuagaauccgaaaaaauaguacaccugaaaaaucuaaaaaaaaaaaaacuaaugaccgacagaaacagcgaagaacuuugcaaauuaguaaaaauuauguucgaauauaaaauggaagaaaaaaaaagcgaaaacuaa

SEQ ID NO: 11489 - RNA, 3480 nt, Artificial Sequence
  Cas13a variant__Leptotrichia buccalis__WP_015770004.1__Cas13a(R1079A)
augaaaguaacaaaaguaggugguauaucacauaaaaaauacaccucggaaggaagacugguaaaaagcgaaucagaagaaaaucguaccgacgaaagauuaagcgcacuacuuaacaugagacuagacauguauauaaaaaauccaucaagcacugagacaaaagaaaaccaaaagagaauuggaaaacuaaaaaaauucuuuucaaacaagaugguauaucuaaaagauaacacccuaucauuaaaaaacgguaaaaaagaaaacauagaccgugaauauuccgaaacagacauccucgaaucugacguccgagacaaaaaaaacuuugcaguacucaaaaaaauauaucuaaacgaaaacgucaacucagaagaacuagagguauuucgaaacgacauuaaaaaaaaauuaaacaaaauaaauucauuaaaauacucauuugaaaaaaacaaagcgaauuaccaaaaaauaaaugagaacaacauagagaaaguagaaggcaagucaaaaagaaacaucauauacgauuauuauagagaauccgcaaaaagagaugccuacguaucgaacgugaaagaagcuuuugacaaacuauauaaagaagaagauauagccaaauugguacuggaaauugaaaaccucaccaaacuugaaaaauacaaaaucagggaauucuaccacgagaucauuggccgaaaaaaugacaaagaaaacuucgcaaaaauaauauaugaagagauacaaaacgugaacaacaugaaagaacuaauagaaaaaguccccgacaugucagaauuaaaaaaaagccaagucuucuacaaauacuaccuagacaaagaagaauuaaaugacaaaaacauaaaauaugcuuuuugccauuuuguagaaauagaaaugucacaacuacuuaagaacuauguauacaaaagacuaucuaauauaucaaaugacaaaaucaaacgaauauuugaauaccaaaauuuaaaaaaacucauugaaaacaaacuacuaaacaaauuagacacauauguacguaacuguggaaaauacaacuauuaucuacaagacggagaaauagcaaccucagacuucauugcaagaaaucgacaaaaugaagccuuccuaagaaauaucauaggugucuccucaguugcauauuucucucuacgcaacauacucgaaacugagaaugaaaacgacauaacaggacgaaugagaggcaaaacgguaaaaaacaauaagggagaagaaaaauacgucagcggcgaagucgauaaaauauacaacgaaaacaaaaaaaacgaagugaaagaaaauuuaaaaauguuuuacaguuacgacuucaacauggacaauaaaaacgaaaucgaagauuucuuugcaaauauagacgaagcaaucagcucgaucaggcacggaaucguccauuuuaaccuagagcuugaaggaaaagacaucuucgcauucaaaaauauagcgcccagugaaauaucaaagaaaauguuccaaaacgagauaaacgaaaaaaaacucaaacucaagauauucaggcaacuaaacucagcaaacgucuuuagauaucuagagaaauauaaaauacuaaacuaucuaaaaaggacaagauuugaguucgugaauaaaaacauaccauucguaccuucuuucacaaaacuauacagccggaucgaugaucuaaagaauagccuaggaauauauuggaaaacaccaaagacaaacgaugacaacaaaacaaaagaaaucaucgacgcacaaauauaccuacuaaaaaacaucuacuacggggaauuccugaacuauuuuaugagcaacaaugguaauuuuuucgagaucagcaaggaaauaauagaacuaaacaaaaacgauaaaagaaaucuaaaaacaggauucuacaaacuacagaaauucgaagacauccaagaaaaaauaccaaaagaauacuuagccaauauccaaucacuauauaugauuaacgcaggaaaucaagacgaagaagaaaaagacaccuauauagacuucauacagaaaauauuucucaaaggcuuuaugacguaucucgcaaacaacggaagauuaucguuaauauacauaggaucugaugaagaaacuaacacgagcuuagcugaaaaaaaacaagaauucgacaaauuucugaaaaaauacgaacagaacaacaauauaaagauccccuaugaaaucaacgaguucuugagagaaauaaagcuaggaaauauacucaaauauacagagagacuaaauauguucuaccucauacuaaaacucuuaaaccauaaagaacucacaaaccugaaaggaucucuagaaaaauaccaauccgcaaacaaagaagaagcauuuagcgaccaacuugaacugaucaaccuacuaaaccuagacaauaauagagucacagaggacuucgaauuagaagccgaugaaauagguaaauuuuuagauuuuaacggaaauaaagucaaagauaauaaagaacuaaaaaaauucgauacuaauaaaauauacuucgacggcgaaaauaucauaaaacauagagcauuuuacaauauuaaaaaguacggaaugcuaaaccuccucgaaaaaauagcagacaaagcaggguauaaaauaucgauugaagaacucaaaaaauauucaaacaaaaaaaaugaaauagaaaaaaaucauaaaaugcaagaaaaucuacacagaaaauaugcaagaccuagaaaagaugaaaaauuuacagacgaagacuaugagucguauaagcaagcaauagaaaacaucgaagaguacacacauuugaaaaacaaaguagaauuuaaugagcuaaauuuacuccaaggccuuuuauuaagaauuuuacaccgcuuagucggauacacaucaauaugggaaagagacuuaagauucagauugaaaggggaauucccagaaaaccaauacaucgaagaaauuuuuaauuuugaaaauaaaaaaaacguaaaauauaaaggcggacaaauaguagaaaaguacaucaaguucuacaaagaacuacaucaaaaugacgaaguaaaaauaaauaaauacagcucggcuaauaucaaagugcucaaacaagaaaaaaaagacuuauacauacgaaacuauauugcacacuucaacuauauaccacaugcagaaauaucguugcuagaaguucuggaaaaccuaaggaaauuguuaagcuaugacgcaaaacuaaaaaacgcggucaugaaaaguguuguagauauacuuaaagaauacgguuucgucgcaaccuuuaaaaucggagcggacaaaaagauaggcauacaaacccuugagucagaaaaaauaguccauuuaaagaaccuaaaaaaaaagaaguuaaugacugaccgaaacucggaagaauuaugcaaacuaguaaaaaucauguucgaauauaaaauggaagaaaaaaagucagaaaacuaa

SEQ ID NO: 11490 - RNA, 3480 nt, Artificial Sequence
  Cas13a variant__Leptotrichia buccalis__WP_015770004.1__Cas13a(E299A)
augaaaguaacaaagguaggaggcauaucacacaaaaaauacaccuccgaaggaagguugguaaaaucagaaagugaagaaaacaggacagaugaaaggcuuucggcguuauuaaauaugagacuagacauguacaucaagaacccaagcucaaccgagacaaaagaaaaccaaaaacgaauaggaaaauuaaaaaaauuuuucaguaacaaaaugguauaccucaaagacaacacacuuagccuaaaaaacgguaaaaaagaaaacaucgacagagaauauuccgaaacagacauacuagaaagcgauguacgagauaaaaaaaacuucgcuguauuaaaaaaaaucuaccuaaaugaaaacguuaauucggaagaacuagaaguauuuagaaacgacauaaaaaaaaaacuaaacaaaauaaacucauuaaaauacaguuuugaaaagaacaaagcaaacuaccaaaaaauaaacgagaacaauauagaaaaggucgaaggcaaaucaaagcguaauaucauauaugauuacuacagagaaucggcaaaaagggaugcguacgucucaaacguaaaagaagcuuucgauaaacuguacaaagaagaagacauagcaaagcucguacuagaaaucgaaaaccuaacaaaacucgaaaaauacaaaauuagagaguucuaccacgaaaucauaggaagaaaaaaugauaaagaaaacuucgccaaaauaaucuacgaagaaauccaaaauguaaauaacaugaaagaacuaauagaaaaaguaccugacaugucagaacucaaaaaaucacaaguauucuacaaauacuaucuugacaaagaagaauuaaacgauaaaaauaucaaauacgcauuuugucauuuugucgagauagccaugucucagcuacuaaaaaacuauguauacaaacgccuuucaaacauaagcaacgacaaaauaaaaagaauauucgaauaccaaaaucuaaaaaaacucaucgaaaauaaacucuuaaacaaacuagauacauacgucagaaacugugggaaauacaauuacuacuuacaggauggcgaaauugcaaccucagacuuuauagcacgcaaucggcaaaaugaagcauucuuaagaaacauaaucgggguuucaucaguggcuuacuucagccuaaggaacauauuagagacagaaaacgagaaugacauaacaggaagaaugagaggaaaaacaguaaaaaauaauaaaggagaagaaaaauauguuaguggcgagguagacaaaauauauaaugaaaauaaaaaaaacgaagucaaagaaaaccuaaaaauguucuacaguuacgacuucaauauggauaauaaaaacgaaauugaagacuucuuugccaauauagacgaagcaauaagcucaaucagacacggaaucguccauuucaauuuagagcucgagggaaaagauauuuucgcauuuaaaaauauagcaccaucagagauaaguaaaaaaauguuccagaacgaaauuaacgaaaaaaaacuaaaauuaaagaucuuuagacagcuaaauagcgcgaacguauucagauauuuagaaaaauacaaaauacuuaauuaccugaaacguacaagauucgaauucguaaauaaaaauauccccuuuguaccaucauucacgaaacuauauucaagaauagacgaccuaaaaaauucacuagguauauacuggaaaacacccaaaacaaacgacgacaacaaaacaaaagaaauaauugaugcacagauauaucuccuaaaaaauaucuacuacggggaauucuuaaauuauuucauguccaacaauggaaacuuuuucgaaaucucaaaagaaauaauagagcuuaauaaaaacgauaaaaggaacuuaaaaacaggauucuauaaacuacaaaaauuugaagacauacaagaaaaaaucccuaaagaguaccuagcuaacauccaaucacuauacaugauuaacgcaggaaaccaagacgaagaagaaaaggauacauacaucgauuucauacaaaaaauauuucuaaagggguucaugacauaccuagccaacaacggcagacuuucacuaauauacaucgguucagacgaagaaaccaacacgagucuagcagagaaaaaacaagaauuugauaaauucuugaaaaaauaugaacaaaacaauaauauaaagaucccauacgaaauaaacgaauucuuaagagaaauaaaacuuggaaacauacuaaaguacacggaaagacucaacauguucuaccuaauccugaaacuauuaaaccauaaagagcuaaccaaccuaaagggaaguuuagaaaaauaccaaagugcuaacaaagaagaagcauuuagcgaucagcuagaauuaauuaaccucuuaaaccuggacaacaauaggguaacagaagacuucgaacucgaagccgacgaaauaggaaaauuuuuagacuuuaacggcaauaaagugaaagacaauaaagaauuaaaaaaauucgacaccaacaaaaucuacuucgacggugagaacauaauaaaacacagagccuucuacaacauaaaaaaauauggaauguuaaaucuacuagaaaaaauagcugauaaagcaggauacaagaucucuauagaggaacuuaaaaaauacucaaacaaaaaaaacgaaaucgaaaaaaaccauaaaaugcaagaaaaccuacaccgcaaauacgcacgaccaagaaaggacgagaaauucacagacgaagacuacgaaucauacaaacaagcaauagaaaauaucgaagaauauacacaccuaaaaaacaaaguggaauucaaugaacucaaccuuuuacaaggguuacucuuaagaauuuuacacaggcuagucggauacacaucuauaugggaaagagaucuacguuuucgacuaaaaggggaauucccagagaaccaauauauugaagaaauauucaacuucgaaaacaaaaagaauguaaaauauaagggaggacagaucguugaaaaauacauuaaauuuuacaaagaacuucaucaaaaugacgagguaaagaucaacaaauauucaucagcuaacaucaaaguguuaaagcaagaaaaaaaagaucuauacaucagaaauuacaucgcccauuuuaacuacauaccacacgcugaaaucucccuacucgaaguauuagaaaauuuacgaaaacuacuaucuuaugaccgcaaacuaaaaaaugcaguaaugaaauccguagucgacauccuaaaagaguacggauucguugcaacguuuaaaauaggcgcagacaaaaagauaggaauucaaacuuuagaaucagaaaaaauaguacaucucaaaaaccuaaaaaaaaaaaagcuaaugaccgauagaaauucagaagaacuaugcaaacuagugaaaauaauguuugaauacaagauggaagagaaaaaaagugaaaauuaa

SEQ ID NO: 11491 - RNA, 3480 nt, Artificial Sequence
  Cas13a variant__Leptotrichia buccalis__WP_015770004.1__Cas13a(K310A)
augaaaguaaccaaaguaggaggaauaagccauaaaaaauauacauccgaaggaagauugguaaaaucagaaucugaggaaaacagaacggacgaaagauuaagcgccuuauuaaacaugaggcuggauauguacaucaaaaacccaaguucaacugaaacaaaagaaaaccaaaaaagaauaggaaaacuuaagaaauuuuuuagcaauaaaaugguguacuuaaaagauaacaccuuaagucucaagaacggaaaaaaagaaaauauagaccgcgaauauucagaaaccgauauccucgaauccgacguaagagauaaaaagaacuucgcaguacuuaaaaaaauuuaccucaacgagaacguaaacagcgaagaacuagaaguauuccgaaacgauaucaaaaaaaaauugaauaaaauaaauagcuuaaaauacucauuugaaaagaacaaagcaaacuaucaaaaaauaaaugaaaacaacauagaaaaagucgaaggaaaauccaagcgcaacauuauauacgacuauuacagagaaucagcaaaaagagacgcauaugucucaaauguaaaagaagcauucgauaaacuuuacaaagaggaagauauagcaaaacuuguauuagaaauagaaaacuugacuaaacuugaaaaauacaaaaucagagaauucuaucacgaaauaauaggaagaaaaaacgacaaagaaaauuuugcuaaaauaauauaugaagaaauacaaaacguaaacaacaugaaagaacuaaucgaaaaaguacccgacaugucagaauuaaaaaaaagucaaguauucuacaaauacuaccuugacaaagaagagcugaacgacaaaaacauuaaauacgcguucugccacuuuguagaaauugaaaugucacaacuauuaaaaaauuacguauaugccagacuaaguaacauaucaaacgacaagaucaaaagaauauucgaauaucaaaauuuaaaaaaauuaauagaaaauaaguuauugaacaaacuagacacauacgucagaaauugcggaaaauauaauuauuacuuacaagacggugaaauagcaacaucagauuucauagcuagaaaccgacaaaacgaagcauucuuaagaaauaucaucggggucucaagugucgcauauuucucauugagaaacauauuagaaacugagaaugaaaaugacaucacuggaaggaugagaggcaaaaccguuaaaaauaauaaaggcgaagaaaaauauguaucaggagaagucgauaaaauuuauaacgagaacaaaaaaaacgaaguaaaggaaaaccuaaaaauguuuuacucguacgacuucaauauggacaacaaaaaugaaauugaagacuucuucgcaaacauagacgaagcuauuagcaguaucagacauggcauaguccauuucaaccuagaacucgaagguaaggauauauucgccuucaaaaauauagcuccaucagaaaucuccaaaaaaauguuucaaaacgaaaucaacgaaaaaaaacuaaaacuaaaaauuuucagacagcuaaacucagcaaacguuuucagauauuuagaaaaauauaaaauauuaaacuaucucaaaagaacaagauucgaguuugucaauaaaaacauacccuuuguaccaucuuucacgaaacuauacucccgcauagaugaccuaaaaaacucacuaggcauuuacuggaaaaccccaaaaaccaaugacgacaauaaaacaaaagagauaauagaugcgcaaauuuaucuacuaaagaauauauauuauggcgaauuccuaaauuacuucaugaguaauaacggaaacuucuuugagauaucuaaagaaauaauagaacuaaauaaaaaugauaagagaaaucuaaaaacaggauucuauaaacuccaaaaauucgaagacauccaagagaagauccccaaagaguaccuagcaaacauacaaucacuauauaugauaaacgcaggaaaucaagacgaagaagaaaaagacacauauauagacuucauacaaaagauauuccuaaaaggauucaugaccuaccuagcaaauaacgguagacuaucgcucaucuacauuggcucagacgaagaaacuaacacgucauuagccgaaaagaagcaagaauucgacaaauuucuaaaaaaauacgaacaaaacaauaacaucaaaauaccuuacgaaauaaaugaauuccucagagaaauaaaacuaggcaacauacugaaauauaccgagcgacuaaacauguuuuaccucauacucaaauuacugaaccacaaagaacuaaccaaccuaaagggaagccuagagaaauaccaaagcgccaacaaagaagaggcauucagcgaucaacuggaauuaauaaacuuacuuaacuuagacaacaaucgcgucacagaggauuucgaacuagaagccgaugagaucggaaaauuccuagacuucaacggaaauaagguuaaagacaauaaagaauuaaaaaaauuugauacaaacaaaaucuacuucgacggagaaaauauaaucaaacauagagcauucuauaauauaaaaaaauacggaaugcucaaccuacuugaaaaaauagcagacaaagccggauacaaaauuucaaucgaagaacugaaaaaauauaguaauaaaaaaaacgaaauagaaaaaaaccacaaaaugcaagaaaaccugcaccgcaaauacgccagaccaaggaaagacgaaaaauuuacagacgaagacuaugaaucguauaaacaagcaauagaaaacauagaagaauauacucaucugaaaaacaagguagaauucaacgaacuaaaccuacuucaaggauuauuacuaaggauacugcauagauuagucgguuacaccuccauuugggaaagggaccugagauucagacuaaaaggagaauuuccugaaaaucaauacauagaagaaauauuuaauuuugaaaauaaaaaaaaugugaaguacaaagguggccaaaucgucgaaaaauacauaaaauuuuacaaagaacuccaccagaacgaugaagucaaaaucaacaaauauucaagcgcaaauauaaagguccucaaacaagagaaaaaagacuuauacaucagaaacuacaucgcacauuuuaauuauauuccccacgcagaaauaucacuauuagaaguucuagaaaacuuacgaaaauuauuaagcuaugauagaaaacuaaagaacgcgguaaugaagucuguugucgauaucuuaaaagaauacggauucguggcaacguucaagaucggagcugauaaaaaaauagggauucaaacacucgaaagcgaaaaaaucguccaccucaaaaaccuaaaaaaaaaaaaacuuaugacagacagaaacagugaagagcuguguaaacucgugaaaauaauguuugaauacaaaauggaagaaaaaaaaucagaaaauuaa

SEQ ID NO: 11492 - RNA, 3480 nt, Artificial Sequence
  Cas13a variant__Leptotrichia buccalis__WP_015770004.1__Cas13a(N314A)
augaaaguaacaaaagucggagguauaucacauaaaaaauacacaagugaaggaagacuagucaaaucagaaagugaagaaaacagaacugaugaaagauuaagcgcauuacuaaacaugagacuagacauguacauaaaaaacccauccaguacagaaaccaaagaaaaccaaaaaagaauaggaaaacuuaaaaaauuuuucucgaauaaaaugguauauuuaaaggauaacacacucagucuaaaaaauggcaaaaaagaaaacauagauagagaauacucagagacagauauucuagaaagcgauguacgagacaaaaagaacuucgcuguacugaaaaaaauauaucuuaacgaaaaugucaauucugaagagcuugaaguauuucgcaacgacaucaaaaaaaaacuaaacaagauaaacagccuuaaauacaguuucgaaaaaaacaaagccaauuaccagaaaauaaaugaaaacaacauagaaaaaguagaaggaaaaucaaagagaaacaucauauaugauuacuauagagaaagugcaaaaagagacgcguacguaucaaacguaaaggaagcauuugacaaacuguacaaggaagaagacauagcaaaacugguauuagaaauagagaaccucacaaaacuugaaaaauauaaaauacgagaauucuaucacgaaaucauaggccgaaaaaacgauaaggaaaauuucgcuaaaauaaucuaugaagaaauccagaauguaaauaacaugaaagaauuaaucgagaaagucccagacaugucagaacugaaaaaaagccagguauucuacaaauauuacuuagacaaagaggaacuaaaugacaagaacaucaaauaugccuucugucacuucgucgaaauagaaaugucccaacuacucaaaaauuacguauacaaacgacuaucagcaauaucaaacgauaaaauaaaaaggaucuuugaauaccaaaaccucaaaaaacucauagaaaacaaauuacuaaacaaauuagacaccuacguccggaauugcggaaaauacaacuacuaccuccaggacggagaaauugcaaccucagacuuuaucgcaagaaauagacagaacgaagcauuucugcgcaauauaauuggagucagcucaguggcuuacuuuagcuuaagaaauauacuugaaacugaaaacgaaaaugacaucacaggaagaaugagagggaaaaccguaaaaaacaauaagggcgaagaaaaauacgucucaggcgaaguagacaaaauauauaaugaaaacaaaaaaaacgaagucaaagaaaauuuaaaaauguuuuauuccuacgauuucaacauggacaacaaaaacgaaaucgaagacuucuucgcaaacauagacgaagcuaucaguuccauacgacacggaauaguucacuuuaaccuggaacuagaagguaaagauauauuugcauucaaaaacauugcaccuagugaaauaucaaaaaaaauguuucaaaacgaaauaaaugaaaaaaaacuaaaacuaaagauuuuuagacaacucaauuccgcuaacguauuucguuaccuggaaaaauacaaaauucuaaacuaccuaaaaagaacgcgauucgaauucguaaacaaaaauauuccuuuuguacccucauucacaaaauuauacucaagaauagacgaucucaaaaacucacucgggauauacuggaaaacaccaaaaacuaacgacgauaauaaaacaaaagaaauaauagacgcacaaauauaucuucuaaaaaacauauacuauggagaauuccuaaauuauuucauguccaauaacggaaacuuuuucgaaauaucaaaagaaauaauagaacuaaauaaaaaugacaaaagaaaucuaaagacaggcuuuuacaaguuacaaaaauuugaagacauucaagaaaaaaucccaaaagaauacuuagccaauauacaaucacuauauaugauaaaugcuggaaaccaagaugaagaggaaaaagacacauauauagacuucauucaaaaaaucuucuuaaaagguuucaugacuuaccuagcgaauaauggcagauuaucacucauuuauauaggaagcgacgaagaaacaaacaccuccuuagcagaaaagaagcaagaguucgacaaauuccuaaagaaauaugaacaaaacaacaacauaaaaaucccauaugaaauaaaugaauucuuaagagaaauuaaacuagguaacauacuaaaauauaccgaaagauuaaacauguucuauuuaauccuaaaacugcuaaaccacaaagaacuaacuaauuuaaaaggcuccuuagaaaaauaucaaagcgcaaacaaagaagaagcauucuccgaccaauuggaauuaauuaacuuacucaaccuggacaacaaccgggucacggaagauuuugaacucgaagcugacgaaaucggaaaauuccuagacuuuaacggaaacaaaguuaaagacaacaaagaacuaaaaaaauucgauaccaauaaaaucuauuucgacggcgaaaauauaaucaaacacagagcauucuacaauauaaaaaaauacggaaugcuaaacuuacuagaaaaaauagcggacaaagccggauauaagauuagcauagaagagcuuaaaaaauacucaaauaaaaaaaacgaaaucgaaaaaaaucauaaaaugcaagaaaaucuacaucggaaauaugcgagaccaagaaaagacgaaaaauucacagacgaagauuacgaauccuacaaacaagcaaucgagaacauagaggaauacacacaccucaaaaacaaagucgaauucaacgaacuuaaccuacuucaaggacuacuacuccgaauacuccacagauuagugggauauacgagcauaugggaacgggaucucagauuccgacuaaaaggagaauucccagaaaaucaauauaucgaagaaauauucaauuuugaaaacaaaaaaaacguaaaauauaaaggcggucagauaguagaaaaauacauaaaauuuuauaaggaacuucaccaaaacgacgaagucaaaauaaauaaauauucaucagcaaacauaaaaguccuaaaacaagaaaaaaaagaccucuauauacgaaauuacauagcucacuuuaacuauauuccgcacgcagaaaucaguuuacuugaaguacucgaaaaccuuaggaaacuacuaagcuacgaccgaaaacuaaaaaacgccgugaugaaaucaguuguugacauauuaaaggaauaugguuucguagcaacuuuuaaaauaggagcugacaaaaaaaucggaauccaaacccucgaaucagaaaagauaguacaucucaaaaaccucaaaaaaaaaaaauuaaugaccgauagaaacucagaagaauuaugcaagcucguuaagaucauguuugaguacaaaauggaagaaaaaaaaucggaaaacuag

SEQ ID NO: 11493 - RNA, 3480 nt, Artificial Sequence
  Cas13a variant__Leptotrichia buccalis__WP_015770004.1__Cas13a(R1072A)
augaaaguaacuaaaguagguggaauaucucauaagaaauacacaucagaaggaagacuuguaaaaagcgaaucagaagaaaaucgaaccgacgaacgcuuaagcgccuuacuuaacaugcgacuugacauguacaucaaaaauccaagcucaacagaaacaaaagaaaaucaaaaacgaauaggcaaacuuaagaaauucuucagcaacaaaaugguauaucugaaagacaauacccuaagccucaaaaacgguaagaaagaaaacauagauagagaauacucugaaacagacauccuagaaucagacguaagagacaagaaaaacuucgcaguacucaagaaaauauaccuaaacgaaaauguaaacagcgaagaacuagaaguauuccgaaacgauaucaaaaagaaacuaaacaaaaucaacagccuuaaauacagcuucgagaaaaacaaagcaaauuaccagaaaauaaacgaaaacaacauugaaaaagucgaaggcaaaucaaaacgaaauaucaucuaugauuacuaccgagaaucggcaaaacgugacgcauauguuagcaacguaaaagaagcauucgacaaacuguacaaagaagaagauauagcaaaacuuguacuagaaauagaaaaucuaacaaaauuagaaaaauacaaaauaagagaauuuuaucacgaaauaaucggcaggaaaaacgacaaagaaaacuuugcaaaaauaaucuacgaagaaauccaaaauguaaauaacaugaaagaacucaucgaaaaaguacccgauaugagcgaacuaaagaaaucacaaguuuucuauaaauacuaccuagacaaagaagaauuaaacgauaaaaauauaaaauacgcauucugucacuuugucgaaaucgaaaugagucaacuccuaaagaacuacguuuauaaacgauuauccaacauaucuaacgacaaaauaaaaagaauauucgaauaccaaaacuuaaagaaacuaaucgaaaauaaauuacugaacaaauuggacacauauguacgaaauugcggaaaauauaauuacuaucuacaagauggagaaauagcuacaucugacuucauugcucgaaacagacaaaacgaagcauuuuuaagaaacaucauaggcgucuccagcgucgcuuacuuuucccuaagaaacaucuuggaaacagaaaacgaaaaugacauaacaggaagaaugcgcggaaaaaccgucaaaaauaacaaaggagaagaaaaauacgucagcggagaagucgauaaaauuuacaaugaaaacaagaaaaacgaagucaaagaaaaccuaaaaauguuuuacucauaugacuuuaacauggacaacaaaaacgaaauagaagacuucuuugcuaacauagacgaggcaaucagcagcauacgacacggaauaguacacuuuaaccuagaacuagaaggcaaagauauauuugcauucaaaaauauagcccccagcgaaauuaguaagaaaauguuccaaaaugagauuaacgagaagaaacucaaauugaaaauuuuccgacaacucaacucagcaaacguuuucagauaccuggaaaaauacaaaauauugaacuaccucaaacgcacaagauucgaauuuguaaauaaaaacauucccuucguaccaucauucacaaaacuauacucacgaaucgaugaucuuaaaaauucacuggguauauacuggaaaacuccaaaaaccaacgacgacaauaaaacaaaagaaauaauagaugcccaaauuuaucugcucaaaaacaucuacuacggagaauuucucaacuauuucaugucaaauaacggaaacuucuucgagauaucgaaagaaaucaucgaacucaacaaaaacgacaaaagaaacuuaaaaaccggauucuacaaacuccaaaaauucgaagauauacaagagaaaauucccaaagaauaucuugcaaauauacagagccuauacaugaucaacgcagguaaucaagacgaagaagaaaaagacacauacauagacuucauacagaaaauauucuuaaaaggauucaugacauauuuagccaacaacggaagacucucacuaaucuauauaggaucagacgaagaaaccaauacaucacucgcagagaagaaacaagaguucgauaaauucuuaaagaaauacgaacaaaacaauaacauaaaaauaccauacgaaauaaaugaauuuuugagggaaauuaaauuaggaaacauauuaaaauauacagaaagacuaaacauguucuaccuaauccuaaaacucuuaaaccauaaagaacuaacuaaccuaaaaggaagucucgaaaaauaccaaucagccaacaaagaagaggcguucuccgaucaacuugaauugauuaaccuacuaaaccuagacaacaaccgaguuacagaagacuucgaacuugaggccgacgaaauaggaaaauuccuagauuuuaacgguaacaaaguaaaagacaauaaagagcucaagaaauuugacacaaacaaaaucuacuucgauggggaaaauauaauaaaacacagggcauucuacaauaucaagaaauauggcauguuaaacuuauuagagaaaauagcagacaaagcagguuauaaaauuagcauugaagaauuaaagaaauauagcaauaagaaaaacgaaauagagaaaaaucacaaaaugcaagaaaaucugcauagaaaauaugcacgaccaagaaaagacgaaaaauuuacagaugaagacuaugaauccuauaaacaagcaauagaaaauauagaagaauacacccaccucaaaaacaaagucgaguucaaugaacuaaauuugcuacaaggacuccucuuaaggauacuccauagacuuguagguuacaccucaauaugggaaagagaucuuagguuccgcuuaaaaggugaguucccugaaaaccaauauauugaagaaauauucaauuucgaaaauaagaaaaacguaaaauauaaaggaggacaaauuguagaaaaauacaucaaauuuuacaaagaacuacaucaaaacgaugaaguaaaaaucaacaaauacucgucugcaaauauaaaaguauuaaaacaagaaaagaaagaucuauacauccggaacuauauagcgcacuuuaacuauauaccacaugccgaaauaucacuuuuagaaguccuagagaacuuagcaaaguuguuauccuacgacagaaaacuaaagaacgccguaaugaaaagcgucguagauauacuaaaagaauauggauuuguagccacauuuaaaaucggagccgacaagaaaauaggaauacaaacauuagaaucugagaaaauagugcauuuaaagaaccugaaaaagaagaaacuaaugacugaccgaaacucagaagaauuaugcaaacuuguuaaaauaauguuugaauacaaaauggaagagaagaaauccgaaaauuga

SEQ ID NO: 11494 - RNA, 3480 nt, Artificial Sequence
  Cas13a variant__Leptotrichia buccalis__WP_015770004.1__Cas13a(D1078A)
augaaagucaccaaagugggagggauaucccacaaaaaauacacgagcgaagggcgacuuguaaaaagcgaaucagaagaaaaccgaaccgacgaaagacuaagcgcccuacugaauaugagacuagauauguacaucaaaaacccaucaucuacagaaacaaaagaaaaucaaaagcgaauaggaaaauuaaaaaaauuuuucuccaauaaaaugguauauuuaaaagacaacacacuauccuuaaagaauggaaaaaaagaaaacauagaccgggaauacuccgagacggacauacuagaaagcgacguaagagauaaaaaaaacuucgcaguacucaagaaaauauacuuaaacgaaaauguaaacuccgaagaauuagaagucuuuagaaaugauauaaaaaaaaaacucaauaaaauaaacagucuuaaauauagcuucgagaaaaacaaagcaaacuaccaaaaaauaaaugaaaacaauaucgaaaaagucgagggaaaauccaaacguaauauaauauacgauuacuacagagaaucagccaaaagagaugcauauguaagcaauguaaaagaagcauucgacaaauuauacaaagaagaagacaucgcaaagcucguacuagaaauagaaaaccuuacaaaacuagaaaaauacaagauaagagaauucuaccaugagauuauuggaagaaagaacgauaaggaaaauuucgcaaaaauaaucuacgaggaaauacaaaacguaaauaacaugaaagaacuaauagaaaaaguaccugauaugucugaacuuaaaaaaucacaaguuuuuuacaaauacuaccuagacaaagaagaacucaacgacaaaaauauaaaauaugcauucugucacuucgucgaaaucgagaugagucaauuauuaaagaauuauguuuauaaaagacuuucaaacauauccaacgacaaaauaaaacgaauauuugaauaucaaaaccuaaaaaaacuaaucgaaaacaaacuacuaaauaaacucgauacauacguacgaaacugcggaaaguacaacuacuacuuacaggauggagagauagcaacaucagacuucauagcucgaaauagacaaaacgaagccuuccuaagaaacauaauuggagucucaagcguagcauauuuuucacuacgcaacauuuuagaaacagaaaaugaaaacgacauaacaggaagaaugaggggcaaaacagugaagaacaacaaaggugaagaaaaauauguaucaggagaaguagauaaaauauacaaugaaaacaaaaaaaacgaagucaaagaaaacuuaaaaauguuuuacuccuaugauuucaacauggauaacaaaaacgaaaucgaagauuucuuugcaaacauagacgaagcaauauccaguauacgucacggaauaguccauuucaaucucgaguuggagggaaaagauauuuucgcauucaaaaacauagcaccaagugaaauuucaaaaaagauguuccaaaacgaaauaaacgaaaaaaaacuaaaauuaaaaauauuuagacaacuaaacuccgcaaauguauucagauaucuagaaaaguauaaaauucuaaauuaccuuaaaagaacaagauucgaauucguuaacaagaacauucccuucguaccaucauucacaaaauuauauucccgcauagacgaccuaaaaaauagucucggaauauauuggaagacaccaaaaacaaacgacgauaacaaaacuaaagaaaucauagacgcccaaauauaccuccucaaaaacauauacuacggcgaauuccugaacuauuuuaugucaaacaacggaaauuuuuucgaaauaucuaaagaaauaauagaacuaaacaaaaacgacaaacgaaaccuaaagacaggauucuauaaacuccaaaaauucgaagauauccaggaaaaaauaccaaaggaauaucuagcaaacauacaauccuuauacaugauaaacgcaggaaaucaagacgaagaagaaaaggacacauacauagauuucauccaaaaaauauuccucaaaggauuuaugacauaccuugcaaauaacggacguuuaagucucauauacauagggucugacgaagaaaccaauacaucucuugccgaaaagaaacaagaauucgacaaauuucuaaaaaaauacgaacaaaacaacaacauaaaaaucccauaugaaauaaacgaauuccuucgcgagauuaaacugggaaacauacuuaaauauacagaaagacuaaacauguucuacuugauacugaaauuacuaaaccauaaagaauuaaccaaucuaaaaggaagucuagaaaaauaucaauccgccaauaaagaagaagcuuucagugaccaacuagagcuaauaaauuuacuaaaccuugauaacaauagggucacugaagacuucgaacuugaggcagacgagauaggcaaauuucucgacuuuaauggaaacaaagucaaggacaauaaagagcugaaaaaguucgacacaaauaaaauuuauuuugacggcgaaaacauaaucaaacaucgagccuucuacaacauaaaaaaauauggaauguuaaaccugcucgagaaaauugcagacaaggcaggauauaagauaucaauagaagaacuaaaaaaauacucuaauaagaaaaaugaaaucgaaaaaaaccauaaaaugcaagaaaaucugcacagaaaauaugcgcgaccaagaaaagacgaaaaauucacagacgaagauuaugagaguuacaaacaggcaauagaaaacauagaagaauauacacauuugaagaacaaaguagaguucaacgaauuaaaccuacuacaaggccuccuccuaaggauacuacacagacuaguaggcuauaccaguauaugggaaagagaccuaagauucagacuaaaaggagaauucccagaaaaccaguacaucgaagaaaucuucaacuucgaaaauaaaaagaacguaaaauacaagggagggcaaauaguagaaaaauauauuaaauucuauaaagaacuacaucaaaacgacgaaguaaaaauaaauaaauacagcucagcgaacauaaagguauuaaaacaagaaaaaaaagacuuauacauaaggaauuauaucgcccacuucaacuacauuccacacgcagaaaucucacuacuggaaguacucgaaaaucuuagaaaauuacuaagcuacgcaagaaaacuaaaaaacgcaguaaugaaaucaguaguugacauucuuaaagaauacggauucgucgcaacguuuaaaauaggggcagacaaaaaaaucggaauacagacacuugaaagcgaaaaaauaguacaccuuaaaaacuuaaaaaaaaaaaagcucaugacagacaggaacucagaagaauuauguaaauuagugaagauaauguucgaauauaaaauggaagaaaaaaaaucagaaaauuga

SEQ ID NO: 11495 - RNA, 3480 nt, Artificial Sequence
  Cas13a variant__Leptotrichia buccalis__WP_015770004.1__Cas13a(R1079A,K1080A)
augaagguaacaaaaguaggagguauuagccauaaaaaauacacuuccgaaggaagauuaguuaaaucggaaagugaagaaaacagaacagaugaaagacuuucagcccuacuaaauaugagacuagauauguacauaaaaaacccaaguagcaccgaaacaaaagaaaaccaaaaaagaauaggcaagcuaaaaaaauucuucuccaacaaaaugguauaccucaaagacaauacacuaucgcuaaaaaacggaaaaaaagaaaauauagaccgagaauacucagaaacagauaucuuagaaagcgauguacgcgacaaaaaaaacuucgcuguauuaaaaaaaauauaucugaacgaaaauguaaacagcgaagaacuagaaguuuuucgaaacgauaucaaaaagaaacucaacaaaaucaacagcuuaaaauauaguuucgaaaaaaacaaagcaaacuaccaaaaaauaaaugaaaacaauauagaaaaagucgaagguaaauccaaacguaacauaauauacgauuacuaucgagaauccgcaaaacgagacgcauaugucucuaacguaaaagaagccuucgauaaacuauacaaagaagaagacauugcgaaacucguacuagaaauagaaaaccuuacaaaacuugaaaaauacaaaauuagagaguucuaucacgagauaauaggaagaaaaaaugacaaggaaaacuuugcaaaaauaauauacgaagaaauacaaaacguaaacaauaugaaagaauuaauugaaaaaguaccagauaugucagaacuaaaaaaaucacaaguauucuacaaauacuaccuggacaaagaagaauuaaacgacaaaaacauuaaauaugcuuuuugccacuucguugaaauagaaaugagucagcuccucaagaacuacguauacaaacgacuaagcaacauuucaaacgacaaaauuaaaagaauauuugaauaccaaaaccucaaaaaacuaauagagaacaaauuauuaaauaaacuagacacauaugucagaaacugcggaaaauauaauuauuaucuacaggauggugaaauagcaaccagugauuuuauagcaagaaauagacagaaugaagcuuuccuaagaaacaucauaggagugucgucaguggcauacuucagccuacgcaacauccucgaaaccgaaaaugaaaacgauaucacagguaggaugagaggaaaaacuguaaaaaacaacaaaggagaagaaaaauacguuaguggagaaguagacaaaauuuacaacgaaaacaaaaagaacgaagucaaagaaaaccucaaaauguuuuacucauaugacuuuaauauggacaacaaaaaugaaauagaagauuuuuucgcaaacaucgacgaagcaaucucuagcaucaggcauggcaucguacauuucaaccuagaacuugaaggcaaggacaucuucgccuucaaaaacaucgccccaagcgaaaucaguaaaaagauguuucaaaaugaaauaaacgaaaaaaaacuaaaacuaaaaauuuucagacagcuaaacuccgcuaacguauuucgguaccuggagaaauacaaaaucuuaaauuaucuaaaaagaacaagauucgaauucguaaacaaaaacaucccauucguaccgucauucaccaaacucuauagcaggaucgacgaccugaaaaacagcuuagguaucuauuggaaaacacccaaaacuaacgaugacaauaaaaccaaagaaauaauagaugcccaaaucuaccuauuaaaaaauaucuacuacggcgaauuccuaaacuacuucaugucuaacaauggcaauuucuuugaaauauccaaagaaauaauagaacuaaauaaaaaugacaaaagaaaucuaaagacaggauucuauaaacuacaaaaauucgaagacauccaagaaaaaauaccaaaagaauacuuagccaauauccaaucguuauauaugauaaacgcaggcaaucaagacgaagaagaaaaagacacauacauagacuucauacaaaaaaucuuuuuaaaaggauucaugacauaccuagcgaauaacggcaggcugucauuaauauauauaggauccgacgaggagacaaauacaagcuuagccgaaaaaaaacaagaauuugauaaauuccuuaaaaaauaugaacaaaacaauaacauaaaaauaccauacgaaauuaacgaguuucuaagggaaauaaaauuaggaaauauccuaaaauauacggaaaggcucaacauguucuaccuaauacuaaagcucuuaaaccacaaagagcuaacaaaccuaaaaggaucacuugaaaaauaccaauccgcaaauaaagaagaagcuuucagcgaucaacuggaacuaauuaaccuguuaaaccuagauaauaaccgcguaacagaagacuucgaacuagaagcugacgaaaucggaaaauuccucgacuuuaacggcaacaaaguaaaagacaacaaagaacuaaaaaaauucgacacaaauaaaaucuacuuugacggagaaaauauaauaaaacauagagcuuucuacaacauaaaaaaauacggcaugcuaaaucuccuagaaaaaauugcagacaaagccggcuacaagauaagcauugaagaacuuaaaaaauacucuaauaaaaaaaacgaaauagaaaaaaaucauaaaaugcaagagaaccuccaccgcaaauaugcacgacccagaaaagacgaaaaauucacagaugaggauuaugaaucauacaaacaagcaauagaaaacaucgaagaauacacccaucucaaaaacaaagucgaauucaacgaacucaaccuacuucaaggacuacuacuaagaauuuuacauagacuaguaggauacacaaguauaugggagagagaucugcgauucagacucaaaggugaauuccccgaaaaccaauacauagaggaaauuuucaacuucgaaaauaaaaaaaauguaaaauacaaaggaggacaaauaguagaaaaauauauuaaauucuacaaagagcuacaccaaaaugacgaaguaaaaaucaacaaauacuccucagcgaacauaaaaguauuaaaacaagaaaaaaaagaucuauacauacgaaauuauauagcccacuuuaauuacaucccacacgccgaaauuagccuucucgaagugcuugaaaacuuaagaaaguuacugucuuacgaugccgcgcucaaaaacgccguaaugaaaucaguaguagacauucugaaagaauauggauucguagcuacauucaaaauaggagccgauaaaaaaauuggaauacaaacacuagaaagcgaaaaaauaguucaucuaaaaaaccuaaaaaaaaaaaaacucaugaccgacagaaacucugaggaacuuuguaaacuagucaaaauaauguuugaguauaaaauggaagaaaaaaaaucugaaaacuaa

SEQ ID NO: 11496 - RNA, 3480 nt, Artificial Sequence
  Cas13a variant__Leptotrichia buccalis__WP_015770004.1__Cas13a(K1080A)
augaaagugacuaaagucggaggaauaagucacaaaaaauacacaucggaagguagacucguaaaaucugaaucagaagaaaaucguacugacgaaagauuaagugcauugcucaacaugagauuggacauguacauaaagaacccuucaucuacugaaacaaaagaaaaccaaaaaagaaucggaaaguuaaaaaaauucuucagcaacaaaaugguauaccucaaagauaacacccuuuccuuaaaaaacggaaaaaaagaaaacauagaccgagaauauagugaaacagacauauuagagagugacgugagagacaaaaaaaauuucgcuguccuaaaaaaaauauaccuuaaugaaaauguaaauuccgaggagcuggagguauucagaaaugacauaaaaaaaaaacuaaauaaaaucaacucccuuaaauacucauuugaaaaaaacaaagcaaacuaucaaaaaauaaacgagaacaauauagaaaaaguugaaggaaaaagcaaacguaauauaauauacgauuacuauagagaaucggcaaaaagagaugcauacguaagcaacguaaaagaagcauucgauaaacuauacaaggaggaagacauugcaaaacuaguacuagagauagaaaacuuaacaaaauuagaaaaauauaaaauucgugaauuuuaccacgaaauuauagguagaaaaaacgacaaagaaaacuucgcaaaaauaauauacgaggaaauacaaaacgucaauaauaugaaagaacucauagagaaaguucccgauauguccgaauuaaaaaaaucacaaguauucuacaaauauuacuuagauaaagaggaacuaaaugauaaaaauaucaaauaugcauucugccacuucguagaaauagaaaugagucaguuauuaaaaaauuacguauacaaaagacucucaaacauaagcaaugacaaaauuaaacgaauuuucgaauaucaaaaucucaagaaacugauugaaaauaaacuccuaaauaaauuagacacuuacguacgaaacugcggaaaauacaacuauuaccuacaagacggagagauugcaacauccgacuucauagcaagaaauagacaaaacgaagcuuuucuacgaaacauaaucggagucaguagcguagcauacuuuagccuccgcaacauacuagagaccgagaacgaaaacgacaucaccgguagaaugagaggaaagacaguaaaaaacaauaagggggaggaaaaauacgucucaggggaaguagacaaaaucuauaacgaaaauaaaaaaaaugaggugaaggagaacuugaaaauguuuuacagcuacgacuucaacauggauaacaaaaacgaaauagaagauuuuuuugccaauaucgaugaagcaaucagcucaaucagacaugguauaguacacuucaaccucgaauuagaaggcaaagauauauuugcauucaagaauauagccccaagcgaaauuaguaagaaaauguuucagaaugagauaaacgaaaaaaaacucaaacuaaaaauauucagacaauuaaauagcgcaaacguauucagauaucuugaaaaguacaaaauacugaacuaucucaaaagaacaagauucgaauucguaaauaaaaauauaccuuucguaccuaguuucacaaagcuauacucgagaaucgacgaccuaaaaaauucacuaggaaucuacuggaagacaccaaaaacaaacgaugauaacaaaaccaaagaaauuaucgaugcacaaaucuaccuauuaaagaacauuuacuacggagaauuccucaacuacuuuaugucaaacaaugggaauuucuucgaaauuucaaaagagauaauagaacuuaacaaaaacgauaaaagaaauuuaaaaacaggcuuuuauaaauuacaaaaauucgaagauauacaagaaaaaauucccaaagaauauuuagcaaauauacaaucacuuuacaugaucaaugcagguaaccaagacgaagaagaaaaagauacauauauagauuuuauccaaaaaaucuuuuugaagggcuucaugaccuacuuagcaaauaacgggcgccuaucacuaauauacaucggaucggacgaagaaacgaacaccagucucgcagagaagaaacaagaauucgacaaauuucugaaaaaauaugaacaaaacaacaacaucaaaauacccuacgaaauaaacgaauuuuuaagagaaauaaaacuaggcaacauauuaaaauauaccgaacguuuaaauauguucuaccuaauacuaaaacuucuuaaccauaaagagcuaaccaaccuaaaaggaagccuagaaaaauaccaaagcgccaacaaagaggaggcauucagcgaccaacuagagcuaauaaaucuacuaaaccucgacaacaaccgaguaacagaggacuuugaacuagaagcagaugaaauaggaaaauuuuuagacuucaacggaaauaaaguaaaagacaauaaagaauuaaagaaauuugacacaaacaaaauauauuuugauggcgaaaacauaauaaaacacagagcguucuacaacauaaagaaauacggaauguuaaacuuauuagaaaaaaucgcagauaaagccggauacaaaauaucaauugaagaacuuaaaaaguauucuaauaaaaaaaacgagauagaaaaaaaccacaaaaugcaagaaaaccugcaccgaaaauaugcaagacccagaaaagacgaaaaauuuacagacgaagacuacgaaagcuauaaacaagcaauugaaaauaucgaagaauacacccaucuaaaaaacaaaguagaauucaacgaauuaaaccuacuccaaggacuccuacuaagaauccuacaucgacuaguaggauauacaucaauaugggaacgagaccuacgcuucaggcucaaaggagaauuccccgagaaccaauacauagaagaaaucuucaauuucgaaaacaaaaaaaacgucaaauacaagggcggacaaauuguagaaaaguacauaaaauuuuacaaagaauuacaccaaaaugacgaaguaaaaauaaacaaauacucaagcgccaacauaaaaguacuaaaacaagaaaaaaaagaccuuuacauacgaaacuauaucgcgcacuucaacuauauaccgcaugcagaaauaucacuccuagaaguauuagaaaaccuacgaaaguuauuaagcuacgaucgagcacuaaaaaaugcaguuaugaaaagcguaguagauauucuaaaagaguauggauucguagcaacguuuaaaaucggugcugacaaaaaaauaggcauccaaacauuagagagugaaaaaauagugcaucugaaaaaucuaaaaaaaaagaaacuaaugacagauaggaacagcgaagaacuauguaagcuuguaaaaauaauguucgaauauaaaauggaagaaaagaaaucagaaaacuag

SEQ ID NO: 11497 - RNA, 3480 nt, Artificial Sequence
  Cas13a variant__Leptotrichia buccalis__WP_015770004.1__Cas13a(K1082A)
augaaagugacaaaaguagguggaauaagucacaaaaaauacacaagugaaggccgacuuguaaaaagugagagcgaagaaaacagaacagaugaaaggcucuccgcauuacuaaacaugagacuagacauguacauaaaaaauccaaguucaacagaaacgaaggaaaaccagaaacguauaggaaaauuaaaaaaauucuucucgaauaaaaugguguaccuaaaagauaacacacuuagccucaaaaacggaaaaaaagaaaauauagauagagaauacucugaaaccgacaucuuagagucagacgucagagacaaaaagaacuucgccgucuuaaaaaaaauauaccuaaacgaaaacguaaacagcgaagaacuagaagucuucaggaacgacauaaaaaaaaaacuuaauaaaauaaacucccugaaauacagcuucgaaaagaacaaagccaauuaccaaaaaaucaaugaaaacaacaucgaaaaaguagaaggcaagaguaagcgaaacauaauuuaugacuacuacagagaauccgcaaaacgagacgccuauguaagcaauguaaaagaagcuuucgacaaacuauacaaagaggaagacauagcaaaacuaguucuggagauagaaaaucugacaaaacuugaaaaauauaaaauacgcgaauuuuaucaugaaauaauuggcagaaaaaaugacaaagaaaauuuugcaaaaaucauauaugaagaaauucaaaacgucaauaauaugaaagaacuuauagaaaaggucccugacaugucggaacuuaaaaagagccaaguauucuauaaauacuaccuagauaaagaagaacuaaaugacaaaaacauuaaauacgcauucugccacuuuguugaaauagaaaugucacaacuacuaaaaaacuauguauacaaacgccuuucaaacauaucaaaugacaaaaucaaaagaauauucgaauaccaaaacuuaaaaaaacucaucgaaaauaaacuccuuaacaaacuagacacuuacguaagaaauuguggaaaauacaauuacuauuugcaagacggcgaaauagcaaccagcgacuuuauagcaagaaaucgacagaaugaagccuuccucagaaacauaauaggaguaucaagcguagcuuacuuuucauuacgaaacauacuagagacggaaaacgagaacgacauaacuggaagaaugagagguaaaaccguaaaaaauaacaaaggugaagaaaaauaugucucaggcgaaguggacaagauauauaaugaaaacaaaaaaaacgaaguaaaagaaaaccuaaaaauguucuacucuuacgacuucaacauggauaauaaaaacgaaaucgaagacuucuuugccaauauugaugaggccauaucaagcauucgacauggaaucguacacuucaaccuugaauuagaaggaaaagauaucuuugcuuucaaaaauauagccccauccgaaaucagcaaaaagauguuucaaaacgaaauuaaugaaaaaaaacuaaaacucaagauauuuagacaacuaaacagcgcuaacguuuucagauacuuagaaaaauauaaaauauuaaacuauuuaaaaagaacacgauuugaauucgucaauaaaaacauacccuucguaccaucauuuaccaaauuguauucacgaaucgaugaccuaaaaaacucacuuggaaucuauuggaaaacgccaaaaacaaaugacgacaauaaaacaaaagaaauaaucgacgcacaaaucuaucuccuuaaaaauaucuacuacggagaguuuuuaaacuacuucaugucaaacaaugguaacuuuuucgaaauuucaaaagaaauaauagagcugaacaaaaacgauaaacgaaaccucaaaacaggauuuuacaaacugcaaaaauucgaagauauucaagaaaagauaccaaaagaauacuuagccaauauacaaucauuauacaugaucaaugccgggaaccaagacgaagaagagaaggacacguacaucgacuuuauacagaaaaucuuucucaaaggguucaugaccuaucuugcuaauaacgggagacuaagcuugaucuauauaggaagcgaugaggaaacuaauaccucuuuagcagaaaaaaaacaagaauucgauaaauuccuuaaaaaguacgaacaaaacaacaacauaaaaauacccuacgaaauaaaugaauuccuacgggaaauaaaacucggcaacauacucaaauauacagaaaggcuaaauauguucuaccuaauauuaaaacuccuaaaccacaaagagcuaaccaacuuaaaaggaucccuagaaaaauaccaaagugcaaacaaagaagaagcauucucagaucaacuagaacuaauuaaccuauuaaaucuagacaacaauagaguaacggaagacuuugaacuagaagcugaugaaauaggaaaauuccuagauuuuaacgguaacaaaguaaaagacaacaaagaauuaaagaaauucgacacuaacaagaucuacuucgauggagagaacauaauaaaacaccgugcauucuauaacauaaaaaaauacggcaugcuaaauuuacuugaaaaaauagcugauaaagcuggauauaaaauaaguauugaagaauuaaaaaaauacuccaacaaaaaaaaugaaauagaaaaaaaucacaaaaugcaagaaaaccuccacagaaaauaugcaagaccuagaaaagacgagaaauuuaccgacgaagacuacgaaucauauaaacaagccauagaaaauauugaggaauauacacaccuuaaaaauaaagucgaauuuaaugaacucaaccuacuucagggacuccugcuaagaauccuacauagguuggucggauacaccucaauaugggaacgcgaucuacgcuuuagauuaaaaggcgaguuuccagagaaucaauauauagaggaaaucuuuaacuuugaaaauaagaaaaauguaaaauacaaaggaggccaaauaguggaaaaauacauaaaauuuuacaaagaauuacaccaaaacgacgagguaaaaauaaacaaauacagcagcgccaauauaaaaguacuaaaacaagaaaaaaaagaucucuacauuagaaacuauauagcacauuucaacuacauaccccacgcagaaauaucacugcucgaaguccucgaaaaucuaagaaaacuacuaagcuacgacagaaaauuagcuaacgcggucaugaaauccguagucgacauccuaaaagaguacggauucguagcaaccuucaaaauaggggccgacaaaaaaauaggaauacaaacauuagagagugaaaaaauaguucaccuaaagaaucuaaaaaaaaagaaacuaaugacagaucggaacucagaagaacuaugcaaacuaguaaaaaucauguuugaauacaaaauggaagaaaaaaaaagcgaaaacuaa

SEQ ID NO: 11498 - RNA, 3480 nt, Artificial Sequence
  Cas13a variant__Leptotrichia buccalis__WP_015770004.1__Cas13a(K1087A)
augaaagucacgaaaguaggagguauaucccauaaaaaauauacaagcgaaggaagacuugugaaaucagaaagugaagaaaacaggacagacgaaagacucucggccuuacucaacaugagacuugauauguauauaaaaaauccuagcagcacagaaacuaaagaaaaccaaaaacggauagggaaauuaaaaaaauucuucucaaauaaaaugguauaccuaaaagacaacacacuauccuuaaaaaacggaaaaaaagaaaacaucgacagagaauauagugaaacugacauucuagaaucagaugucagagauaaaaaaaauuucgcaguacuaaaaaaaauauacuuaaacgagaacgucaacagcgaagaauuagaaguuuuuagaaaugacaucaagaaaaaacuaaacaaaauuaacucccuaaaauacucguucgagaaaaacaaagcaaauuaccagaaaauaaacgaaaauaauaucgaaaaaguagaaggaaagagcaaaagaaauauaaucuacgacuacuacagggaaagugcaaaaagagacgcauauguaucuaacgugaaagaagcauucgacaaauuauauaaggaagaggacauagcaaaauuaguacucgaaaucgaaaaccuuacuaaacucgaaaaauauaaaauacgugaauuuuaccaugaaauaauaggcagaaaaaaugacaaggaaaacuucgcaaaaauuauauaugaagaaauccaaaauguaaauaacaugaaagagcuaauagaaaaagucccugauauguccgaacuuaaaaaaucgcaagucuucuacaaauacuaccuagacaaagaagaauuaaaugacaaaaacauaaaauacgcauucugccauuucgucgaaauagaaaugagccaacuccuaaaaaacuauguauacaagagguuaucaaacauaaguaaugacaaaauaaaaagaauauucgaguaccagaaccuaaaaaaacuuauagaaaauaaacuacuaaacaaacuugacacauacguaagaaacugcgggaaauauaauuacuaucuucaggacggagagauagcaaccuccgauuuuauagcaagaaaccgccaaaaugaagccuuucuaagaaauauaauaggagucagcucaguagccuauuuuagucuaagaaacauacucgaaacagaaaaugaaaacgacauaacaggaagaaugagaggcaaaacaguaaaaaacaacaagggugaggagaaauauguauccggagaagucgacaaaauauauaacgaaaauaagaaaaacgaagucaaagagaaucuaaaaauguuuuacucauacgacuuuaauauggacaauaaaaacgaaauagaagacuuuuucgccaacauugacgaagccaucucguccauaagacauggcauaguccauuucaaccuugaacuagaaggcaaagauauauucgccuucaaaaacaucgcaccaagugaaauaaguaaaaaaauguuccaaaacgaaaucaaugaaaaaaaacucaaauuaaaaauauucagacaacugaacagcgcaaacguauucagauaccuagaaaaguacaaaauauuaaacuaccuaaaaagaacaagauucgaauucgucaacaaaaauauccccuucguaccuagcuuuacaaaacuauauucaagaauagacgaccugaagaacucacuagguauauacuggaagacuccaaaaaccaacgaugacaacaaaaccaaggagauaauagacgcacaaauauaucuacugaaaaacauauauuauggagaauuucugaacuacuuuaugaguaacaacggaaacuucuucgagaucagcaaagagauaauugaacuaaacaaaaacgacaaaagaaaucucaaaacaggguuuuacaaacuacaaaaauucgaagauauacaagaaaaaauaccaaaggaauacuuagcaaacauccaauccuuauacaugauaaaugcaggaaaucaagacgaagaagaaaaagacacuuacauugauuucauacaaaagaucuuuuuaaaaggauuuaugaccuaccuggccaauaacggcagacuauccuuaauauauauaggcuccgacgaagaaacgaacacaucacuagcagaaaaaaaacaggaauucgacaaauucuuaaaaaaauaugaacaaaacaacaacauaaaaauuccauacgaaauaaacgaauuccuaagagaaauaaaacuaggaaacauccugaaauauacggaacgauuaaauauguucuacuuaauauuaaaacuacuaaaccauaaagaauuaaccaaccucaaaggauccuuagaaaaauaucaauccgccaacaaagaggaagcguuuuccgaccaacuagaacucauuaaccuacucaaucuugacaacaauagaguuacugaggacuucgaacuagaagcagacgaaauaggcaaauuucuagacuuuaacggaaacaaaguaaaagacaauaaggaacuaaaaaaauucgacacaaacaaaaucuacuucgacggcgaaaauauaauaaaacaucgagcuuuuuauaacaucaaaaaguaugggaugcugaacuuauuagaaaaaauagccgacaaggcaggguacaaaauaaguauagaggaauuaaaaaaguacagcaacaaaaaaaacgaaauagaaaaaaaccacaaaaugcaagagaaccuacacagaaaauaugcacgaccuagaaaagaugaaaaguucacagacgaagacuaugaauccuacaaacaagccauagaaaauauagaagaauauacacaccuaaaaaauaaaguagaauucaacgagcuuaaucuauuacaagggcuacuacuacgaauauuacacaggcuaguagguuacacaagcauaugggaaagggaccuacgcuucaggcuaaaaggggaauuccccgagaaucaauacauagaagaaauauuuaacuucgaaaauaaaaaaaauguaaaauacaaaggaggucaaaucguagaaaaauacauaaaauuuuauaaagaacuacaucagaacgacgaagucaagauuaauaaauauucaucagcaaacauaaaaguacucaaacaagaaaaaaaggacuuauacauucgaaacuauaucgcacauuucaauuauauaccccacgcagagauaagucuauuggaaguacuugaaaauuugcgaaaauuauuaucauaugauagaaaauugaaaaaugcaguaauggcuucagucguggauauauuaaaagaauacggauuugucgcaacauuuaaaauaggcgcagacaagaaaauagguauccaaaccuuagaaucagagaaaauaguacaccuaaaaaaccuaaaaaaaaaaaaacuaaugaccgacagaaauagugaagaguuaugcaaacuaguaaaaauaauguucgaauauaaaauggaagaaaaaaaaucagaaaacuaa

SEQ ID NO: 11499 - RNA, 4170 nt, Artificial Sequence
  Cas13a variant__Leptotrichia shahii__WP_018451595.1__Cas13a
augggcaaccuauucggccauaaaagaugguacgaaguucgagacaaaaaggacuucaaaauaaaaagaaagguaaaaguaaaacgaaacuaugaugggaacaaauacauucuaaacauuaaugaaaauaacaacaaggagaagaucgacaacaacaaauucauaagaaaauacauaaacuacaaaaaaaaugauaauauccugaaagaauuuacaagaaaauuccacgcaggcaacauacuguucaaacuaaaaggaaaagaaggaauaaucaggauagagaacaacgacgauuuccuagagacagaagaaguggucuuauacauugaagcguauggaaaaucugaaaaacuaaaagcuuuaggaauaaccaaaaaaaaaauaauagaugaagcaauaagacaaggaaucaccaaagacgacaaaaaaauagaaauaaaaagacaagagaaugaagaagaaauugaaauagacauacgugacgaauacaccaacaagaccuuaaacgauugcucaauaauccuacgcauaauagaaaaugaugaacucgaaacaaaaaaaucaauauacgaaauauuuaaaaauaucaacaugagucuuuacaaaauaauagaaaaaauaauagaaaacgaaacggagaaaguauucgaaaacagauacuacgaagaacaccuacgagagaaacuguuaaaagacgauaagauagacguuauacuaacaaauuucauggaaaucagagaaaagauaaaaucaaaccuagagauccuaggauuugugaaauucuauuuaaaugucgguggugacaaaaaaaaaucaaaaaacaaaaaaaugcucguagagaaaauauuaaauauaaacguggacuuaacaguagaagacauagcagauuucgucauaaaagaacuagaguucuggaacauaacaaaaaggauagaaaaaguuaaaaaggucaacaacgaauuuuuggaaaaaagaaggaacagaacauauauuaaaucuuauguacuacuagacaagcacgaaaaauucaaaauagaacgugaaaacaagaaggacaagaucguaaaguuuuucguagaaaauauaaaaaauaacucaaucaaagaaaaaauagaaaagauacuggcugaauucaagaucgaugaacuaauaaagaaguuggaaaaagaacuuaaaaaaggaaacugcgacacagaaaucuucggaauauuuaaaaaacacuacaaaguaaacuucgacucaaaaaaguucucaaaaaaaucagacgaagaaaaagaacucuauaaaaucauauacagauauuuaaaagguaggauugaaaaaauacuaguaaacgaacaaaaagugagacuuaagaaaauggaaaaaauagagauagaaaaaauccuuaacgagagcauccuuagcgaaaaaauccucaaaaggguuaaacaauacaccuuagaacauauaauguaccucggaaaauuacgacauaacgacauagauaugaccacuguaaauacagaugacuucaguaggcuccaugcaaaagaagaauuggacuuagaauuaauaaccuuuuuugccagcacaaacauggaauugaacaaaaucuucucaagggaaaacaucaacaacgacgagaacaucgauuucuuuggaggagaucgagaaaaaaauuauguauuagacaagaaaauacuaaauaguaaaaucaagaucauacgagauuuagacuucauagacaauaaaaacaacauaacaaacaacuucauaaggaaauuuaccaaaaucgguaccaacgaaagaaaccgcauauuacacgcaauaucaaaagaaagggaucuacaagguacacaagacgauuacaacaaaguaauaaacauaauccaaaaccugaaaauaucugacgaagaagugucaaaagcauuaaaccucgauguuguuuucaaagauaaaaaaaacauaauaacaaaaaucaacgauauaaaaauuagugaagaaaauaacaacgacauaaaauaucucccaagcuuuagcaaaguauuaccagagauauuaaaccuauaccgaaacaacccaaaaaaugaaccauuugauacaauagaaacagagaaaauaguauuaaaugcucuaaucuacguuaacaaagaauuauauaaaaaacuaauccuggaagacgaccuagaagaaaacgaauccaaaaauauuuuccuacaagaacugaaaaaaacacuaggaaauaucgacgaaauagacgagaauauaaucgagaacuacuauaaaaaugcccaaauaucagcaucaaaggguaacaacaaagcaaucaaaaaauaccaaaaaaaaguaauagaauguuacaucggguauuuaagaaagaacuacgaagaguuauuugauuuuucagauuuuaaaaugaacauacaagaaauaaagaaacaaauuaaagauauaaacgacaauaaaacuuacgaaagaauaacaguuaaaacaagcgacaaaaccauaguaauaaacgacgacuuugaauacauuauuucaauauucgcguuacucaauucaaaugcuguaauaaauaaaauccguaacagauucuucgcaacauccguauggcuaaacacaagcgaguaucaaaacauaaucgauauccuagaugaaauuaugcaauuaaauacgcuccgcaacgaaugcauaacagaaaauuggaaucugaaccuagaagaauuuauucagaaaaugaaggagauagaaaaagacuucgaugauuucaagauccaaacaaaaaaagaaauauucaacaacuauuaugaagacauaaagaacaacauacucacagaauucaaagaugacaucaacggcugcgacguauuagaaaaaaaacuagaaaagaucguaauuuucgaugacgagacaaaauucgaaauagacaaaaaaucaaacauccuacaagacgaacaaagaaaacuaaguaauauuaauaaaaaagacuuaaaaaaaaaagucgaccaguacauuaaagacaaagaccaagaaauaaagucaaaaauccugugcagaaucauauucaacucggauuuccugaaaaaauauaaaaaagaaauagauaaucuuaucgaagacauggaaagcgaaaaugaaaacaaauuccaagagauuuacuacccaaaagaacgaaagaaugaauuauauauauacaaaaaaaaucucuucuuaaacauaggaaaccccaacuucgacaagauauacggguuaaucuccaacgacaucaaaauggccgacgccaaauucuuauucaacauagauggaaaaaauauaaggaaaaauaaaaucagugaaauagacgcaauccucaaaaaucuaaaugauaaauugaacggcuacagcaaagaauacaaagaaaaauauauaaaaaagcucaaagaaaacgaugacuucuucgcaaaaaauauacagaacaaaaacuacaaauccuucgaaaaagauuacaaucgaguuagcgaauauaaaaaaauaagagaccuugucgaauucaauuaccuaaacaaaauugaaucauaccuaauugacauaaauuggaaacuggcaauccaaauggcgcgcuuugaaagagauaugcacuauauuguaaauggacuaagagaacuaggaauuauaaaacucuccggauacaacaccgguauaucaagagcauacccgaaaagaaauggaagugacgguuucuacacgaccaccgcauauuacaaauucuuugaugaagaaagcuacaaaaaauucgagaaaauaugcuacggcuucggcauugauuugagugaaaacagcgaaauaaauaaaccagaaaaugaaucgauaaggaacuacauaagucacuucuacaucguucggaauccauucgcagacuauucaauagcagaacaaauagacagagucuccaaucuacucucguauucuacaagauauaacaacuccacauacgcuaguguuuucgaaguauucaaaaaagacguaaaccuugacuaugaugaguuaaaaaaaaaguuuaaacucauaggcaauaacgacauacuggaaagacuaaugaagccaaaaaaaguuaguguacuagaacuagaaagcuacaacagcgauuauauuaaaaauuuaauaauagaauuacuaacaaaaauagagaauacaaaugacacucuauaa

SEQ ID NO: 11500 - RNA, 4170 nt, Artificial Sequence
  Cas13a variant__Leptotrichia shahii__WP_018451595.1__Cas13a
augggaaaucucuuuggacacaaaagaugguacgagguucgagacaaaaaagacuucaaaaucaaacgaaaaguaaaggucaaaaggaacuaugacggaaauaaauauauacuaaauauaaaugagaacaauaacaaggaaaaaauagacaacaacaaauucauacguaaauacauaaacuacaaaaaaaaugacaacauacuaaaagaauucacaagaaaauuccaugcaggaaauauauuauuuaaacuaaaaggcaaggaaggaauaauaagaauagaaaacaaugaugauuuucuagaaacagaagaaguaguauuauacaucgaggccuacggaaaaagugaaaaauuaaaggcgcugggcauaacaaaaaaaaaaauaauagacgaagcaauacgucaaggcauaacgaaggacgacaaaaaaaucgaaauaaaaagacaagaaaaugaagaagagauagaaaucgacauacgagacgaauauaccaauaagacccuaaaugacugcucgauaauuuugcgaaucaucgaaaacgacgaacuagaaacaaaaaaaucgauauaugaaaucuuuaaaaauauaaauaugagucucuauaaaauaauagaaaaaauuauagaaaacgaaacagaaaaaguauucgagaaccgauacuacgaggaacaccuacgagaaaaacuacucaaagacgauaaaaucgacguuauauugaccaacuuuauggaaauaagggaaaaaaucaagucaaaccucgaaaucuuaggguucguuaaguucuaccuaaauguaggcggcgacaaaaaaaaaucaaaaaacaaaaaaaugcucguagaaaaaauucuuaacauuaacguagaccuaacaguagaagacauagcagacuucguaauaaaagaauuagaauucuggaacauaacaaaaagaaucgaaaaagucaaaaaaguuaauaacgaauucuuagaaaaaagaaggaaccgaacuuauaucaaaucauacguucuucuagacaaacaugaaaaauuuaaaauagaaagggaaaacaaaaaagacaaaauagugaaauuuuuuguagaaaacaucaaaaacaauagcauaaaagaaaaaauagaaaaaauacuagcagaauuuaagauagacgaauuaauaaaaaaacuugaaaaagaacuaaaaaaaggaaauugugauacagaaauauucggcauauuuaaaaaacacuacaaaguuaacuucgacaguaaaaaauuuuccaaaaaaagugaugaagaaaaagaacuauauaagauuauauaccguuaucuuaaaggcagaauagaaaaaauauuaguaaaugaacaaaagguacgacuaaagaaaauggaaaaaauugaaauagaaaaaaucuuaaaugaaagcauacuuucagagaaaauuuuaaagagagucaaacaauacacacucgaacauaucauguaucuaggaaagcuaagacauaaugacauugauaugacgacaguaaauaccgaugacuucagucgacuacacgcaaaagaagaauuagaucuagaauuaauaacuuuuuucgcaucuaccaacauggaauuaaauaaaauuuucaguagagaaaauaucaacaacgacgaaaacauagacuucuucgggggagauagagaaaagaacuacguacuagacaagaaaauauuaaacuccaaaauaaaaauaauaagagaucuagauuucauagacaauaaaaauaacauaacaaacaacuuuauuagaaaauucacgaaaauaggcacaaaugaacgaaaccguaucuuacaugcgauaagcaaagaacgagacuuacaaggaacccaagacgauuacaacaaaguaauaaacauaauucaaaaucuaaaaauaucagacgaagaaguaucaaaagcacuaaaucuagacguugucuucaaagauaaaaaaaacauaauaacaaagauaaacgacauaaaaauauccgaagaaaacaacaacgauauaaaauauuuacccagcuucuccaaaguacuuccagaaauacucaaccuauaccgaaauaauccaaagaacgaaccauuugauacaauagaaacagaaaagauaguacucaacgcgcuaaucuacguaaauaaagaacuuuacaaaaaacuaauacucgaagacgaccuggaagaaaaugaaaguaaaaauaucuuccuacaggaauugaaaaagaccuuaggaaauauagacgaaauagacgagaacaucauugaaaacuacuauaaaaaugcacaaauaagcgcgucaaaaggcaacaacaaagccauaaaaaaauaccaaaaaaaagucaucgaauguuacauaggauaucuacggaaaaauuacgaagaauuguucgauuuuucagauuucaaaaugaauauucaggagauuaaaaaacaaauaaaagauauaaacgacaauaaaacauacgaacgaauaacuguuaagacaucugacaaaacaaucguaauaaacgaugauuucgaauacauaaucagcauauucgcucugcugaacucaaaugcaguuauaaacaaaauaagaaacagauucuucgccaccucaguauggcuaaauacuucggaauaucaaaauauaauagacauuuuagaugaaauaaugcaauugaacacgcuaagaaacgaguguauaacagaaaauuggaaucuaaauuuagaagaauucauccaaaaaaugaaagaaauagagaaagauuuugacgauuucaaaauccaaacaaaaaaagaaauauucaacaacuauuaugaggauauaaaaaacaacauccugaccgaauucaaagaugacauuaacgguugcgacguacuagaaaagaaacuugaaaagauagucauauuugacgacgagacaaaauuugaaauagacaaaaaaagcaauauacuacaagacgaacaacggaaacugucaaauauaaauaaaaaagaucuaaaaaaaaaaguagaccaauacauaaaagacaaggaccaagagauaaaaagcaaaauacuauguagaauuauauucaauucugacuuccuaaagaaauacaaaaaagagauagacaaucuuauagaggauauggaaucagaaaaugaaaacaaauuccaagaaauauacuauccaaaggaacgaaaaaacgaacucuacauauauaaaaaaaaucuauuccuaaacaucggaaacccuaauuuugauaaaauauauggacuaauaagcaacgauauaaaaauggccgacgccaaauuccuauuuaauauugauggaaaaaacaucaggaaaaauaaaauaagugagauugacgcaauucuaaaaaacuuaaacgacaaacucaacggcuacucaaaggaauauaaagaaaaguacauaaaaaagcuaaaagaaaacgacgauuucuucgcuaagaacauacagaacaaaaauuacaaaagcuucgaaaaggacuacaauagagugagcgaguauaaaaagauaagagaccucguggaauucaauuaucuaaacaagaucgaaucuuaccuaauagacauaaacuggaaacuggcaauacaaauggcgagauuugaacgagacaugcacuauaucgucaacggccuccgagagcucggaauaaucaaacuaucuggauauaauaccggaauaagcagagcguauccgaagagaaacggaucagacggauucuauaccaccacggcauacuacaaauuuuuugacgaagaaucuuauaaaaaauuugaaaaaauaugcuauggauuuggaauugaccuaagugaaaauagcgaaauaaauaaaccagaaaaugaaagcauaagaaacuacaucucacauuucuacaucgucagaaaccccuuugcagauuacucaauagcagaacaaauugauagagucuccaaucuacuaucauacuccacaagauacaauaauucaaccuaugccucagucuucgaaguauuuaaaaaggaugucaauuuagacuaugacgaauuaaaaaaaaaauuuaaacuaaucggaaauaacgauaucuuagaaagacugaugaaacccaaaaagguaucgguccuggaauuagaaucauacaacagugacuacaucaaaaaccuuaucauugaacuuuuaacaaaaauagaaaauaccaaugacacucucuaa

SEQ ID NO: 11501 - RNA, 4305 nt, Artificial Sequence
  Cas13a variant__Leptotrichia shahii__WP_018451595.1__Cas13a(long)
augggaaauuuauuuggacauaaaagaugguaugaagucagagauaaaaaagacuucaaaauuaaaagaaaaguaaaagucaaaagaaacuacgacggaaacaaauacauacuaaauauaaacgaaaauaacaacaaagagaaaauagacaacaacaaauuuaucagaaaauauauaaacuacaaaaaaaaugauaacauccucaaagaauuuacaagaaaauuccaugccggcaacauauuauuuaaauuaaaaggcaaggaagggauuauacguaucgagaauaacgacgacuuucuugagacugaagaaguaguccucuauauagaagcauauggaaaaucagaaaaacuuaaagcauuaggcauaaccaaaaaaaaaaucauagacgaggcgauaagacaagguaucaccaaagaugacaaaaaaauugaaaucaaacgacaagaaaacgaggaagaaaucgaaauugacauucgagaugaauauacaaacaagacacuaaacgauugcucgauaauauuaagaaucaucgaaaaugacgaauuggaaacaaaaaaauccauauacgaaaucuucaagaacaucaacaugagccuguacaaaaucauagaaaaaauaauugaaaaugaaacagagaaagucuuugaaaauagauauuacgaagaacaucucagagaaaaauuauuaaaagaugauaaaauugaugucauauuaaccaacuucauggaaauucgagaaaaaauuaaaaguaaucucgaaauacucggauuuguaaaauucuaccuaaauguagguggagauaaaaagaaaagcaaaaacaaaaaaaugcucguggaaaaaauucuaaacaucaacgucgauuugacaguagaggacaucgccgauuucguaauaaaagaacuggaauucuggaacauaacaaaacgaaucgaaaaaguaaaaaaaguaaacaacgaauuucucgaaaaacgacguaacagaacuuacaucaaaaguuauguacuucuagauaaacaugaaaaauuuaagaucgaacgugaaaacaaaaaagacaaaauaguaaaauucuucguagaaaauauaaagaacaauaguauaaaagaaaagaucgaaaaaauccuugcagaauucaaaauugacgaauuaauaaaaaaacuggaaaaggaauuaaaaaaagggaacugcgauacagaaauuuuuggaauauucaaaaaacacuacaaagucaauuucgacagcaaaaaauucaguaagaagucagaugaagaaaaggaacuauacaaaaucauauaccgcuaccuaaaaggacgaaucgaaaaaauuuuggugaacgaacaaaaaguccgacuuaaaaaaauggaaaagaucgaaaucgaaaaaauauuaaacgaaucaauccuguccgaaaaaauucuaaaaagaguaaaacaauauacacuagaacacaucauguaccuagguaaacuaaggcauaacgacauagauaugacuaccgucaacacagaugacuucagcagacuacacgcgaaagaagaauuagaucuugaacuaauaacauuuuucgcaaguacaaacauggaacucaacaaaauuuuuaguagagaaaacauaaauaaugacgagaacauagacuucuucggcggagaccgagagaagaacuacguauuggauaaaaaaauccuaaacucaaaaaucaaaauaaucagggauuuagacuuuauugacaauaaaaacaauauaacaaacaauuucauuagaaaauucacgaaaauuggcacaaaugaaaggaaucgaauccuacacgccauaucuaaggaacgagaccuccaaggaacucaagaugauuacaauaaaguuauaaauauaauacaaaaccuuaaaauauccgacgaagaagugucgaaagcccuaaaucucgacgucgucuucaaagauaaaaaaaacauaauaacaaaaaucaaugacauaaaaauuagugaggaaaacaacaacgacauuaaauaccuaccaagcuuuagcaagguauuaccagaaauauuaaacuuauacagaaacaacccuaaaaaugaaccauuugacacaauagaaacagaaaagauaguccugaaugcucuaaucuacguuaauaaagaacuuuacaaaaaacuaauauuagaagaugauuuagaggaaaacgaaagcaaaaacauauuucuacaagaauugaaaaagacuuuaggcaauaucgacgaaauagacgagaacaucauagaaaauuauuacaaaaaugcccaaauuuccgccaguaaagggaauaauaaagcgauaaagaaauaccagaaaaaaguaauagagugcuauauaggauaucuucgcaaaaauuacgaagagcuuuuugacuucucagauuucaaaaugaacauccaagaaauaaaaaaacaaauaaaggacauuaacgacaacaaaacuuaugaaagaauaacugugaagacaagcgacaaaacaauagugauaaacgacgauuucgaauacauaauaagcaucuucgcacuauuaaauagcaacgccguaaucaacaaaauaagaaacagauucuucgccacaucaguauggcucaacacaucggaauaucaaaacauaauagauauacuagacgaaauaaugcaguuaaacacccugcguaaugaaugcauaacagaaaacuggaaucucaaccucgaagaauucauccaaaaaaugaaagaaauagaaaaagauuucgacgacuucaagauucaaacgaagaaagaaauauucaauaacuauuacgaagauaucaagaauaauauacuaacggaguuuaaagaugacauaaacggcugcgauguacucgaaaaaaagcucgagaaaauuguaauauucgacgacgaaaccaaauuugaaauagacaaaaaauccaacauacuacaggaugaacaaaggaaacucucaaauauaaacaaaaaggaucugaaaaaaaagguagaccaguacauaaaagacaaagaucaagaaauaaaaucgaaaauucucugcaggauaauauuuaacagcgacuuccuaaaaaaauauaaaaaagaaauagacaauuuaauagaagauauggagucagaaaacgaaaauaaguuccaagaaauauauuacccaaaagaacgaaaaaaugaauuauauauauacaaaaaaaacuuauuccucaacauaggcaaccccaacuucgauaaaaucuacggacugauaucaaacgauauuaagauggcagacgcgaaauuccuauucaacauagacggcaagaacauaagaaaaaacaaaauaucugaaaucgacgccauacuaaaaaaucuaaaugacaaacugaacggauacucaaaagaauacaaagaaaaauacauaaaaaaacucaaagaaaacgaugauuucuucgcaaagaacauccaaaacaaaaacuacaaaucauucgaaaaagacuacaaccggguaucagaauacaagaagauaagagaccuugucgaauucaacuaccuaaauaaaaucgagucauaucuaauugauauaaauuggaaacuagccauacaaauggcacgcuuugaaagagauaugcacuauaucguaaacgggcuccgcgagcucggaauaauaaaacuaucgggauacaacacuggcauaucacgagcguacccuaaaagaaacggcagcgacgguuucuauacgaccacugccuacuauaaguuuuuugacgaagaaagcuacaaaaaguucgaaaaaauaugcuacggauucggaaucgacuuaagcgaaaacucagaaauaaacaaacccgaaaaugaauccaucagaaauuauauaagucauuucuacauaguacgaaauccauuugcagauuacagcauugcagaacaaauugauagagucucaaacuuacuaagcuauucuacacgguacaauaacaguacauacgcaucaguauucgaaguauuuaaaaaagacguaaaucuagacuacgacgaauugaaaaagaaguucaaguuaauaggcaacaacgacauacuagaacgacuaaugaaaccaaaaaaaguaucgguauuagaauuagaaucuuacaauucagauuauaucaaaaaccucauaauagaauuguuaacaaaaaucgaaaauacgaaugacacacuaaaaagaccggcagcaaccaaaaaagcugggcaagcaaaaaaaaagaagggaagcuacccauaugacguuccagauuacgcauacccuuaugacguaccagauuaugcauauccuuaugacguaccggacuacgccuag

SEQ ID NO: 11502 - RNA, 4158 nt, Artificial Sequence
  Cas13a variant__Leptotrichia sp. oral__WP_021744063.1__Cas13a
augggcaaccucuucggacacaaacggugguacgaagucagagacaaaaaagauuucaaaauaaaaaggaaagucaaaguuaaaagaaauuacgaugggaauaaauacauacucaacaucaaugaaaacaacaauaaagaaaaaaucgacaacaauaaauuuauaggagaauuuguaaacuacaaaaagaauaacaauguucuaaaagaauuuaaacgcaaguuccacgccggaaauauccuauucaaacucaagggaaaggaagaaaucauuagaauagaaaacaaugaugacuuccuagaaacagaagaaguaguccucuacaucgaaguauacggcaagucagaaaaacuuaaagcgcuagaaaucacaaaaaaaaaaauuaucgacgaagcaauaagacaagggauaacuaaagaugauaagaagaucgaaauaaaacgccaagaaaacgaagaagaaauagaaauagauauacgugacgaauauacuaacaaaaccuuaaacgacugcaguauaauacugcgcauaauagaaaaugacgaacuagaaacuaaaaaauccauauaugagaucuucaaaaacauaaacaugagccuuuacaaaauaauagaaaaaauaaucgaaaaugaaacugaaaaaguauuugaaaaccgauacuaugaagaacacuuacgagaaaaauuauuaaaggauaauaaaauagacgugauacuaaccaacuucauggaaauacgugaaaaaauaaaaaguaacuuagaaauaaugggauucguaaaguucuacuuaaacgugucaggcgauaaaaaaaaaucagaaaauaaaaagauguucguugaaaaaauacucaauacuaauguagaccuaacaguagaggacaucguagacuuuauuguaaaagaguuaaaauucuggaacaucacgaagagaauagaaaaaguaaaaaaauuuaauaacgaauuucucgaaaaucgacgaaacagaacauacauaaaguccuacguccuauuggauaagcacgagaaauuuaaaauagaaagagaaaacaaaaaagauaaaauaguaaaauucuuuguggaaaacauaaagaauaauagcauaaaagagaaaauagaaaaaauacucgcugaauucaaaauaaacgaacucauuaaaaaacuagaaaaagaacuaaagaaagguaacugcgauacagaaaucuucgguauauucaaaaaacauuauaaaguuaauuucgacucaaaaaaguuuucuaacaaaucagacgaagaaaaagaauuauacaaaaucauauacagauaucuuaaaggcagaauagagaaaauacugguaaacgaacaaaaaguacgacuaaagaaaauggaaaaaauugaaaucgaaaagauucuaaacgaaaguauccuauccgaaaaaauucuaaaacgaguaaaacaguacacccucgaacauaucauguaccuagggaaauuacgacacaacgacauaguaaaaaugacaguuaacaccgacgacuucaguagacuccacgccaaagaagaacuagaucuugaacugaucaccuucuuugcuucaaccaacauggagcucaacaaaauauucaacggaaaagaaaaagucacugauuucuucggguucaacuuaaacgggcaaaaaauuacuuuaaaagaaaaaguacccucauucaaacuaaacauucuaaaaaaauuaaacuucaucaacaacgaaaacaauauagacgaaaaacuaucucauuucuacucauuucaaaaagagggauacuuacuacggaacaaaauacuucacaacucguacggaaacauucaagaaacaaaaaaccuaaaaggcgaauacgaaaauguagagaagcuaaucaaagaacuaaaaguuagcgaugaagaaaucuccaaauccuuaucucuagaugucaucuucgagggaaaaguagauauuaucaauaaaauuaauaguuuaaaaauaggcgaauacaaggacaaaaaauaucuaccuucguucuccaaaaucguccuugaaaucacuagaaaauuccgagaaauaaacaaagacaaacucuucgacauagaaagcgaaaaaauaauucuaaaugcagucaaguauguuaacaaaauauuauacgaaaaaauaacaagcaacgaagaaaacgaauucuuaaaaacuuuacccgacaaacugguaaaaaaaucgaacaauaaaaaagaaaauaagaacuuacuaucaauagaagaauacuauaaaaaugcacaagucucaaguucaaaaggagauaaaaaagcuauuaaaaaauaccagaauaaagucacaaacgcuuaccuagaauaucuagaaaacacauucacagaaauaaucgacuucuccaaauucaaucucaauuaugacgaaauaaagacgaaaaucgaagagagaaaagauaacaaaagcaaaauuauuauagacucaauuucaaccaauauuaacauuacaaacgacaucgaauacauaauuucaauauucgcuuuacucaacucaaauacguauauuaacaaaauaagaaaccgauucuucgcaacaucgguauggcuugaaaaacaaaauggcacaaaagaauacgauuacgaaaacaucauaucaauccuugacgaaguucuccuaauaaaccuacuacgagaaaauaauaucaccgauauacuagaucucaaaaaugcaauaauagaugcuaaaauuguggaaaaugacgaaacuuacauuaaaaacuacauauucgagucaaaugaagaaaaacucaaaaaaagacuuuucugcgaagaacucguagacaaagaggacauucguaaaauauuugaggacgaaaacuucaaauucaaaagcuucauaaagaaaaaugaaauaggaaacuucaaaauaaauuucgggaucuuaucaaaccuagaauguaacucagaagucgaagccaaaaaaauuauagguaaaaauucaaaaaaacuagaaagcuuuauacaaaauauuauagacgaauacaaaaguaacauccguacccuauucaguucggaauuccuagaaaaauacaaggaagaaaucgacaaucuaguggaggauacugaaagugagaauaagaauaaauuugaaaaaaucuacuaucccaaagaacacaaaaaugaacuuuacauauacaagaagaaucuauucuugaacauaggaaacccgaauuuugauaaaaucuauggacucauaucgaaagacaucaaaaacguagacaccaaaaucuuauucgaugacgauauaaaaaaaaacaagaucucagaaaucgaugcaauucuaaaaaaccuaaaugacaaacucaacggcuauucuaacgauuacaaagcgaaguacgucaacaaacuaaaagagaaugaugauuuuuucgccaaaaauauccagaaugaaaacuacagcucauuuggagaauucgaaaaagauuacaacaaagugagcgaauacaagaaaaucagagacuuagucgaguucaacuacuuaaauaaaauagaaucauaccuuaucgacauaaacuggaaacuagccauccaaauggcacgauucgaacgagauaugcacuacauaguaaacggucuaagagaauugggaauuauaaaacucuccggauacaauacuggaauaucacgagcauacccaaaacguaauggcagugacggauucuacaccacaaccgcguacuauaaauucuucgacgaagagucguacaaaaaauucgaaaaaauuugcuauggauucggcauagaccucagcgaaaauucugaaauaaauaaaccugaaaaugagucaauacguaacuacauuucacauuucuauaucgugagaaacccauucgccgacuauucuauagcagaacaaauagacagaguuucgaacuuacucaguuacagcacacgauauaauaacagcacauaugcgucaguauucgagguuuucaaaaaagacgucaaucuagacuaugacgagcucaaaaaaaaauucagacucauagggaacaaugacauauuagaaagacucaugaaaccaaaaaaagucagugugcuggaacuagaaagcuauaacagcgacuacauaaaaaaccuaauaauagagcuacuaaccaaaauagagaacacaaacgacacccuauaa

SEQ ID NO: 11503 - RNA, 3459 nt, Artificial Sequence
  Cas13a variant__Leptotrichia wadei__WP_021746774.1__Cas13a
augaaggucacaaaaguagacgguauaagccacaaaaaauauauagaagaagguaaacucguaaaaucgacguccgaagaaaacagaaccagugaacgccuuagugaacuauuaagcauacgccuagacauauacaucaagaauccugauaaugccucagaagaagagaacaggauaagaagagaaaauuuaaaaaaauucuuuucaaacaaaguacuucaccuaaaagauaguguacuuuaccucaaaaauagaaaagaaaaaaacgcgguucaagacaaaaacuacucugaagaagauauaagcgaguaugacuuaaaaaacaaaaacucauuuaguguacuaaaaaaaauacuauuaaaugaagacguaaauucagaagaacucgagauauuucguaaagacgucgaagcgaaacuaaacaaaauaaacucgcuaaaauauucauuugaagaaaacaaagcuaacuaccaaaaaauaaacgaaaauaacguugaaaaagucggaggaaaauccaagagaaacauaauuuacgacuacuauagagaaucagcaaaaagaaacgauuauauuaauaauguccaagaagccuuugacaaacuuuacaaaaaagaagacauugagaagcuauucuuucugaucgaaaacucaaaaaaacacgaaaaauacaaaauaagagaauacuaucacaaaauaaucggccgcaaaaaugacaaagaaaacuuugcaaaaauaauauacgaggaaauacaaaauguaaacaacaucaaagaacucaucgaaaaaaucccagacaugagugagcuaaaaaaaagucaaguauuuuacaaauauuaccuugauaaagaagaacuaaaugacaagaauauaaaauaugcauucugucacuucguagaaauagaaaugucacaacuccuaaagaacuacguauacaaaagacucaguaauauaucaaaugauaaaauaaaaagaauauuugaauaccaaaaucuaaaaaaauuaaucgaaaauaaguuacuaaacaaacucgauacauacgucagaaacugcggcaaauauaauuacuaccuacaaguaggcgaaauagcgacaagcgauuuuauagcaagaaacagacaaaacgaagcauuccuccggaacauaauaggcguaagcuccguagcauacuucagcuuacgaaauauauuagaaaccgaaaacgaaaacggaauuacaggcagaaugcgcgguaaaacaguaaaaaacaacaaaggcgaagagaaauacgucagcggcgaagucgacaaaauauacaacgaaaacaaacaaaaugaaguaaaagaaaauuugaaaauguuuuacagcuacgacuucaacauggauaacaaaaacgaaauugaagacuucuucgcaaacaucgacgaggcuauaucaagcauaaggcacggaauaguccacuucaacuuagaacuagaaggaaaggauaucuuugccuucaaaaauaucgcacccucagaaauaucuaaaaaaauguuccaaaacgagauaaaugaaaaaaagcucaaacucaaaaucuuuaaacaauuaaacagcgcaaacguauuuaacuauuacgagaaagacguuauaauaaaauaucucaaaaacacaaaguucaauuucguaaacaaaaacauaccuuuuguaccuucauucacuaaacuauacaacaaaaucgaagaucuacgaaacacacuaaaguuuuucuggucuguuccaaaagacaaagaagaaaaagacgcacaaaucuaucuccuuaaaaacaucuacuauggggaauuccucaacaaauuuguaaaaaacucaaaaguauucuucaaaauaacaaaugaagucaucaaaauaaacaaacaaagaaaccaaaaaaccggucauuacaaauaccaaaaauucgaaaacaucgaaaaaacaguaccaguagaauaccuagcaauaauccaaucccgagaaaugauuaacaaccaagauaaggaagaaaaaaacacauauauugacuucauacaacaaauauuucuaaaaggauucauagacuaccuaaauaaaaacaaccuaaaguauauagaaucuaacaacaauaaugauaacaaugacauauucuccaaaauuaaaauaaaaaaagacaacaaagaaaaauacgauaaaaucuuaaaaaacuaugaaaaacauaauagaaauaaagagaucccacacgagauaaacgaauuuguccgagaaauaaaacuagggaaaauccucaaauacacagaaaaucuaaacauguuuuaucuaauacuaaaacuacucaaucauaaggaacuaacaaaucuaaaagguagucuagagaaauaucaaagcgccaacaaagaagaaaccuucucagacgaauuagaacuuauaaaccuacuaaauuuagacaacaaucgaguaacggaagauuucgagcucgaggccaacgaaauaggcaaauucuuagauuucaacgaaaacaaaauaaaagacagaaaagaauuaaagaaauucgacaccaacaaaauauacuucgacggugaaaauaucauaaaacauagagccuuuuacaauaucaagaaauacggaauguuaaauuuacuagaaaaaaucgcugacaaagcaaaauauaaaauaucacuuaaagagcucaaagaauacagcaacaaaaaaaacgaaauagaaaagaauuauacaaugcaacaaaacuuacacagaaaguacgcccgacccaagaaagaugaaaaauuuaacgacgaagacuacaaagaauacgaaaaagcuaucggaaacauacaaaaauacacacacuuaaaaaauaaagucgaauuuaacgaacuuaaccuacuucaaggucuacuccuuaaaaucuuacaccgucuuguaggauacaccaguauaugggagagagaccuaagauuuaggcuaaaaggagaauucccagaaaaucacuacauagaagaaauauuuaauuuugacaauucgaaaaacguaaaauauaaaucaggacaaaucguagaaaaauacauaaacuucuacaaagaacuauauaaagauaacguagaaaaacgaucaauauacagcgacaaaaaaguuaaaaaguugaagcaagaaaaaaaagaccuauacauccgaaacuacauagcccacuuuaacuauauuccacacgccgaaauaucacuccuagaaguauuggaaaaccuaagaaaacugcuaucauacgacaggaaauuaaaaaacgcaauaaugaaaucaauaguagauauccucaaagaauacggcuuuguagccacauucaaaauaggagcagauaaaaaaauagaaauccaaacacuagaaagcgaaaagauuguacacuuaaaaaaccuuaaaaagaaaaaacucaugacugaccgcaauuccgaagaacuaugcgaacuaguuaaaguaauguucgaauauaaagcacuugaauga

SEQ ID NO: 11504 - RNA, 3459 nt, Artificial Sequence
  Cas13a variant__Leptotrichia wadei__WP_021746774.1__Cas13a(G403D)
augaaaguaacaaaagucgacgggaucagccauaagaaauauauagaagagggcaaacuagucaaaaguaccagugaagaaaaccgaacuucagaacgacuaucagagcuacuaucgauucgauuagacauauacauaaaaaacccagacaacgcauccgaagaagaaaaucgcauccgucgugaaaacuuaaaaaaauucuucucaaacaaaguccuacaccuaaaagacagcguccucuaccuuaaaaacagaaaagaaaaaaacgcaguccaagacaaaaacuauagcgaagaggauauaagcgaauacgaccuuaaaaauaaaaauuccuucucaguacucaaaaaaauacuacuaaaugaagacgucaacagcgaagaacucgaaauauuccgaaaagacguugaagccaaacucaauaagauaaacucacuaaaauauucauucgaagaaaacaaggcaaauuaccaaaaaauaaacgaaaacaacguagaaaaaguaggcgggaaaaguaaacgaaacauaaucuaugauuauuacagagaaucagcaaaaagaaacgauuacauaaacaacguccaggaagcauucgacaaacuauacaagaaggaagacaucgaaaaguuauucuuccucauugaaaacucuaaaaaacaugagaaauauaaaauccgagaauacuaucacaaaauaauaggacgaaaaaacgacaaggaaaauuucgccaaaauaauauaugaagagauccaaaauguaaacaacaucaaagaacucauagaaaaaauaccagauaugucugaguuaaaaaaaagccaaguauucuacaaguauuacuuagacaaagaggaauuaaaugacaaaaacaucaaauacgcuuuuugccauuucguagaaauugaaaugucccaacuauuaaaaaacuauguauauaaacgacuaaguaacauaucaaaugacaagauuaagagaauauuugaauaccaaaauuuaaaaaaauuaauagaaaauaaacuacuaaacaaauuggacacguacguucgcaacugcggaaaauauaacuacuauuuacaaguaggugagauagccacuucggacuuuaucgcaagaaacagacaaaacgaagccuuucuacgaaauauuauuggcgucagcucaguagcauauuucucccuacgaaauauacuggagacagagaacgaaaacgacaucaccggacgaaugcgcggcaaaacaguuaaaaacaacaaaggagaagaaaaauacguaagcggcgaggucgacaaaauauacaaugaaaacaaacaaaacgaaguaaaagagaauuuaaaaauguucuacuccuacgauuucaacauggacaacaaaaaugaaauagaagacuucuucgcuaacaucgacgaagcgauauccuccaucagacacggaauaguacacuucaaccuagaacuggaaggaaaagacauauuugccuucaaaaauauagcaccaucggaaauaucaaaaaagauguuccaaaacgaaauaaaugagaaaaaacuaaaacuaaaaauauucaaacaacucaacagcgcaaauguauucaacuacuacgaaaaagauguaaucauaaaauaccuaaaaaauacaaaauucaauuucguaaauaaaaacaucccauucguccccucauucaccaaacuauacaacaaaauagaggaccuacgcaacacacuaaaauuuuucuggucaguucccaaagauaaagaagagaaggacgcacagauauaucuacugaaaaauaucuacuauggagaauuucuaaacaaauuugugaaaaacucaaaaguuuucuucaaaauaaccaacgaggucauaaaaauaaauaaacaaagaaaccagaaaacaggacacuauaaauaccaaaaauuugaaaacauagaaaaaaccguaccaguugaauaccuugcaauaauacagucacgagaaaugauaaacaaccaagacaaagaagaaaagaacacauauauagauuuuauacaacaaauauuccuaaaaggguucaucgacuauuugaacaaaaacaaccuaaaauacauagaaagcaacaauaacaaugauaauaacgacauauucagcaaaauaaaaaucaaaaaagacaacaaggaaaaauaugauaaaauacuaaaaaauuacgaaaaacacaaccgcaacaaagaaauaccccaugaaauaaacgaauucguacgagaaauaaaacucggaaaaauacuaaaauacaccgaaaaccucaauauguuuuaccucauuuuaaaacuacuaaaucauaaagaacuuacaaaccucaaagguucacuagaaaaauaccaaucagcaaacaaagaagaaacuuucucagacgaauuagaacuaauaaaccuacuaaaccuggacaauaauagggucacagaagacuucgaacuagaagcaaacgaaauugguaaauuucuagauuuuaacgaaaauaaaauaaaagaccgaaaagaacuaaaaaaauucgacacaaacaaaaucuauuucgauggagaaaacauaauaaaacaccgagccuucuauaacauuaaaaaauacggaauguuaaacuugcuagaaaaaauagcagacaaagcaaaauacaagauauccuuaaaagaacuuaaagaauauucaaacaaaaaaaacgaaauagagaaaaauuacacaaugcaacagaaccuacaccgaaaauacgcaaggccuaaaaaggacgaaaaauucaacgaugaggacuauaaagaauaugaaaaagccauagguaacauccaaaaauauacacaccuaaaaaacaaaguagaauucaacgaacuuaaccuacuacagggucuccugcuaaaaauccugcaccgacuaguaggauacacauccauaugggaacgagaucuacguuuuagacuaaaaggcgaguuuccagaaaaccauuacauagaagaaaucuuuaauuuugacaacucgaaaaacgucaaguacaaaagcggccaaauaguugaaaaauacauaaacuucuauaaagaacucuauaaagacaauguagaaaaacgaucaauauauucggauaaaaaaguaaaaaaacucaaacaagagaaaaaagaccuauacauccgcaacuacauagcccacuuuaacuacauaccacaugcagaaauaucacucuuggaaguacuagaaaaucuuagaaaacuacuaucauacgaccgcaaacucaaaaacgcgauaaugaagagcauaguggacauacucaaagaauacggauucguagcaacauucaagauaggagccgauaaaaaaauugaaauacaaacccuggagucugaaaaaauuguacaucuuaaaaaucuaaaaaaaaaaaaacuaaugacagacaggaauucagaagaguuaugcgagcuugucaaagucauguuugaguacaaagcacucgaauaa

SEQ ID NO: 11505 - RNA, 3909 nt, Artificial Sequence
  Cas13a variant__Leptotrichia wadei__WP_021746774.1__6xHis-Tag/Twin-Strep/SUMO_Cas13a(G403D)
augggcagcagccaccaccaucaccaccauucaagcggccuagucccccgugguagccauauggcaucauggagucacccacaauucgaaaaaggcggaggaucaggaggcggcucaggaggcuccgcauggagccauccucaauuugaaaaaaugucagauucugaaguaaaucaagaagcaaaacccgaaguaaaaccugaaguaaagccugaaacacacauuaaucucaaagucucagauggcuccagugagaucuucuucaaaauaaaaaaaacaacaccauuacgaagauuaauggaagcauucgccaaacgacagggaaaggaaauggauagccuuagauuuuuauaugauggcaucagaauccaagccgaccaaaccccagaagaccuagacauggaagauaacgacaucauugaagcacacagagaacaaaucgguggaucaaugaaagucacaaaaguagacggaauaucgcauaaaaaauacauagaagaagggaagcucgucaaaucuacuuccgaagaaaacaggacaagcgaaagauugagugaacuuuuaucaauaagacuagacauuuauaucaaaaacccugacaacgcaagcgaagaagaaaacagaauaagacgagagaaucuaaagaaauuuuuuucaaauaaaguuuuacaccuaaaagacuccguucuauacuugaaaaaccgaaaagaaaaaaacgcaguacaggauaaaaacuacagcgaagaagacaucucagaauacgaccuaaaaaacaaaaauucauucaguguacuaaagaaaauacucuuaaaugaagauguuaacagugaggaauuagaaauauuccgcaaggacguggaagcaaaacuaaacaaaauuaauagccuuaaauacucauuugaagaaaacaaagcaaacuaccaaaaaauuaaugaaaacaacgucgaaaaagugggaggaaaaucaaaacgaaauauaaucuaugacuauuaccgcgaaucagccaagagaaacgacuacaucaacaacgugcaagaagcauuugacaaacuauacaaaaaagaagauauagaaaaacuauuuuuccuuauagaaaacucaaaaaaacacgaaaaauauaaaauuagggaauauuaucauaaaauuauuggcagaaaaaacgauaaagaaaacuuugcgaaaauaauauacgaagaaauucaaaauguaaacaauauuaaagagcuaaucgaaaaaauaccugauaugucagaauuaaaaaaaucacaaguuuuuuacaaauacuaccuugacaaagaggaauuaaacgauaaaaacauaaaauaugcuuuuugccacuucgucgagauugaaaugagccaauuacuuaaaaacuacguauauaaaagacucucaaauaucagcaacgauaagauuaaaagaaucuucgaauaccaaaaccucaaaaaauuaauagaaaauaaacuacuuaacaaauuagacacuuauguucgaaacugcgguaaauacaacuacuaccuccaagugggagaaauugcaaccucugauuucauagccagaaaucgacaaaacgaagcguuccuaagaaacaucaucggaguuaguucuguagcauauuucucuuuacgaaacauauuagagaccgaaaaugaaaaugacauuaccggaagaaugcgcgggaaaacuguaaaaaacaauaagggcgaagaaaaauacgucucuggagaaguugauaaaauuuacaacgaaaacaaacaaaacgaaguaaaagaaaaccucaaaauguucuauuccuacgauuucaauauggacaacaaaaacgaaauagaagacuucuuugccaacauagaugaagcaaucagcucaauacgacacggaauaguccauuuuaaccuugaauuagaaggaaaagauauauucgccuuuaaaaacauagcaccaucugagauaucaaaaaaaauguuccagaacgagauaaaugaaaaaaagcucaaauuaaaaaucuucaaacagcuaaauucagcaaauguauuuaauuacuaugagaaagacgucauaaucaaauacuuaaagaacacaaaauucaauuucguaaacaaaaacaucccguucgucccaucuuucacaaaauuauacaauaaaauagaagaucuacggaauacauuaaaguucuuuuggagugucccaaaagauaaagaagaaaaagacgcacaaauauaccucuuaaagaacaucuacuauggggaauuuuuaaacaaauuuguaaaaaauucaaaaguauucuuuaaaauuacaaaugaaguaauaaagauaaauaagcaacgaaaccaaaaaacaggacacuacaaauaccaaaaguucgaaaauauagaaaaaacaguaccaguggaauaucuagcaauaauacaaaguagagagaugauaaacaaucaggacaaagaggaaaaaaacacauacauagauuucauacaacaaaucuuccuaaaaggauuuauagacuaccugaacaaaaauaaccuaaaauauauagaaucaaacaauaauaacgacaacaaugauauauucucaaaaauaaaaauaaaaaaagauaacaaagaaaaauacgauaaaauccucaaaaauuaugaaaaacacaaccgaaauaaagaaauaccacacgaaauaaacgaauucguuagagaaaucaagcucgguaaaauacuuaaguacacagaaaaccucaacauguucuaccucaucuuaaaacuccuuaaccauaaagaauugacaaauuuaaaaggcucguuagaaaaauaccaguccgccaacaaagaagaaacauucucugaugaguuagaacuaaucaacuuauuaaaccuggacaauaacagagugaccgaagauuucgaacuagaagcaaaugaaauaggaaaauuccuggauuuuaacgaaaacaaaauaaaagaccgaaaagaacugaaaaaauuugauaccaacaaaauauacuuugauggggaaaauauuauaaagcaucgagcauuuuacaauauaaaaaaauacggaaugcuaaaccuauuagaaaaaauagcagacaaagcaaaguauaaaauaagccuaaaagaacuaaaagaguauucgaacaaaaaaaacgaaaucgaaaaaaauuacacuaugcaacaaaaccuacacagaaaauacgccagacccaaaaaggaugaaaaauuuaaugacgaggacuauaaagaauacgagaaagcaauaggaaacauccaaaaauacacacaccuuaagaauaaaguagaauucaaugaacuaaacuuauuacaaggccucuuacuaaaaaucuuacacagguuaguuggcuauacaucaaucugggaaagagaccuaagauucagacucaaaggagaauuuccagaaaaucacuacauagaagagaucuuuaacuucgauaauucuaaaaauguaaaauacaaguccggacagaucguagaaaaauacauaaauuucuacaaagaacuauacaaagacaacguagagaaaagauccaucuacagcgauaaaaaaguaaagaaacuaaaacaggaaaaaaaagaucucuauauaagaaacuacauagcacauuucaauuacauaccacaugcggaaauaucauuacucgaagugcuggaaaacuuaagaaaacuacuaucauacgauaggaaacuuaaaaacgccauaaugaaaucaauaguagacauucuaaaagaauauggauuuguagccaccuucaaaaucggagcagauaaaaaaauagaaauccaaacacuagaaagugaaaaaaucguccacuuaaaaaaccuaaaaaaaaagaaacugaugacagacagaaacagcgaagagcuaugcgaauuagucaaaguaauguuugaauacaaagcacucgaauaa

SEQ ID NO: 11506 - RNA, 3459 nt, Artificial Sequence
  Cas13a variant__Leptotrichia wadei__WP_021746774.1__Cas13a(R474A,R1046A)
augaaaguaacaaaaguugacgguauaagccacaaaaaauacauugaagaaggcaaauugguaaaaucaacgucagaagagaauagaacgagcgagagacuauccgaacugcucucuauaaggcuagauauauacauaaaaaacccggacaacgcuucagaagaagaaaauagaauacgcagagaaaaucuaaagaaauucuucucuaacaaaguccuacaccuaaaagauucgguacucuaccuaaaaaauagaaaagaaaaaaacgccgugcaagacaagaacuacuccgaagaagacauaucagaauacgaucuaaaaaacaaaaauaguuucuccguguugaaaaaaauacuauuaaacgaagaugucaauucagaagaacuagaaauauuccgaaaagacguagaggcaaaacucaacaaaauaaauucuuuaaaguacucauuugaggaaaacaaagcuaacuaccaaaaaauaaacgaaaacaacguagaaaaagucgggggcaaaucuaaaagaaacaucauauacgacuacuacagggaaucagcaaaaagaaacgacuacaucaacaacguccaggaagcguucgacaaacuauauaagaaagaggauauagaaaagcuauucuuuuuaauagaaaacagcaaaaaacacgagaaauauaaaauaagagaguacuaccacaaaauaauaggucgaaaaaacgacaaagaaaacuucgcaaaaauuauauacgaagaaauucagaaugugaauaacaucaaagaacuaauagaaaaaauaccagacaugucagaacuaaaaaagucacaaguguucuacaaauacuaucuagacaaagaagaacuaaaugauaaaaauauaaaauaugcauuuugccacuucguagaaauagaaaugucgcaauuacucaaaaauuacguauauaaaagauuaucaaacaucucuaaugauaaaauaaaaagaaucuuugaauaucaaaaccuaaaaaaacuuauagaaaacaaacuacugaacaaauuagacaccuacguacguaauuguggcaaauacaacuacuaucuucaaguaggagaaauagccaccuccgacuucauugcacgaaacagacaaaaugaagcauuccuaagaaauauaauaggagucuccuccguugccuacuuuucauuaagaaacauacuagaaaccgaaaacgaaaacggaauaaccggacgaaugcguggaaaaaccguaaaaaauaacaaaggagaagaaaaauaugucucgggagaaguagacaaaaucuacaacgaaaacaaacagaacgagguuaaagaaaaccuaaaaauguuuuacuccuacgacuucaacauggauaacaaaaaugaaaucgaagacuuuuucgccaacauugacgaagcaauaagcuccauagcacaugggauaguacauuuuaaccucgaacucgaagggaaagauaucuucgcauucaagaacauagcucccucagaaauaucaaaaaaaauguuucaaaaugaaauaaacgagaaaaaacuaaaauuaaaaaucuucaaacaacucaacucugcaaauguauuuaauuacuacgaaaaagacguaauaauaaaguaucuaaaaaacacuaaauucaauuucguaaauaaaaauauaccauuugucccaucauucaccaaacuauauaacaaaauagaagaccuaagaaacacauugaaauuuuuuuggagcguaccaaaggauaaagaagaaaaagacgcucaaauauacuugcuaaaaaacauauacuauggugaauuucuuaauaaauuugucaaaaacucaaaaguauucuuuaaaauuacaaaugaaguaauaaaaaucaacaagcaacguaaucaaaaaacaggccacuauaaauaccaaaaauucgaaaauaucgaaaaaacugucccaguagaguacuuagcaaucauucaaagcagagaaaugauaaauaaccaagacaaagaggaaaaaaacaccuacauugacuucauacaacaaauauucuuaaaaggguucauugauuaucucaauaagaauaacuuaaaguacaucgaaucaaacaacaacaaugauaacaacgacaucuucaguaaaauaaaaauaaaaaaagacaauaaagagaaauacgacaagauacuaaagaacuaugaaaaacacaauagaaacaaagaaauaccacaugaaauaaaugaguucgucagggaaauaaaacuaggaaagauccuaaaauauaccgaaaaucuaaacauguuuuacuuaauacuuaaauuacuaaaucauaaagagcuaacgaacuuaaaaggaucauuagaaaaauaccaaagcgcaaauaaggaagaaacuuuuucagacgaacuugagcucauaaaucuccuaaaucuugauaacaacaggguaacagaagacuuugaacuagaagcuaacgaaauaggaaaguuuuuagauuucaacgaaaacaaaauaaaagauagaaaagaacuuaaaaaguucgacacaaacaaaauauacuuugacggugagaacauuauaaaacauagagcauuuuacaauauaaaaaaauacggcauguuaaaccuauuagaaaaaauagcagauaaagcuaaauacaaaauuagccuaaaagaacuaaaagaauauucaaacaaaaagaacgaaauagaaaaaaacuacaccaugcaacaaaaccuacacaggaaauacgcaagaccaaaaaaagacgaaaaauucaacgaugaagacuacaaagaguacgaaaaagcaauaggaaacauccaaaaauauacacacuuaaaaaauaaaguagaauucaaugaacuaaacuugcuccaaggccuacuucuaaaaauccugcacagacuaguaggcuauacgagcauuugggagcgagaccuacgcuucagguuaaaaggggaauucccagaaaaccacuauauugaagaaaucuucaauuuugauaauucaaaaaacguaaaauacaaaucaggucagauaguagaaaaauacauaaauuucuacaaagaauuauacaaagauaauguagagaaaagaucaaucuacucagacaaaaaggucaaaaaauuaaaacaagaaaaaaaagaccuauacauagcaaauuacaucgcucacuucaacuacauaccccacgccgaaauuagucuauuagaaguccuagaaaaccuacgcaaacuacucagcuaugaccgcaaacuaaaaaaugcgaucaugaaguccauaguagauauacucaaagaauacggauucgucgcuacauuuaagaucggcgcagauaaaaaaauagaaauacaaacacuagaauccgaaaaaaucguacacuuaaaaaacuugaagaagaaaaaauuaaugacagaccgaaacuccgaagaauuaugcgaauuagucaaaguaauguuugaauacaaagcccucgaauaa

SEQ ID NO: 11507 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggagaaggccugagggcauccccacgcagaagaccacuauuaccacuacaaccacgcggauguccacguggagauggcugucuacgaggagggcgcgggagggccggguuuggguuuuggcguguaacgggugguucuagggcaucagcaaaccacguacaugccuucuucuuuuuccuacaauuacuggggaacgugcuaguaauagucuuaucccaucacuuuggaaaagaauuuggcacggccgguccgggagcaacaaugaaaguaacuaaaguagacggaauaucacacaagaaauacauugaagaaggcaaauuaguaaaaucaaccuccgaagaaaacagaacaucagaaagacuaucagaauuauuaucaauacgucuugauauauauaucaaaaaccccgauaacgccucagaagaagaaaacaggauaagaagagaaaaccucaagaaauucuucucaaauaaaguauuacaucugaaagauaguguauuauaucucaaaaacaggaaagagaaaaacgccgugcaagauaaaaauuacucagaagaagauauuagcgaauacgaucucaaaaacaaaaauaguuuuucgguauuaaagaaaauacuacuaaaugaagacguaaauucagaagaacuagaaauauucaggaaagauguugaagcgaaauuaaacaaaauaaacagccuaaaauacucguucgaagaaaauaaagcaaauuaccagaaaauaaaugaaaacaauguagaaaaagucggaggcaaaaguaaacggaauauaauauaugacuauuaucgugaauccgcgaaaagaaacgacuauauuaacaauguccaagaagcguuugauaaacuuuacaagaaagaagacauagaaaaauuauucuuuuuaauagaaaacagcaagaaacacgaaaaauacaaaauaagggaauauuaccacaaaauaauaggacgcaaaaaugacaaagaaaacuucgcuaaaauaauauacgaagaaauacaaaaugucaauaacauaaaagaacuaauagagaaaauaccagacaugucagaauugaagaaaagucaaguauucuacaaauauuaucuggacaaagaagaacuaaaugacaaaaacauaaaauacgccuucugucacuuuguagaaauagaaaugucucaacuucuuaaaaacuacguuuauaaaagacuaagcaacauaagcaaugacaaaauuaaaagaauuuuugaauaucaaaaucuuaagaaacuaauagaaaauaaacuuuuaaauaaacuagauacuuauguaagaaacugcgggaaauacaacuauuaccuacaaguuggagaaauagcgacaagcgauuucauagcaagaaacagacaaaaugaagcauucuuaagaaauauaauagguguguccaguguugcuuauuuuagcuuaagaaacauucuagaaacagaaaaugaaaauggaauaaccgguaggaugagagggaaaacagugaaaaacaauaaaggagaagaaaaauacguaucaggagaaguugauaaaauauacaacgaaaauaaacagaacgaaguaaaagaaaaccuaaaaauguucuacucauaugauuuuaacauggauaacaaaaaugaaauagaagacuucuuugcuaacauugacgaagccauaagcaguauagcccauggcauaguacauuucaaucuagaacuugaaggcaaagacauauuugcuuuuaaaaauauagcaccaucugaaauaaguaaaaagauguuccaaaaugaaauaaaugaaaagaaacuaaaacuaaaaauauucaaacaauuaaauuccgcaaacguauuuaacuauuacgaaaaagauguaauaauaaaauaucucaaaaacacuaaauucaacuucgucaauaaaaauauacccuucguacccucuuuuacgaaauuauauaacaaaauagaagaucuuagaaacacacuaaaauuuuucuggucaguaccaaaagauaaagaagaaaaagaugcccaaauauaucuguuaaagaacauuuauuauggagaauuucuaaacaaauucgucaaaaauaguaaagucuucuucaaaauaacuaaugaaguaauaaaaauaaacaaacaaagaaaccagaaaacaggucauuacaaauaccagaaauuugaaaacauugaaaagacagugccaguagaauauuuagcaaucauacaaagccgugaaaugauaaauaaccaagauaaagaagagaaaaacacauauauagacuucauacagcaaauauuucuaaaaggauuuaucgauuaccuuaacaaaaauaauuuaaaauacauagaaucaaacaauaauaacgauaauaaugauauauuuucaaaaauaaaaaucaagaaagauaacaaagaaaaauaugacaaaauucuuaaaaauuacgaaaaacacaaucgcaauaaagaaauaccccaugaaauuaacgaauuuguccgcgagauuaaacuaggaaaaauucuaaaauauacggaaaaucuaaacauguucuaccuaauacucaaacucuuaaaccacaaagaacuuaccaaccuaaaaggcucacucgaaaaauaccaaagugcgaacaaagaagaaacauucagugacgaacuggaauuaauuaaucuacuaaauuuagauaacaauaggguuaccgaagauuuugaacuagaagcaaacgaaaucggaaaauuccuagacuuuaacgaaaacaaaaucaaagauaggaaggaacuaaagaaauuugacaccaauaaaaucuacuucgacggcgaaaacauuauaaaacacagagcuuucuauaacaucaagaaauacgguauguuaaauuuacuugagaaaauagcugauaaagcuaaauauaaaauaucucuaaaggaacuaaaagaauacucaaacaagaaaaaugaaaucgagaaaaauuacacuaugcaacaaaacuugcacaggaaauacgcacgaccgaagaaagacgaaaaauuuaaugaugaagauuacaaagaguaugaaaaggcaaucggaaauauccaaaaauacacccauuugaaaaauaagguagaguucaacgaauugaauuuauuacaaggacuacuucucaaaauacuucauagacucguagguuacacuagcauaugggagcgugaucuacgguuucgccugaaaggagaguucccagaaaaucacuauauagaagaaauauucaacuucgacaauagcaaaaaugucaaguauaaauccggacaaauuguagaaaaauacauuaacuucuauaaagaacucuacaaagacaacguagaaaaacgaaguauauacagcgacaagaaaguaaagaaacuaaaacaggagaaaaaggaucucuacauagcaaauuauaucgcacacuuuaauuauauaccacacgcggaaaucucccugcuagaaguccuugaaaaccuaaggaaacuuuuaucauacgauagaaaguugaaaaaugcuauuaugaaaucaaucgucgacauccuaaaagaauacggcuuuguggcaacuuucaaaauuggagccgacaagaaaauugaaauacaaacacuagaaucagagaaaauaguccaucucaaaaaccuaaagaagaagaaacuuaugacggauagaaauucugaagaacugugcgaauugguaaaagugauguuugaauacaaagcguuagaaggcgggggaggaucaggaggaggaggguccgguggcggaggcucggucaguaaaggagaagaacuauuuacagguguaguccccaucuuaguggaauuagauggugauguaaauggacauaaauucagcguaagcggagaaggagagggugaugcaacauacggcaaauuaacauuaaaauucauauguaccaccgggaaacuaccaguuccauggccgacacuuguaacuacucuaaccuacggaguacaaugcuucagcagauauccagaccauaugaaacaacacgacuucuuuaagucagcaaugcccgagggguauguacaagagcgaacaauauucuuuaaagaugacggaaacuauaagacccgugcagagguaaaguucgagggagacacucuaguaaacagaauagaacugaaggguauagacuucaaggaagacggaaacauccugggacacaaauuagaauauaauuauaauucacacaauguauauaucauggcagacaaacaaaagaacggcauuaaaguaaauuucaaaaucagacacaauauagaggauggaaguguacaauuggcugaccacuaccaacaaaauacgccaauuggagauggaccaguauuacuaccugacaaccacuaccuaagcacucaauccgcuuuaagcaaggauccuaacgaaaagcgcgaccacaugguacuauuagaguucguaacagcagcuggaaucacauuaggaauggaugaauuauacucaagaggagccggagcgggagcuggagcuggagcuggaucuagauuccaaugcagaauaugcaugcgaaauuucucagauagaucaaaucuguccagacauauuagaacacacacaggagaaaaaccauuugcaugcgacauaugcggaagaaaauuugccauauccagcaaccucaacucccacacaaaaauucauaccggaucccaaaaaccauuccaauguagaaucugcaugagaaauuuuagcagaucagacaaucuugcacgacauauacgaacucacacaggggaaaaaccauucgccugugauauuugugguagaaaauuugcgacaucaggaaauuuaacacgacauaccaaaauacacuuaagaggaucacaauuaagcauaguagacgccccagaacaaagagaaggagcaagccaaguaucuguuuccguaacuuucgaagauguagcaguucuauuuacaagagacgaauggaagaaacuagaccuaucccaaagaucacuuuauagagagguaaugcuugaaaauuauaguaacuuagccucuauggcuggaagucccaaaaagaaaagaaaagucuaa

SEQ ID NO: 11508 - RNA, 3549 nt, Artificial Sequence
  Cas13a variant__Leptotrichia wadei__ERK53440.1__Cas13a
auguacaugaaaauaacuaaaaucgacggagucucccacuacaaaaaacaagacaaaggaauacuaaagaaaaaauggaaagaucuugacgaaagaaagcaacgcgagaaaauagaagcaagauauaacaaacaaaucgaaucaaaaauauauaaagaauucuuuagauuaaaaaacaaaaaaagaauagaaaaagaagaagaccaaaauauaaaaagccucuacuucuucauaaaggaauuauacuuaaacgaaaaaaacgaggaaugggagcuaaaaaacauaaacuuagaaaucuuagacgauaaagaaagggucauaaaaggauacaaauucaaggaagacguguacuucuucaaggaaggauacaaagaauauuaccuccguauccuuuuuaacaaucuaauagaaaaaguccagaaugagaacagagaaaaaguacgaaagaacaaagaauuuuuagauuuaaaagaaauauucaaaaaauacaaaaacaggaaaauagaucugcuccucaaaaguauuaacaacaauaagauaaaucuagaauauaaaaaagaaaacguuaaugaagaaaucuaugguauaaaucccacuaacgacagggaaaugaccuuuuacgaauuauuaaaagaaauaauagaaaaaaaagacgaacaaaaaucuauacuagaagagaaacuagauaauuucgauauuacaaacuuccuagaaaacauagaaaaaauauucaacgaagaaacagaaauaaacauaauaaaaggaaaaguacuuaacgagcuacgagaauacaucaaagaaaaagaagaaaauaauucugauaacaaacuaaaacaaauauacaaccuagaacuaaagaaauauaucgaaaacaauuuuaguuauaaaaaacaaaaaagcaaaagcaaaaacggcaaaaacgacuaccuauaccuaaacuuucuaaagaaaauaauguuuauagaagaagucgaugaaaaaaaagaaauaaauaaagaaaaauucaagaacaaaauuaauagcaacuuuaagaaucucuucguacaacacauccuagauuauggaaaauuguuauacuacaaggagaaugacgaauacaucaaaaacaccggacaauuggaaaccaaagaucuggaauacauuaaaacaaaagagacccuaauaagaaaaauggccguucuagucagcuuugcugccaacaguuauuacaaucucuuuggucguguauccggagauauauuaggcacagaaguagucaaauccucgaaaacaaacguaaucaaaguaggaucgcacauuuucaaagaaaaaauguuaaacuacuucuucgauuuugaaaucuucgacgcaaauaagauaguagaaauucuugaaucaauauccuacucaauauacaacguaagaaauggaguaggacacuuuaauaaacuuauacuagguaaauacaaaaagaaagacauaaacacuaacaaacggaucgaagaagacuugaacaacaacgaagaaauaaaaggcuauuucauaaaaaagagaggcgaaauagagagaaaagucaaggaaaaauuucucuccaacaaccuucaauacuacuacaguaaagaaaagaucgaaaacuacuuugaaguauacgaauucgaaauccuaaagagaaaaauaccauucgcaccaaacuucaaaagaauaaucaagaaaggugaagacuuauuuaacaacaaaaauaacaaaaaauacgaauauuucaaaaauuuugacaaaaacucagccgaggaaaaaaaagaauuccucaaaacgagaaauuuccucuuaaaagagcucuacuacaacaacuuuuacaaagaauuucuaaguaaaaaagaagaauucgaaaagauaguacuagaaguaaaagaggaaaaaaaaucuagaggaaauauaaacaauaagaaaucaggagucaguuuccaaagcauagacgacuaugauaccaagauaaacauuuccgacuauauagccucaauccacaaaaaagaaauggaacgaguagaaaaauacaacgaagaaaagcaaaaagacaccgcaaaauacauaagagacuucguugaggaaauauucuuaacaggauuuauaaacuaccucgagaaagauaaacgacuccacuucuuaaaagaggaauucucgauccucugcaacaacaauaauaauguaguagacuuuaacauaaacauaaacgaagaaaaaauaaaagaauuuuuaaaagaaaacgacucaaaaacacuaaaucuuuaccucuuuuuuaacaugaucgauagcaaacgaauaucagaauuccgaaacgagcuaguaaaauacaaacaauucacaaaaaaaagacuagacgaagaaaaagaauuucucggaauaaaaauugaauuauacgaaacccuaaucgaguuuguaauacuaacaagagaaaaacuggacaccaaaaaaucagaagaaauagacgccugguuaguagacaaacuauacguaaaagauucaaacgaauauaaagaauacgaagaaauacuaaaacuuuucguagacgaaaaaauucuaagcaguaaagaagcaccauacuaugcgacagacaacaaaaccccgauccuuuuauccaacuucgaaaaaacaagaaaauauggaacccaaagcuuccuaagugaaauucaaucuaauuacaaauacucaaagguggaaaaagaaaacauagaagauuacaauaaaaaagaagaaaucgaacaaaaaaaaaaauccaacauagaaaaacuacaggaucuaaaaguagaacuacacaaaaaaugggagcaaaacaaaauaacagaaaaggaaauagaaaaauauaauaauacaacacgcaagauaaacgaauacaacuaccucaaaaacaaagaagaacuacagaauguguauuuauuacaugaaauguuaagugacuuauuagccagaaacguagcauucuucaauaagugggaacgagacuucaaauuuauagugaucgccaucaaacaauuccuacgagagaacgauaaagaaaagguaaaugaauuucuaaacccgccagauaauucgaaagggaaaaagguguacuucucggucaguaaauauaaaaauacaguagaaaacauagacggcauacacaagaacuucaugaaccuaauauuuuuaaauaauaaauuuaugaauaggaaaauagacaaaaugaacugcgcuauuuggguauauuuucgaaacuacauagcacauuuucuacaccuacacaccaaaaacgaaaaaauaagucucauaucacaaaugaaccuccuaauaaaguuauucucauaugauaaaaaaguucaaaaccauauacuaaaaucaacaaaaaccuuauuagagaaauacaacauacaaaucaacuucgaaaucucaaaugauaagaaugaagucuucaaauauaaaauuaaaaaccgauuauacaguaaaaaaggaaaaauguuaggaaaaaacaacaaauucgaaaucuuagaaaacgaauuccucgagaauguuaaagcaaugcuagaauacagcgaauaa

SEQ ID NO: 11509 - RNA, 4158 nt, Artificial Sequence
  Cas13a variant__Clostridium aminophilum__WP_031473346.1__Cas13a
augaaauucucaaaaguagaccauacaagguccgcaguaggaauacagaaagccacagauucaguccacgguaugcuuuauacagaucccaagaaacaggaaguaaacgacuuagauaaaagauuugaccaacuaaauguaaaagcaaaacgauuauacaacguauuuaaccaaucaaaagcagaagaagaugacgaugagaaaagauuuggaaaaguuguaaagaaacuaaacagggaauuaaaagaccuauuauuccaucgcgaaguuagccgauauaauucaauaggaaaugccaaauauaacuacuauggaaucaaaucgaauccugaagaaauaguaucaaaucuaggaaugguagaaucgcucaaaggagaacgagacccacaaaaaguaauaucuaaacuauuacuuuauuacuuaaggaaaggccuaaaacccggaacagacggucuccgcaugauacuagaagcaaguugcggauuaagaaaacuauccggcgaugaaaaagaacuaaaaguauucuuacaaacacuagacgaagauuucgaaaagaaaacauucaagaaaaaucuaauaaggaguaucgaaaaucaaaacauggcaguccaaccaagcaaugaaggagacccaauaauaggaauaacacaaggacgcuucaacagucagaaaaaugaagagaaaagcgcaauugaaaggaugaugagcauguacgcagauuuaaaugaagaccaccgagaagacguucuacggaaacuuagacguuuaaacguacuauacuuuaauguugauacagagaaaacagaggaaccaacauuaccaggagaaguagacaccaauccuguauucgaagucuggcaugaucacgaaaaaggaaaagaaaaugauagacaauucgccacuuucgcuaaaaucuuaacugaagacagagaaacaagaaagaaagaaaaacuagcagugaaagaagcacuuaacgaccuaaaaucugcaauucgagaccauaauauaauggcauacagaugcucuauuaaaguaacagaacaagauaaagacggucuuuucuuugaagaccaaagaaucaauagguuuuggauacaucacauagaaagugcaguagaacgaauauuggcaaguaucaauccagaaaaauuauauaaacuacgaaucggauauuuaggagaaaaaguauggaaagaucuucuaaauuaucuauccauuaaauauauagccguagggaaagcaguauuucacuucgccauggaagaucuagguaaaaccggacaagauauagaacuagguaaacuaucaaauuccguaagugguggauuaacaucauucgauuaugaacaaauuagagcagacgaaacauuacagagacaacuuagcguagaaguagcauucgcagcaaauaauuuguuucgggcaguaguaggucaaacagggaagaaaauugaacaguccaaaucugaagaaaacgaagaagacuuucuucucuggaaagcugagaaaauagccgaaaguaucaagaaagaaggcgaagguaauacacugaaaucaauuuugcaauucuuuggaggcgccucauccugggaccuaaaucauuucugcgccgcauauggaaaugaaaguucggcuuuagguuaugaaacgaaauuugccgaugacuuacguaaagcuauauacagccuuagaaaugaaacuuuucacuucacaacccuaaauaaaggaaguuuugauuggaaugcaaaacuaaucggagacauguuuucccaugaagcagcuacuggaauagcaguagaacgaacuagauuuuacucaaauaauuuaccaauguucuacagagaaagugaucucaagaggaucauggaucaucuauauaauacauaccacccaagagccucucaagugccuagcuuuaacagcguauucguacgcaaaaacuuucgccuauuucucucgaauacacuaaacaccaacacuagcuuugauacagagguuuaucaaaaaugggaaagcgguguuuauuaccuguucaaagaaauauauuauaacucauuuuuaccaagcggagaugcgcaucaucuuuucuuugaaggauuaagaagaauaagaaaagaagcugacaauuuaccaaucguagguaaagaggcaaagaaaagaaaugcaguucaagacuucggccgaagaugugaugaacugaaaaaucuuucccuaucggcaaucugucaaaugauaaugacggaauacaacgagcagaacaauggaaacagaaaaguaaaaucuacaagagaagacaaacgaaaaccagauauauuccagcauuauaaaaugcuauuauuaagaacucuacaagaagcauucgcuauauacauaagacgagaagaguucaaauucauauuugaucugccaaaaaccuuauaugucaugaaaccaguugaagaguucuuaccuaauuggaaaucagguauguuugacucccucguggaaagaguaaagcaaaguccugaucuacaaagaugguauguccuuugcaaauuucuuaacggacgauuauugaaccaacucucaggaguaauaagaucauauauacaauucgccggcgacauacaacgacgugcaaaagcaaaccacaaccgacuauauauggauaauacgcaaagaguugaauacuauagcaacguacuagaagucguagauuucuguauuaaaggaacuucuagguucucaaacguauuuagcgacuacuucagagaugaagacgcauaugcagacuaucuagacaacuacuuacaauuuaaagacgagaaaauagcggaaguaaguucguuugcagcacugaaaacauucugcaacgaagaagaaguaaaagccggcauuuauauggacggugaaaacccaguaaugcaaagaaauauuguaauggcaaaacuuuucgggcccgaugaagugcuuaaaaacgucguaccaaaaguaacuagagaagaaauagaagaauauuaucaacucgaaaaacaaauagcaccauauagacaaaauggguacuguaaaagugaagaagaucagaagaaacuacuuagauuccaacgcauuaaaaacagaguagaguuccagacgauaacagaguucagcgaaauaauaaaugaauuacuuggacaacuaauuaguuggagcuuccugcgagaacgagaccuacuauacuuccaacuaggcuuccauuaccuuugucuacauaaugacacagaaaaaccugcagaauacaaagaaauaucacgcgaagauggaacagucauucgaaacgcaauauugcaucagguagccgcaauguauguugggggauugccaguguauacgcucgccgauaagaaauuagcggcauuugaaaaaggagaagcagauuguaaacuuucaauuaguaaagauacugcuggugcagguaagaaaauaaaagacuucuuucgauauucaaaauacguacucauaaaagaucgaaugcuaaccgaucaaaaucagaaauacacuauauauuuagcuggauuagaauuauuugaaaacacagacgaacacgauaacauaacagauguaagaaaauauguagaucacuuuaaguacuaugcaacuagcgaugaaaaugcaauguccauacuagauuuauauucagaaauacacgaccgauucuucacauacgauaugaaauaucaaaagaacguagcaaauauguuagaaaauauccugcucagacauuucguuuuaauacgacccgaguucuuuacugguagcaagaaaguaggcgaaggaaagaaaauaacuuguaaagcaagagcacaaauagaaaucgccgaaaacggaaugagaagcgaagacuuuaccuauaaacucucugaugguaaaaagaauauuucgaccugcaugauagcggcaagagaccagaaauaccuaaauacaguagcgcgacuauuauacuauccacacgaagcuaagaaaucuaucgucgauacuagagagaagaaaaacaauaagaaaaccaacagaggagauggaacauucaacaaacaaaaagggacggcaaggaaagaaaaagauaacggaccacgagaauuuaacgauacuggcuucaguaacacgccauucgcaggauucgacccguuuagaaauaguuga

SEQ ID NO: 11510 - RNA, 4035 nt, Artificial Sequence
  Cas13a variant__Eubacterium rectale__CVRQ01000008.1__Cas13a
augcucaggagggacaaggaaguaaagaaacuuuacaacguguuuaaccaaauccagguaggaacuaaacccaaaaaguggaacaacgaugagaaacuaucuccagaagaaaaugagcgcagagcgcaacagaaaaacauuaaaaugaaaaauuauaaauggagagaagcauguaguaaauauguugaaucaagucaaaggaucauaaacgauguuauauuuuacucguauagaaaagccaaaaacaaacuacgauacaugaggaaaaaugaagauauucuuaaaaagaugcaagaagcagaaaaacucagcaaauucuccggaggaaaacuggaggacuuuguagcauacacauuaagaaagagcuugguagugucuaaauaugauacacaggaauuugacucacuagcugccaugguugucuuuuuagaguguauaggcaaaaacaacauaucugaccacgaaagagaaauaguuuguaaacuacuagagcuaauaaggaaagacuucucuaaauuagacccuaaugugaaaggaagccaaggagcaaauaucguucgaaguguaagaaaucaaaacaugauagugcaaccucaaggagauagguuccuauucccacaaguauacgcaaaagaaaacgaaacagugacuaacaagaauguugaaaaggaagguuuaaacgaauuucuacugaauuacgcaaauuuagaugaugaaaagcgugccgaaucucuaagaaaauuaagaagaauacuagacguauauuuuucagcaccuaaccacuaugaaaaagauauggacauaacauuaagugauaauauagaaaaagaaaaauuuaauguuugggaaaaacaugaaugcggaaagaaagaaacgggacuauucguugauaucccagacguacuuauggaagcagaggcagaaaauauaaaacuugaugccgucgucgagaaaagagaaaggaaaguauuaaacgaccguguaagaaaacaaaacauaauuuguuacagauacacacgagcaguaguagaaaaauacaacagcaaugaaccacuguucuucgaaaauaacgcaauaaaucaauauuggauacaccauauagaaaaugcaguagagagaaucuugaaaaauuguaaagcaggaaaauuauucaaauuacggaaaggauacuuagcagaaaaaguauggaaagacgccauaaaccuaauaucaauaaaauacauagcacuugguaaagccguauacaacuuugccuuagacgacauauggaaagauaagaaaaacaaagaacucggcauaguagacgaaagaauacguaacgguaucacgaguuuugauuaugaaaugaucaaagcccacgaaaaccuacaaagagaacuagcaguagacauagcauuuucaguaaauaaccuagcgagagcugucugcgacauguccaaucuagguaauaaagaaagcgacuuccuauuauggaaaagaaacgauauugcagacaaacuuaaaaacaaagacgacauggcaucuguaucugcuguacuucaauucuucgguggaaaaaguucuugggacauaaacauauucaaagaugcauauaaaggcaaaaagaaauacaacuacgaaguucgauucauagacgaccuaaggaaagcgauauacugugcaaggaacgaaaacuuucauuucaaaacagcccuagugaacgacgaaaaauggaauacggaauuauuugggaaaaucuuugaaagagaaacagaauuuugucuaaacguagaaaaagacagauucuauucaaacaaccuauauauguuuuaccaagucagcgaacugagaaauauguuggaccacuuauacagcagaucaguaagccgagcagcacagguaccaucauacaauagcguaauaguuaggacagcauucccugaauacauuacuaacguauugggcuaucaaaaaccaaguuacgaugcagauacacuuggaaaaugguacagugcuuguuauuaccuccuaaaagaaauauauuacaacuccuuccuacaaucagaucgcgcuuuacaacuuuucgagaaaagcguuaaaacccuaucaugggacgacaagaaacaacaaagggcaguagauaacuucaaagaccauuuuucagauauuaaaucugcguguacaucauuagcacaaguaugccaaauuuacaugaccgaauauaaccaacaaaauaaucagauaaagaaaguucgguccucaaaugauucaauauuugaccaacccguguaccaacacuauaaaguucuacuaaagaaagcaauagcaaacgcuuuugcagacuaccucaaaaacaacaaagauuuauuuggauucauaggaaaacccuucaaagcgaacgaaauaagagaaauagauaaagaacaauuccuaccugauuggacgagcaggaaauacgaagcccugugcauugaaguaucaggaucacaagaauuacaaaaaugguauauugucggaaaauuucuaaacgcucgcucauuaaaucucaugguggguucaaugcggucguauauucaguauguaacagacauaaaacgccgagccgcaucaauuggcaacgaacuccacgucaguguacacgacguugaaaaagucgaaaaauggguccaaguaaucgaaguauguagucuuuuagcgucgaggacuuccaaucaguucgaagacuauuuuaacgauaaagacgacuacgcacgcuaccuaaaauccuauguugacuucagcaacguggacaugccaucggaguauuccgcacucguugauuuuuccaacgaagaacaaagcgauuuauauguagaccccaaaaacccaaaaguuaacagaaauaucguccauagcaaauuauuugcggcagaccacauacuucgagacauaguagaacccguaucuaaagacaauaucgaagaauuuuauagccaaaaagcagaaauagcauauugcaaaauaaaaggcaaagaaauaacugccgaggaacaaaaagcaguauuaaaauaucaaaaauugaaaaauagagucgaauuaagagauauuguugaauacggagagauaauaaacgaacuacucgggcaacuaauaaacuggagcuuuaugagagaacgagaucuacuauacuuccaauuaggauuucacuaugacugucugagaaacgauucuaagaaaccagaagguuauaaaaacauaaaagucgacgaaaacucaaucaaagaugccauacuauaucaaauaauuggaauguacguuaacggugugacaguauaugcaccagaaaaagauggagacaaauuaaaggaacaauguguaaaaggagguguaggagucaaaguuucagcauuccauagauacagcaaauauuuaggacuuaacgagaaaacauuauauaacgcgggccucgaaauuuucgaaguaguagcagaacacgaagacauaauuaauuuacgaaacggaauagaucauuucaaauauuaucuaggugacuauagaagcaugcuaucuauauauucagaagucuucgacagauuuuucacauaugauauaaaauaccagaagaacguguuaaaucuauuacaaaauaucuuguuaagacauaacguuaucguagaacccauauuagaaucagguuuuaaaacaaucggagaacaaacaaaaccaggugccaaacucucaauacgauccaucaagucagauaccuuucaauauaaaguaaaaggugguacauugauuacagaugcuaaagaugaaagauaccucgaaaccaucagaaaaaucuuauacuacgcagaaaaugaagaagauaaccucaaaaagucaguaguaguaacuaacgccgauaaauacgagaaaaauaaagaaucugacgaccaaaacaaacagaaagaaaagaaaaacaaagauaauaaaggaaagaaaaacgaagaaacaaaaucugacgccgaaaagaacaacaacgaacguuuaucauacaauccauuugcaaacuuaaauuuuaagcuaaguaacuga

SEQ ID NO: 11511 - RNA, 3858 nt, Artificial Sequence
  Cas13a variant__Herbinix hemicellulosilytica__CRZ35554.1__Cas13a
augaaauuaacaagaagaagaauaucaggaaauucaguagaucaaaaaaucacugcagccuuuuauagagacaugucacaaggccuauuguacuacgacagcgaagauaacgacuguacagacaaggugaucgaaagcauggauuucgaaagaagcuggcgcggcagaauucuaaaaaauggcgaagaugacaaaaauccuuuuuacauguucguaaagggacuagucgguuccaacgacaaaauuguaugcgagcccauugacguggacucggauccagacaaucucgacauauuaauuaacaaaaaccucacaggauucgggcguaaucucaaagcaccagauuccaacgauacgcuagaaaacuuaauacgaaaaauacaagcaggaauaccugaagaggaaguuuugcccgaacuuaaaaaaauaaaagaaaugauccaaaaagacauaguaaauagaaaagaacaacuccucaaaaguaucaaaaauaaucgcauaccuuuuucauuagaagguucaaaauugguccccucaacaaaaaaaaugaaauggcuauucaaacuuauagauguaccgaacaaaacguuuaaugaaaaaauguuagaaaaauauugggagaucuacgauuacgauaaauugaaagcaaacaucacaaacagauuggacaaaacagauaaaaaagcacgaaguauaucaagagcaguauccgaagagcuaagagaauaccauaaaaaccuaaggaccaacuauaaucgauucguaucuggagauagacccgcugccggacuagauaacgggggauccgcaaaauauaaccccgacaaagaagaauuuuuacucuuucuaaaagaaguagaacaguacuucaaaaaauacuuuccaguaaaaucgaagcauucaaauaagucaaaagacaagagcuuaguggauaaauauaaaaacuauuguucauacaaagucgugaagaaggaaguaaauaggucaaucauuaaccaacugguagcaggucugauacaacaaggcaaacuacucuacuacuucuacuacaaugacaccuggcaagaagauuucuuaaacagcuauggccucucauauauacaaguagaagaagcauuuaaaaagagcguaaugacaagccuauccuggggcauaaacagguuaacauccuucuuuauagacgauucaaacacagucaaauucgacgauauaaccacgaaaaaggcaaaagaagcaauagaaagcaacuauuucaacaaacuaagaaccugcaguagaaugcaagaccacuuuaaagaaaaacuagcguucuuuuacccuguuuacguaaaagacaaaaaagaccgaccagacgacgacauagaaaaccuuauaguauuagugaaaaaugcaauagaguccguaucauacuugagaaauaggacauuccacuucaaagagucaagcuuacucgaacuacuaaaagaacuagacgauaaaaacucaggucaaaacaaaauagauuauagcgucgcagcagaauuuauaaaaagagacauagagaaccuauacgaugucuucagagaacagauacgaagcuuagguauugcagaauacuacaaagccgacaugaucucagacugcuucaaaaccugcggucuagaauucgcuuuauauucacccaaaaacuccuuaaugcccgcauucaaaaaugucuacaaacggggagcaaacuugaauaaggcauauauccgagauaaaggaccaaaagaaacuggugaccaaggccaaaacucauauaaagcacuugaggaauaccgagaacuaacaugguauauugagguaaagaauaaugaccaaucuuauaaugcauauaaaaaccuacuacaacuuauauacuaccacgcauucuuaccagagguucgagaaaacgaagcacucauaaccgacuucauaaaucgaaccaaagaauggaauagaaaggaaacagaagaaagacuuaacacaaagaauaacaaaaaacauaaaaauuuugacgaaaacgaugauauaacagucaacacguaccgauacgagagcauacccgacuaucagggugaaagccucgacgacuaucucaaaguauuacaacgcaaacaaauggcacgggcaaaagaaguaaaugaaaaagaagaaggcaauaacaauuauauccaauuuauuagagacgucgucguaugggcuuucggagcguaccuggaaaacaaauuaaaaaauuauaaaaacgaacugcaacccccacucagcaaagaaaauauaggacucaaugauacacuaaaagaauuauuccccgaagaaaaaguaaaaucaccauucaacaucaaaugucgcuuuucaauuaguacauuuauagacaacaaaggcaaaaguacagacaacacauccgccgaagcaguaaaaacugaugguaaagaagacgaaaaagacaaaaaaaacauaaaaaggaaggaucuacucugcuucuacuuauuucuaagacugcuugaugaaaaugaaaucugcaaauuacagcaccaauucauuaaauacaggugcagccucaaggaaagaagauuuccaggaaauagaaccaaacuagaaaaagaaacugaguuacuugcagaacuagaagaauuaauggaacuaguacgcuucaccaugccaucaauuccugaaauuagcgcaaaagccgaaucaggauacgauacaaugauaaaaaaauacuuuaaagacuucauagaaaaaaaaguauucaaaaacccaaaaacuagcaaucucuacuaucauucagauagcaaaaccccagucacaagaaaauauauggcauuauuaaugcgcucugcaccauuacaucuauacaaagacauauuuaaaggcuacuaccuaauaacaaaaaaagaaugucuggaauauauaaaacuaaguaacauaauaaaagacuaccaaaacucacuaaacgaacuacacgaacaauuagaacgaauuaaacuaaaaagcgaaaagcaaaauggcaaggauaguuuauauuuagacaaaaaagacuuuuauaaaguuaaagaauacguagaaaaucuugagcaaguagcgcgguacaaacaucuacaacauaaaauaaauuucgaaucucuauacagaauauucagaauacacguagauauagcggcacgaaugguaggauauacucaggauugggaaagagauaugcacuuccuauucaaagcacuaguuuacaauggaguacuagaagaacgaagauuugaggcaauauuuaauaauaacgaugacaauaacgauggcagaauaguaaaaaaaauacaaaacaacuuaaacaacaaaaaucgagaacucguaagcaugcucugcuggaacaaaaaauuaaauaaaaacgaauucggagcaauaauauggaaaagaaauccaauagcacaccugaaucacuucacacaaaccgaacaaaacaguaaaucaagucuagaaucucuaauaaacagcuuacgaaucuuacuagcauaugacagaaaaagacaaaaugcuguaacaaagacuauaaacgauuuacuauuaaaugauuaccacauccgaauaaaaugggaaggacguguagacgaaggccaaauuuacuuuaacauuaaagaaaaagaagauauugagaaugaacccaucauucauuuaaagcaccuccauaaaaaagacugcuacauauauaaaaacaguuauauguuugacaaacaaaaagaauggauauguaacggcauaaaagaagaagucuacgacaaaagcauacuaaaguguauuggcaacuuauuuaaauucgacuacgaagacaaaaacaaaucaagcgcaaauccaaaacacacauaa

SEQ ID NO: 11512 - RNA, 4314 nt, Artificial Sequence
  Cas13a variant__Lachnospiraceae bacterium__WP_022785443.1__Cas13a
augaaaauaucaaaaguacgagaagaaaauagaggugcaaaacuuacaguaaaugcaaaaaccgcaguagucagugaaaacagaucacaagaaggaauauuauacaaugauccgagucguuacggaaaaucacgcaagaacgaugaagacagagacagauacauagaaucaagacuaaaaucaaguggaaaauuauauaggauauuuaaugaagacaaaaacaaaagagaaacagaugaacuucaaugguuucuuucagaaauuguaaaaaaaauaaaucgaagaaaugguuugguacucuccgacaugcuaucugucgaugaucgagcuuucgaaaaagcguuugaaaaauaugcggaauugucauacacaaauaggcgaaacaaaguaaguggaagcccagcauucgaaacaugcggcguugaugcugcaaccgcagagagacuaaaaggaauuauaucggaaaccaauuucauaaaucgaauaaaaaauaauauagacaacaaaguaucagaagacauaauagauagaauaauugcuaaauaccugaaaaaaucuuuaugcagagaaagagucaaacgaggacuaaagaaacuauugaugaaugccuucgaucucccauacuccgauccagauaucgacgugcaaagagacuucauagacuauguacuugaagacuucuaccacgucagagccaaaucucagguaucucgcucaauaaaaaauaugaauaugcccguccaaccagagggugacggcaaguucgcaauaacaguaagcaaaggaggaacugaaaguggaaauaaaagaagcgcagaaaaagaagcauuuaaaaaauuccuaucagacuacgcaucucuagacgaaagaguacgagacgacaugcuccgaaggaugaggagacuaguaguuuuauacuucuacggaucagacgacucaaaacuaucagacguaaaugagaaguucgacguaugggaagaccacgcagcacgaagaguugacaacagagaauucauuaaauuaccacuugaaaacaaauuagccaacggaaagaccgauaaagacgcggaacgaauaaggaaaaacacagucaaagaacuuuauagaaaucaaaacauaggaugcuauagacaagcuguaaaagcuguagaagaagacaacaauggaagguacuuugacgacaaaaugcuaaauauguuuuucauacauaggauagaguacgguguugaaaaaaucuacgcaaacuuaaaacaagugacugaauuuaaagcaaggacagguuaccugucagaaaagauauggaaagaccuaauuaacuacauauccauuaaauauauagccauggguaaagccguauacaacuaugccauggacgaauuaaaugcaucggacaaaaaagaaaucgaacugggcaaaauuucggaagaauaccuaucaggcauaagcucauuugacuaugaacuaauaaaagcagaagaaaugcuucaaagagaaacugcagucuauguagcuuucgcugcaagacaccuaaguucacaaaccguagaauuagacucugaaaauagugacuuucuacuauuaaaaccgaaagguacuauggauaaaaaugauaagaacaaauuggcauccaauaacauauuaaacuucuuaaaagauaaagaaacucuaagagauacuauccugcaauacuuugguggucacucgcuauggaccgacuucccguuugauaaauaccuggcuggcggaaaagacgaugucgacuuucucacagauuugaaagaugucaucuacaguaugagaaacgauucauuccacuaugcaacagaaaaccauaacaauggcaaauggaacaaagaauuaauaagugcaauguucgaacacgaaacggaacggaugacugugguaaugaaagacaaauucuacucaaacaaucuaccgauguucuauaaaaaugacgaccuaaaaaaauuacuuauagaccuauauaaagauaauguugaacgugcaucucaggugcccuccuucaauaaaguauuuguaagaaaaaacuucccugcacugguaagggauaaagauaaccuaggaaucgaauuagaccuuaaagcugacgcagacaaaggagaaaacgaguuaaaguuuuauaaugcuuuauacuacauguuuaaagaaauuuacuacaaugcuuuucuaaaugauaaaaacguaagagagagauucauaaccaaagcaacaaaaguggcagacaauuaugacagaaacaaagaaagaaaccuuaaagacagaauaaaaucggcagguagcgacgaaaaaaaaaaacuuagagaacaauuacagaacuauauagcugaaaacgacuuuggacaaagaauaaaaaacauaguucaaguaaauccagacuacacauuagcccaaauuugucagcuaauaaugacggaauacaaccaacaaaacaauggaugcaugcaaaaaaaauccgcagcacgcaaagauauaaacaaagacucauaccaacauuauaaaaugcuauuacuugucaaucuucguaaagcauucuuagaguuuauaaaagagaauuacgccuucgucuuaaaaccguacaaacacgaccuaugcgauaaagcagauuucgucccugacuuugcaaaauacguaaaacccuaugcaggacuaauauccagaguagcaggaagcagugaacuccaaaaaugguauauaguaucacgcuucuuaucaccagcacaagcaaaccauauguuaggauuucuacauagcuauaaacaauauguaugggauauauacagaagagccagugaaacuggaacagaaauaaaccauagcauugccgaagacaaaaucgcaggcgucgauaucacagacguugaugcaguaauagacuuaucagugaaacuguguggaaccaucuccuccgaaauuuccgacuauuucaaagacgacgagguauacgccgaauacauaucuuccuaucuugauuuugaguaugauggaggaaacuacaaagauagccuuaacagguucugcaacagugacgcuguaaaugaucaaaaaguagccuuauacuaugacggcgaacaucccaaauuaaacagaaauauaauacuuucuaaauuauauggcgaaagaagguuccuagaaaaaauuaccgaccgcguaagucgaucugacauaguagaauacuacaaauuaaaaaaggaaacaagccaauaucaaacuaaaggaauauucgacucagaagaugaacaaaaaaacauaaaaaaauuccaagaaaugaaaaauaucguugaauuuagggaccuaauggacuauucagaaauagcagaugaauugcaagggcaauugaucaacuggaucuaucuaagagaaagagaccuaaugaauuuucaacuuggauaccauuacgcaugucuaaacaacgauagcaauaaacaagcuacauauguaacacuagacuaucaagguaaaaagaacaggaaaauuaauggggcaaucuuauaccaaauuugugcaauguauaucaacgggcuuccauuauauuacguagacaaagacuccucagaauggaccgugucggaugguaaggaaucgacaggagccaaaauaggugaauucuacagauaugcaaaaucauucgagaauacaucugacugcuacgcaaguggauuagaaaucuuugaaaauaucucagaacaugacaauauaacagagcuaagaaacuauauagaacacuucagauauuacagcaguuuugacagaucauuccugggaaucuacucagaaguuuucgaucgauucuuuaccuaugaucuaaaauauagaaaaaauguaccaacaauauuauacaauauauuacugcaacacuuuguuaacgucagauuugaauucgucucagguaagaaaaugaucggcaucgacaaaaaggaucgaaaaauagcaaaagaaaaagagugcgcaaggauaacuaucagggaaaaaaacggaguauacagugaacaguucacauauaaacuaaagaacggaacaguguauguagacgcaagagacaaacgcuaccuacaaagcauaauucgauugcucuucuauccagaaaaaguaaauauggaugaaaugauagaaguaaaagaaaaaaaaaaaccaagcgacaacaacaccgggaaaggauauucuaaaagagauaggcagcaagaccgaaaagaguaugauaaauauaaagagaaaaagaaaaaagaaggaaacuuccuaaguggaaugggcgggaauauaaacugggaugagauuaacgcacaauuaaaaaauuaa

SEQ ID NO: 11513 - RNA, 3156 nt, Artificial Sequence
  Cas13a variant__Listeria newyorkensis__WP_036091002.1__Cas13a
augaaaaucaccaaaaugagaguugacgggaggacuaucguuauggaaagaacauccaaggaaggacaauugggauaugaaggaauagacgguaacaaaaccacagaaaucaucuucgacaaaaaaaaagaaagcuuuuacaaaucaauucuaaacaaaacaguaagaaaaccagacgaaaaagaaaaaaacagaaggaagcaagcaauaaauaaagccauaaauaaggaaauaaccgaauuaaugcucgcaguauugcaucaggaaguaccaucacaaaaacuacacaaucuaaaaucauuaaacacagaaucauuaaccaaauuauucaagccaaaauuccaaaacaugauauccuauccaccgucaaaaggagcagaacauguacaauucugcuuaacagacauugcaguacccgccaucagagaccuagacgaaaucaaaccagacuggggaauauuuuucgaaaaacuaaaaccauauacugacugggcagaaucauacauacacuacaaacaaacgacaauucaaaaaucaauagaacaaaauaaaauacaaaguccagacagcccuagaaaauuaguacuacaaaaauacguaacagcauuccucaauggggaaccccuaggcuuagaccugguagcuaaaaaauauaaacucgcagaccuugcagagagcuucaaacucguagaucuuaacgaagauaagucagccaacuacaaaauaaaagcaugucuacaacaacaccaacguaacauacucgaugaauugaaagaagacccugaguuaaaucaguauggcauagaaguaaaaaaauauauacaaagauacuuccccaucaaacgagcaccuaaucgaucaaaacacgcaagagcagauuuucucaaaaaagaauuaauugagagcacgguugaacaacaauuuaaaaacgcagucuaccacuacgucuuagaacaagguaaaauggaagcauaugaauuaaccgaccccaaaacgaaagaucuucaagacauaagaucuggagaagcauucaguuuuaaauuuauaaacgcaugcgccuucgcaucuaauaacuuaaaaaugauacuaaacccagaaugugagaaagauauauuagguaaaggcaacuuuaaaaaaaaucuaccgaacuccacaacuagaucagauguaguaaagaaaaugaucccauucuuuucggacgaacuccaaaaugucaacuucgacgaggccauuugggcaauacgugguaguauucaacaaauaagaaaugaagucuaccacuguaaaaaacacagcuggaaaagcauccucaaaauaaaaggauuugaguuugaaccaaacaacaugaaauaugcagacucagacaugcaaaaacuaauggacaaagauauagcaaaaauaccggaauucauugaagaaaaacuaaaaucuucugggguaguacgauucuaccgucacgacgagcuacaaucaauuugggaaaugaaacaaggauucuccuuacuaacaacaaacgccccauuuguacccuccuuuaaaagaguauaugcaaaaggccacgauuaucaaacaucaaaaaaccgauacuauaaucuugaccugacgaccuuugauauacuagaauauggcgaggaagauuuccgggcacgguacuuuuuaacaaaacuaguauauuaucaacaauucaugccaugguucaccgcugacaacaaugcauuuagagacgccgcaaacuucguucuaagacucaacaaaaaucgacaacaagaugcaaaagcauucauaaauauaagagaggucgaagaaggcgaaaugccaagagauuacaugggauacguccaaggacaaauugcaauucaugaagacagcauagaggacacuccuaaucacuucgaaaaauuuauaucacaaguauucauaaaagguuucgauagacacaugaggucagcaaacuuaaaauucauaaaaaaccccagaaaucagggacuagaacaaagugaaauagaagaaaugaguuucgacauaaaaguagaaccaucguuucuaaaaaauaaagaugacuauauagcguucuggauauucuguaaaaugcucgacgcaagacacuugagcgaauuaagaaacgaaaugauaaaauaugacggucaccucacaggcgaacaagaaauaauaggacuggcacuacugggaguggacaguagagaaaaugacuggaaacaauuuuuuucaagcgaaagggaauaugaaaaaaucaugaaaggcuacguaguagaagaacuauaucaaagagaaccauacagacaaagcgauggaaaaaccccaauuuuauucagaggaguagaacaagcacgaaaauacgggacagaaacagugauccagagauuauucgacgcaaacccagaguuuaaaguaaguaaauguaaccuagcugagugggaacgacaaaaagaaacaaucgaagaaacuauaaagagacgaaaggaacuacauaacgaaugggcuaaaaauccaaaaaaaccacaaaauaacgcauuuuucaaggaauauaaagaaugcugugacgcaaucgaugcauauaauuggcacaaaaauaaaacaacauuagccuauguaaacgaacuacaccaucuauuaauagaaauucuagguagguauguaggauacguugcaauagccgaccgugauuuccaaugcauggcgaaccaauauuucaagcauuccggaauaacggaaagaguagaauacuggggagacaaccgucuaaaaucuauaaaaaaauuagauacauuucucaaaaaagaaggacuauuuguaucagaaaaaaaugcaagaaaccauaucgcacaucuaaauuacuuaagccuaaaaucagaaugcacguuauuauaucucucagaaaggcuaagagaaauauucaaauacgaucgaaaacuuaaaaaugcuguaucaaaaucccucauagacauacuagauagacacggaaugagcguaguuuucgcaaaccugaaagaaaauaagcacagacuaguuaucaaaucccuagaaccaaaaaaauuacgacauuuaggaggaaaaaaaaucgauggaggguacauagaaacaaaccagguaagugaagaauacugcggcauaguuaaaagauuacuagaaauguaa

SEQ ID NO: 11514 - RNA, 3363 nt, Artificial Sequence
  Cas13a variant__Listeria seeligeri__WP_012985477.1__Cas13a
auguggauaagcauaaaaacucucauacaucaucugggaguauuauucuuuugugacuacauguauaauagaagagaaaaaaaaauuauagaaguaaaaacaaugagaauuacaaaaguagaagucgacagaaaaaaaguacuaaucucacgagauaaaaacgguggaaaacuuguauacgaaaaugagaugcaggacaauacagagcaaauaaugcaucauaaaaaaucaucauuuuacaaaucugugguaaacaaaacaauaugucgacccgagcaaaaacaaaugaaaaaacuaguccauggauugcuacaagaaaauucacaagaaaagauaaagguaucagacguaacaaaauuaaacaucaguaacuuccuuaaccacagguucaaaaaaucucucuacuauuuucccgaaaacucaccagacaaaucagaggaauaucguaucgaaauuaaucucucacaauuacuagaagacucacugaaaaaacaacaaggcacauuuaucugcugggagagcuucucaaaagacauggagcuauauauaaacugggcagaaaauuauauaucaaguaaaacaaaacuaaucaaaaaaagcauacgaaauaauagaauacaauccacagaaagccgaucuggacaacucauggacagguacaugaaagacauacuaaacaaaaacaaaccauucgauauucaaucagucucagaaaaauaucaacuagaaaaauuaacaucugcacuuaaagcaacauucaaagaagcaaaaaaaaacgauaaagaaauaaacuacaaacuaaaauccacguuacaaaaucacgaacgacaaauuauagaagaacucaaagaaaauuccgaacuaaaccaauuuaacauagaaauaagaaaacaucuugaaacuuacuuuccuauaaaaaaaacuaaucguaaaguaggagacauaagaaauuuagaaauuggcgaaauacaaaaaaucgucaaucaccgacuaaaaaauaaaaucguacaacgaauacuacaagaaggaaaauuagcuucauaugaaauagaaaguacgguuaacaguaauucguuacaaaaaaucaaaauagaagaggcuuucgcgcuaaaauuuaucaacgcaugccuauuugcauccaauaacuuaagaaauauggucuacccagucuguaaaaaagacauauuaaugauuggagaauuuaaaaacaguuucaaagaaaucaaacacaaaaaauuuaucagacaauggagccaauucuucagccaagaaauaacaguagacgauauagagcuugcaaguuggggcuuaaggggugcaauagcaccuauucgcaaugaaaucauacaucugaagaaacauucauggaaaaaauuuuuuaacaacccaacauuuaaagucaaaaaaagcaaaauuaucaacggaaaaacuaaggacguaacaagugaauucuuauauaaagaaacacuauucaaagauuauuucuacucagaacuagacucuguaccagaacuaaucauaaauaaaauggagucaaguaaaauucuugacuacuauaguucagaccaacuaaaccaaguuuucacaaucccaaacuucgagcuuagccuucuaacauccgcaguaccauuugcccccucauucaagagagucuaucuaaaaggauucgauuaccaaaaccaagacgaagcccaacccgauuauaacuugaaacuaaacauuuauaacgaaaaagcauucaauucagaagcauuccaagcccaauacuccuuauuuaaaaugguuuacuaccaaguauucuuaccccaauucaccaccaacaaugacuuauucaaaucaucaguagauuuuauuuuaacacuuaacaaagaaagaaaagguuaugcaaaagcauuucaagacauaagaaaaaugaacaaagacgaaaaaccguccgaauauaugucuuacauacagucacaacuaaugcuauaccaaaaaaagcaagaagagaaagaaaaaauuaaucacuucgaaaaauucauaaaucaaguuuucaucaaagguuucaacagcuucauagaaaaaaacagacucacguauauaugucacccuacaaaaaauacuguuccagaaaacgacaauauagagauaccauuucacacagauauggacgauucgaauauugcauuuugguuaauguguaaacuuuuagacgcaaaacaacuaucugaacugcgaaaugaaaugauuaaauucuccuguagcuuacaaucuaccgaagaaaucuccaccuuuacaaaagcucgagaaguaauaggacucgcgcuauuaaacggugaaaaaggaugcaaugauuggaaagaacucuucgaugacaaagaagcauggaaaaaaaauaugucacuauacguauccgaagaacucuuacaaaguuuaccguacacacaagaagacggacaaacgccaguaauaaaccgauccauagaucuaguuaaaaaauacggcacagaaaccaucuuagaaaaauuauucucaucaucagacgacuacaagguaucagcuaaggauaucgcaaaauuacacgaauaugauguaacagaaaaaauagcccagcaggaaucauuacauaaacaauggauagaaaaacccggccuagcaagggacucagcauggacaaagaaauaccaaaauguaauaaacgauauaucaaacuaccaaugggcaaaaaccaaaguagaacucacccaagugagacaccuacaucaacuaacuauagaccuacuuucuagacuugcuggcuacaugagcauugcagaccgcgauuuucaguuuuccuccaauuauauacucgaaagagaaaauucagaauaccguguaacaaguuggauccuccuaucugaaaacaagaauaaaaacaaguauaacgauuaugagcuauacaaccuaaagaaugcauccauaaaaguguccagcaaaaaugacccacaauuaaaaguagaucuaaaacaacuaagguuaacacuagaauaucuugaauuauuugacaaucgacuuaaagaaaaaagaaacaauauaagucacuucaacuauuuaaacggacaacucggaaacaguauacuugagcucuuugaugacgcaagggacguucucucauacgacagaaaacuuaaaaacgcaguuucuaaauccuuaaaagaaauauuauccagucauggaauggaaguaacauucaaaccccuauaccaaacaaaucaucacuuaaaaauugacaaacuucaaccgaaaaaaauacaucaucuaggcgaaaaaaguacugucucaucuaaccaagucucaaacgaauauugccaacuaguccgaacucucuuaacaaugaaguga

SEQ ID NO: 11515 - RNA, 3465 nt, Artificial Sequence
  Cas13a variant__Paludibacter propionicigenes__WP_013443710.1__Cas13a
augagagucucaaaagucaaagugaaagacggcgguaaagauaaaaugguacucguacacagaaaaacuacaggcgcacagcuagucuacucuggacaaccaguaagcaacgaaacuucuaacauacuucccgaaaagaaacggcaauccuucgauuuaaguacgcuaaauaaaacaaucaucaaauucgauacagcaaagaaacaaaaacuaaauguagaccaauauaaaauaguugagaaaauauucaaauauccaaaacaagaacucccuaaacaaauaaaagcagaagaaauacuuccauucuugaaucacaaauuccaagaaccugucaaauacuggaaaaacggaaaagaagaauccuuuaacuuaacauuacuaauaguagaagcagugcaagcacaagacaaacgaaaauuacaaccguauuaugauuggaaaacaugguauauacagacaaaauccgaucuacuaaagaaauccauagaaaauaauagaauugaucuaaccgaaaaucuaucaaaaaggaaaaaggcuuuauuagcuugggaaaccgaguucacagcaucaggaucaauagaucucacucacuaucacaaagucuauaugacugaugucuuauguaaaaugcuacaagacguaaaaccacugacggaugacaaagguaaaauaaauacaaacgcauaccaucgaggacucaagaaagcacuacaaaaucaucaacccgcaaucuucggcacacgagaagucccaaacgaagcaaauagagcagacaaucaacuauccauauaucaccuagaagucguaaaauaccuagaacauuacuucccaauaaaaacaaguaaaaggagaaacacagcugacgacaucgcccacuaccuaaaagcacaaacacuaaaaacaacaauagaaaaacagcuaguuaacgcaauacgagcaaauauuauccaacaaggaaaaaccaaucaucacgaauuaaaagccgauacaaccuccaacgaccucauccgcaucaaaacaaacgaagcauucguuuuaaaucuuacaggaaccugcgcauucgccgcaaacaacauaagaaacaugguagacaaugaacaaaccaaugacauccuuggcaaaggcgacuuuaucaaauccuuauuaaaagauaacacuaauucucaacuauauaguuucuucuuuggagaaggcuuaucaacaaauaaagcagaaaaagaaacgcaauuauggggaauaagaggagcaguccaacaaauucguaacaacguaaaucacuauaagaaagacgcauuaaaaacuguuuuuaauaucucaaacuuugaaaaccccacuaucacagaucccaaacaacaaaccaauuaugcugauacaauauacaaagcacgauuuauuaaugaacuagagaaaaucccagaggcuuuugcucaacaauuaaaaacaggaggcgccguaucauacuacacaauagaaaaccucaaaucccuacuaacuaccuuucaauucagucuauguagaaguacuauacccuuugccccaggauucaagaaaguauuuaauggagguauuaacuaucaaaacgcuaaacaagacgaaucauuuuaugaacucauguuagaacaauaucucagaaaagaaaacuucgcggaagaaagcuauaacgcucgauauuucaugcuaaaacuaauuuauaacaauuuauuuuuacccggauuuacaacugacagaaaagccuucgcugauuccguagguuuuguccaaaugcaaaacaagaaacaagcugaaaaaguaaauccccgaaagaaagaagccuaugcauuugaagccgucagaccaaugaccgcagcagacucaauagccgacuacauggcauauguacaaucagaacuaaugcaagaacaaaauaagaaagaagaaaaaguagcagaagaaacuagaauaaacuuugaaaaauuuguauuacaagucuuuauuaaaggauucgacagcuuucuacgagcaaaagaguucgacuuuguacagaugccacaaccacaacuaacagcaacagcauccaaccaacaaaaagccgauaaauuaaaccaacucgaagcaucaaucaccgcagauuguaaauuaacaccacaauacgcuaaagcagacgacgcaacucauauagccuuuuauguauuuuguaaacuccuagacgcagcacaucuaaguaaucucagaaacgaauuaauaaaauuuagagaaaguguuaaugaauuuaaauuucaccaucuucucgaaauaauagaaaucugccuacugucagcagaugugguuccaacagauuauagagaccucuacagcucagaagccgacugucuagcccgacucagaccauuuauagaacaaggagccgacauaacaaauugguccgauuuauuuguacaaucagauaaacauaguccaguaauccaugcaaacauugaauuaagcguuaaauacggaacgacuaaacuacucgaacaaauaauaaauaaagauacacaauuuaaaaccacagaagcaaacuuuacagcauggaacacagcucaaaaaucgauagaacaacuaauuaaacaaagagaagaccaucacgaacaauggguaaaagcgaaaaacgcagaugauaaagaaaaacaggaaagaaaaagggaaaaauccaauuucgcacaaaaauucauagaaaagcacggugaugauuaucuugacauaugugacuacauuaauacauauaacuggcucgauaacaagaugcacuuuguccaucuuaaccgauuacaugguuuaacaauagaauuacugggacgaauggcaggauucguagccuuguuugaucgugauuuccaauucuuugacgaacaacagauugccgaugaauuuaaacuucacggauuuguaaacuuacacucaauagauaagaaauuaaacgaaguacccacuaagaaaaucaaagaaauauaugauauacgaaauaaaauaauccaaaucaacgguaauaaaauaaacgaaucaguacgagccaacuuaauccaauuuauauccucuaaaagaaacuauuauaacaaugcauuuuuacacguaucaaacgacgaaauaaaagaaaaacaaauguaugauaucagaaaccacauugcccauuuuaacuauuugacaaaagacgcugcagauuucagccuuauugaucucauaaaugaauuaagagaacuacuacacuaugacagaaaacucaaaaaugcuguuuccaaagcauucauugaccuauucgacaaacacggaaugauacuaaaauugaaauuaaaugcagaccacaaacuaaaaguagagagcuuagaaccuaagaaaauauaucacuuagguuccagugcuaaagauaaaccagaauaccaauauuguacaaaccaaguaaugauggccuacuguaauaugugccgcucuuuacuagaaaugaagaaauag

SEQ ID NO: 11516 - RNA, 3858 nt, Artificial Sequence
  Cas13a variant__Rhodobacter capsulatus__ETD76934.1__Cas13a
augcaaauaggaaaaguacaaggaagaacaauuagugaguuuggggacccagcugguggauuaaaaagaaaaauuaguacggacggcaaaaauagaaaagaacuaccugcccauuuaaguucggacccaaaagcgcuuaucggacaauggauaagcggcaucgacaaaauauacaggaagccagauucacgaaaaucagauggcaaagcaauacacagcccuacuccgaguaaaaugcaauucgaugcacgugaugauuuaggugaggcauucuggaagcugguaagcgaagcagguuuagcacaggauucagauuaugaucaguuuaaaagacgacuacauccauauggcgacaaauuucaacccgcagacagcggcgcaaaacuaaaauuugaagcugauccuccugagccucaagcauuucaugggagaugguacggugccaugucgaaacguggaaacgaugccaaagaauuagccgcugcacuauacgaacaucuccaugucgaugagaaaagaauugauggccaaccgaagaggaacccaaaaacugacaaauucgcaccuggcuuaguaguagccagagcccuaggaauagaaucuucggucuuaccacgaggaauggcaagauuggcaaggaauuggggagaagaagaaauucaaacauauuucgugguugacguagcugcuuccguuaaagaaguugcaaaagccgcuguaagcgcagcacaagcauucgauccuccaagacaaguaucaggacgcagccuuaguccaaaaguaggguuugcucuugcagaacaccuggaacgaguaacugggagcaaacguuguagcuucgacccagccgcaggaccaagcguacuugcuuuacaugaugaagucaagaaaacuuauaaaagauuaugcgcaagagggaaaaaugcugcacgugccuuuccggcagacaaaacagaacuccuugcacuuaugagacauacucaugaaaauagaguuagaaaccaaaugguaagaaugggcaggguaucagaauacagaggccaacaagcuggcgauuuggcccaaucacauuauuggacaucagcgggacaaacagaaauuaaagaaucagaaauauucguacgauuaugggucggugcguuugccuuagcaggacggaguaugaaagcguggauagauccaaugggaaaaauaguaaauaccgaaaagaacgacagagaccuuacggcagcaguaaauauaagacagguaauaaguaauaaagaaaugguagcugaagccauggcaaggagaggaauauacuucggcgaaacuccugaacucgauagauuaggcgcagaagguaacgaaggauuuguauucgcauugcuuagauauuuaagagguuguagaaaucaaaccuuucaucuaggagcucgagccggauucuuaaaagaaauuagaaaagaauuagagaaaacgagauggggcaaagcaaaagaagcagaacacguuguuuuaaccgauaagacugucgcagcaauaagagcuauaauagauaacgaugcuaaagcacuuggagcccgacucuuggcagauuuaucaggagcauucguagcucacuacgcgucaaaagaacauuuuucaacacuauauucagaaauaguaaaagccguaaaagaugcuccagaaguaagcuccggcuuacccagguuaaaacuguuacugaaaagagcagaugguguacgaggauaugugcacggacuaagagacacaagaaaacaugcuuucgccacuaaauugccacccccuccugccccuagagaauuagaugacccugcaaccaaagcuagauacauagcacuauuaagguuauacgacggaccauuuagagcuuacgcaucagguauaacugguacugcacuagcaggcccugccgcaagggcaaaagaagcagcuaccgccuuggcacagucuguaaaugucacaaaggcuuauucagacguuauggaaggcagaaguucaagauuacgaccgccuaaugauggugaaacacuaagagaguaccugucagcuuuaaccggagaaacggcuacagaauuuagaguacaaauugguuaugaaucugauagcgaaaaugcacgcaaacaagcugaguucauugaaaacuauagacgagacauguuggcauucauguuugaagauuacauaagggcgaaaggauuugacuggauacuuaaaauagagccaggagcaacagccaugacacgugcaccaguguugccugaacccauagauacuagaggccaguaugaacacuggcaagcagccuuauauuuagucaugcauuucguaccugcuagcgauguuucaaaucuauugcaucaacucagaaaaugggaagcguuacaaggaaaauaugaacuuguacaagauggugacgcuacagaucaagcagaugcaaggagagaggcauuagaucucguuaagcgcuucagggacguauugguauuauucuuaaaaacaggcgaagcucgcuuugaaggccgggcugcaccauuugaccuuaaaccuuuuagagccuuauuugcaaauccugcaacauucgaccguuuguucauggcaacaccaacgacagccagaccagcugaagaugauccagagggcgauggagccucagaacccgaauugcguguagcaagaacacuucguggucugagacaaaucgcaagauauaaccauauggcuguacuaucagaucuuuuugcaaaacacaaaguuagagaugaagaagucgcacguuuagcugagauagaagaugaaacucaagagaaaagucaaauaguagcugcacaagaguuaagaacagaucuccacgauaaagugaugaaaugucacccgaaaacuauaaguccagaggaaagacagucuuacgcugccgcaauaaaaacaauagaagaacaucgguucuuaguuggaaggguauauuuaggcgaccaucucagauuacacagauugaugauggauguaauuggaagacuuauugauuaugcgggagcauaugaaagggacacggggaccuucuuaauaaaugcuucaaaacaguuaggagcuggugcugauugggcgguaacaauugccggagcagccaauaccgaugcaaggacacaaacaagaaaagaucuagcgcacuuuaacguguuagaucgugcggacgguacuccagaccucacggcauuaguaaauagagcgagggaaaugauggcauaugauaggaaaagaaagaacgccguaccacgaaguauucuugauauguuagcgaggcuaggauuaacucugaaauggcaaaugaaagaucaucuauugcaggaugcaaccauaacgcaggcagcaauuaaacauuuggacaaaguacgucucacaguuggaggucccgccgcagucacagaagcacgcuuuucacaagauuauuuacaaaugguagcggcaguuuucaacggaucuguccaaaaucccaaaccaaggagacgagaugacggugaugcauggcacaaaccaccaaaacccgccacagcacaaagccaaccugaccagaaaccaccaaacaaggcuccgucugcaggaucaaggcuuccaccgccccaagucggggaaguauaugaaggagucguaguuaaaguaaucgauaccggcucuuuaggauucuuagcgguagaagggguagcaggaaacaucggacuucauauaucgcgucugagaagaauacgugaagaugcaauuauaguuggacgaagauaucguuuccgagucgaaauuuaugugccuccaaagucaaauacguccaaauuaaacgcagccgacuugguaagaaucgacuaa

SEQ ID NO: 11517 - RNA, 1578 nt, Artificial Sequence
  Cas13a variant__Corynebacterium ulcerans__WP_038617242.1__Cas13
augccuaaauauuguuuaacagcaagauuuccacuaggaguauaccuaggccauacaggcgacgcaaaucgagacgcauacccugauccagcgcgacuacaugcagcacuaaugaaugcagcagcucaaggaguacaugcagaagaagaccccaaugaacaucaauuaagaccuucacaacaaucauuacaagccuuacaauggcuagaagcacauccaccaacaggauuagcaaugccugaacaacaaugguuaaguccagacacaucaagaaugauguacagaaauguaggaagcguaaaaauagacaaaacaggaguaacgcgagcaaccgaaaauagagcaguaagcgacggaguaaguguaaacggugcauacggauacauaugggacgaaaugccaguagauauagcagaagcaauaacugccuugcuacccgacguagcauguuuaggagaagcgucaucccuuguaguauuagaacaacaagaaauagaggccacacuuacacucgauccucaagcuaccgccuuuagcacagaaagaguucaaguaagaauugcauuaccuggaagaacacaacacuuaagagaagucuuucaugcuagauauggaaaaaaacccccuucaaaaaaagcugauaaauuucucaaagaugauccaauucacgauccaccaaucccaaaagaucacuuaggaacagcaagauauuugcgaguaaacgcagccgauaaagaaugugugacaccguggacuaaaguuauacuucuggaaguacacgguaaacaauuaggagcaaaagaacaaguaagagcagcaguagcauuacaccgagcacuaauagcucgaauaagaacagacguaucaccaguuauaaccggacgauaugcagcaggcgcacaaagaccagcaaauaaucuagcuauccaguauauaccucaccgacauuuagaagcucuaggauuaaaaacaagugcauucgcauuacuuguaccacaagacgcagauaguacuguauacgaacaauuaaaucaagccuuaacagguccauucccauuaagaucagggggaaaauuauuaugccaacuaaaauacaauggacauguauuuagaggagaugcauuuuggccagcaccacaaccuggaacuauaagaaugugggaaccguuaaacguauucauaccagaaucaagaccucacaauaaacaacaaggaguucuuuggagguuagcagaugccgguuuauuaucaguagcauuuguauggagagauaacuuuccaacaaaagaaacaggacccgcaagauauguugagcuaagagacgcagcauacaaugcagacguaagaauauuccaugaccaucccguuagcagaaacacucgcagauucgugcaccgaacaaauagaucauuaacaauucaaccauggagaggauuaguacaucuaggcucacuucaacaagauagagcaauaauagcacuaggucaaucaagacaucucggaggaggauuauuaauacccguagacauccccagaagugaauuugaaacaaugaccagugaaaugacacacgcauaa

SEQ ID NO: 11518 - RNA, 3675 nt, Artificial Sequence
  Cas13b variant__Bergeyella zoohelcum__WP_002664492.1__Cas13b
auggaaaacaaaacaucacuaggcaauaacauauacuacaaucccuuuaaaccacaagacaaaucuuacuuugcagguuauuucaaugcagcgauggagaacaccgauucaguuuuccgagaacuaggaaaaagacucaaaggcaaagaguauacuagcgagaacuucuucgacgccauauucaaagaaaacaucucgcuaguagaauacgaacgauacguuaaacuccuaagcgacuacuucccaauggcccgauuacuugacaaaaaagaaguaccaauuaaagaaagaaaagaaaacuucaaaaagaacuucaaaggaauaaucaaagcaguaagggacuuaagaaacuuuuauacccacaaagagcauggagaagucgagauuacagaugaaaucuuuggcguauuagacgaaaugcugaaaucaacagugcuaacggucaaaaaaaaaaaaguuaaaacagauaaaacuaaagaaauccuaaaaaaaagcauagaaaaacagcuugauauccuaugccaaaaaaaauuagaguaccuuagagacacagcccgaaagauagaagaaaaaagacguaaccaaagagaaaggggagaaaaagaacuaguagcacccuucaaauacuccgacaaaagagaugaucuaauugcagcaauuuauaacgacgcauuugauguauacaucgauaagaagaaagauucauuaaaagaaucgucaaaagccaaauacaacacgaaaagcgacccacaacaagaagaaggcgaucucaaaauucccauaagcaaaaauggaguaguguucuuacucucauuguucuuaaccaaacaagagauacaugcauuuaaaaguaaaauagccggauuuaaagcaacaguuauagaugaggcaacugucucagaagcaaccgucucccacggcaaaaacucaauaugcuucauggcaacccacgaaaucuuuucacaucuggccuacaaaaaauuaaaaagaaaaguaagaacagcugaaaucaauuacggcgaagcagaaaaugcagaacaauuaagcguuuaugcuaaagaaacccucaugaugcaaauguuagaugaacuaaguaaagugcccgacguaguauaucaaaaccuauccgaagacguacaaaaaaccuucauugaagacuggaaugaauaccugaaagagaacaauggugacgucggaacaauggaagaagaacaaguuauacacccaguaauaaggaaacgauacgaggauaaauucaacuacuuugccauaagauuucuagacgaauucgcccaauucccaacauugcgauuccaggugcauuuaggcaacuaucuucacgacucuagaccaaaagaaaacuuaauuagugauagacgaauuaaagaaaaaaucacaguguuuggucgucucucugaacuagaacacaagaaagcacucuuuaucaaaaacacggaaacaaacgaagacagagaacacuacugggaaauauuucccaauccuaauuaugauuuuccaaaggaaaauauauccguuaaugacaaggacuucccgauagccggaaguauauuagauagagagaaacagccaguagcagguaaaaucgggaucaaaguaaaauuacuaaaucaacaauacguaucagaaguagacaaagcgguaaaagcucaccaauuaaagcaacgaaaagcaucaaaaccaagcauacaaaauauaauagaggaaauaguaccaaucaacgaaagcaacccgaaagaagcuaucguauuuggaggacaaccgaccgccuaccuaucuaugaaugauauacacagcaucuuauacgaauucuuugacaaaugggaaaaaaaaaaagaaaaauuagaaaaaaaaggugaaaaggaacuuaggaaagaaauagguaaagaacuagaaaaaaaaauugucggaaaaauacaagcucaaauccaacaaauuauagacaaagauacaaacgcaaaaauauugaagccguaucaagacggaaacaguacggcaaucgacaaagaaaaacuaauuaaagaccugaaacaagaacaaaauauauuacagaagcucaaagaugaacagacgguaagagaaaaagaauacaacgacuuuaucgcauaccaggacaaaaacagggaaaucaauaaagucagagacagaaaucauaaacaauaccuaaaagacaaccuaaaaaggaaauacccagaagccccagcacgaaaggaaguucucuauuaccgagagaaaggaaaagucgcuguaugguuagcuaacgauauaaaacgcuuuaugccuacugauuuuaagaaugaauggaaaggagaacaacacucacuacugcagaaaucacuggcauauuacgaacaauguaaagaagaacuaaaaaaccuucuaccagaaaaaguguuccaacaucuaccauucaaauuaggaggguauuuucagcaaaaauaucuauaucaguucuauaccuguuaucuagacaaaagacuagaauauauaagcggacugguacaacaagcagaaaauuucaaaagugagaauaaaguauucaaaaaaguagaaaacgaaugcuucaaauuucucaagaaacaaaacuauacccacaaggaauuagaugcgagaguacagucaauacuuggguauccaauuuuccuugaaagaggauucauggacgaaaaacccacaauaauuaaaggaaaaacauucaaaggaaacgaagcauuauucgcagauugguucagauacuacaaggaguaccaaaauuuucaaacauucuaugacaccgaaaacuauccauugguagaauuagaaaaaaaacaggcugaccguaaaaggaaaaccaaaauauaccagcagaagaaaaacgacguauuuacauuacucauggcaaaacauaucuucaaaagugucuuuaaacaagacucaauagaucaguuuucacuagaagacuuauaccaaucgcgagaagaaagacuuggaaaccaggaacgagcccgccaaacaggcgaacgaaauacaaacuauaucuggaacaaaacaguagacuuaaaacuuugcgauggaaagaucacaguagaaaauguuaaauuaaaaaacguuggagacuucauaaaauaugaauacgaccaaagaguccaagccuucuuaaaauacgaagaaaauauugaauggcaagcauuucuaauaaaggagagcaaggaggaagaaaacuaucccuauguuguagaacgagaaauagaacaauacgaaaaaguaagaagggaagaacuacugaaagaaguacauuuaauagaggaauacauuuuagaaaaaguuaaagacaaagaaauauugaaaaaaggagauaaccaaaacuuuaaauacuacaucuuaaacggccuacuuaaacaauugaaaaaugaagacguagaaucuuacaaagucuuuaaccuuaauaccgaaccagaagacgugaauauaaaccaacuaaaacaggaggcuacugaucuagaacaaaaagcauucguacucacauacauucgcaacaaguucgcacacaaucagcuuccuaaaaaagaauuuugggacuauugccaagaaaaauacgggaaaauugaaaaagaaaaaaccuacgccgaauauuuugcagaggucuucaaaaaggaaaaagaagcacuaauaaaauaa

SEQ ID NO: 11519 - RNA, 3675 nt, Artificial Sequence
  Cas13b variant__Bergeyella zoohelcum__WP_002664492.1 modified__Cas13b(R116A,H121A,R1177A,H1182A)
auggagaauaaaacgucacuaggaaacaacauauacuauaauccuuucaaaccacaagauaaaagcuacuucgcaggauauuuuaacgcugcaauggaaaacacagauuccgucuuuagagaacucggaaaacguuuaaagggcaaagaauacacaucugaaaauuuuuuugacgcaauauucaaagaaaauauaucacucguagaguaugaaagauacguuaaacuacuaucagauuacuuccccauggccagacuucuagacaaaaaagaaguaccgauaaaggaaagaaaagagaacuucaaaaaaaauuuuaaaggcauaauaaaagccguuagagaccuugccaacuucuacacagcuaaagagcauggcgaaguagaaauaaccgacgaaauauucggcgucuuagacgaaaugcuuaaaagcacaguauuaacaguaaaaaaaaaaaaaguuaaaacagacaaaaccaaagagauauuaaaaaaguccauagaaaaacaauuagauauauugugucaaaaaaaacuugaguaucuaagggacacugcacgaaagaucgaagaaaaacgaagaaaucaaagagaaaggggagaaaaagaacuagucgccccauucaaauauucggacaaaagagacgacuuaauagcagccauauacaaugaugcauucgacguauauaucgacaaaaaaaaagacuccuuaaaagaaucaucuaaagcaaaauauaacacaaaaagugauccccaacaagaagaaggggacuuaaaaauaccaaucaguaaaaaugggguaguauuccuacuaucacucuuccuaacuaaacaagaaauucacgcauucaagucaaaaauagcaggauuuaaagcuacaguaauagaugaagcaacaguuagugaggcgacaguaucccacggaaaaaacucaauaugcuuuauggccacacacgagauauucucccaucuagccuauaaaaaacugaagagaaaaguaaggaccgccgaaauaaacuacggagaagcagaaaaugccgaacaauuaucaguauaugcaaaagaaacacuaaugaugcaaaugcuagaugagcuauccaaaguuccagacguaguauaucaaaaccucagugaagacguacaaaaaaccuucauagaagacuggaacgaguacuuaaaagaaaacaacggagacgucggaacaauggaagaagaacaggucauacacccagucauaagaaaaagauacgaagauaaauucaacuauuuugccauccgauuucuagaugaauucgcgcaguucccaacucuaagauuucaaguacaccuagggaacuaccuccacgacagcagaccaaaagaaaaucuaauaucagaccgccgaauaaaagaaaagauaacaguguuuggaagacuaucagaacuagaacacaagaaagcacuuuucauaaaaaacacagaaacaaacgaagauagagaacauuauugggaaauuuucccaaauccaaacuaugacuuuccaaaagaaaacauaagcguuaacgacaaggacuuuccaauagcaggcucaaucuuagacagagaaaaacaaccaguugccggcaaaauaggaauaaaaguaaaacuacuaaaucaacaguauguguccgaaguagacaaagcagucaaagcacaccaauuaaaacaaagaaaagccucgaaaccaucaauccaaaacaucauagaggaaauaguaccaauaaaugaaaguaacccgaaagaagcuauuguguucgguggucaaccgacagccuaccuaucaaugaaugacauacacuccauacuuuacgaauucuucgauaaaugggaaaaaaaaaaggaaaaacuagaaaagaaaggggaaaaagaacucagaaaagaaauaggcaaggaauuagaaaaaaaaauaguaggaaaaauacaagcgcaaauacaacaaauuauugacaaagacacuaacgcuaaaauauuaaaaccauaucaagacggcaacagcacagcaauugacaaagaaaaacucauaaaagacuuaaaacaagaacagaauauauuacaaaagcuaaaagacgaacagacugucagagaaaaagaguacaacgacuucauugcguaccaagacaaaaacagagaaauuaauaaaguacgcgaccggaaucacaaacaguaccucaaagauaaccucaaaagaaaauacccagaagcaccagcacguaaagaaguacuauauuauagagaaaaaggaaaagucgccguauggcuagcaaacgauauuaaacgauuuaugccaaccgauuucaaaaacgaauggaaaggcgaacaacacucucuccuucaaaaaucacuugcuuacuaugaacaguguaaagaagaacuaaagaaccuauuaccagaaaagguuuuccaacaucucccauucaaauuaggaggauacuuccaacagaaguaccucuaucaguuuuacacaugcuaccuagauaaacgccuagaguauauaucuggacuaguccaacaagcggaaaauuuuaagucagaaaacaaaguauuuaaaaaaguugagaacgaauguuucaaauucuuaaaaaaacaaaauuacacacauaaagagcucgacgccagaguccaaaguauacuagguuauccaauauuccuagagcguggauucauggacgaaaaaccaacaauaauaaaaggaaagaccuuuaaaggaaacgaagcacuauuugcagacugguuccgauauuacaaagaauaccaaaauuuucaaacguuuuaugauacggaaaauuauccacuaguagaacuggaaaagaaacaagcugauaggaaaagaaaaacuaaaauauaucaacaaaaaaaaaaugaugucuuuacacuacuaauggcaaaacacauauuuaaaucaguuuucaaacaagauagcauagaucaauuuucauuagaagaccuauaccaaagucgagaagaaagauugggaaaucaagaacgagcaaggcaaacaggagaacguaauacuaacuauauauggaacaagacaguagaccuuaaacuaugugacggaaaaauaacaguagaaaaugucaaguuaaaaaauguaggugacuucauaaaauacgaauacgaucaacgcguucaagcauuuuuaaaauaugaagaaaacaucgaauggcaagcauuuuuaaucaaagaaucaaaggaagaagaaaacuauccauacguaguagaaagagaaauagaacaauacgagaaaguacgacgugaagagcuacuuaaagaaguacaucuaauagaagaauacauuuuagaaaaaguaaaagacaaagaaauauuaaaaaaaggcgacaaucaaaauuuuaaauacuauauccuaaacggacucuuaaagcaacuaaaaaacgaagacguagaaaguuacaaaguauuuaaucuaaacaccgaaccggaagaugucaacauaaaucaauuaaaacaagaggcgacagaucuagaacaaaaagcguucguacuaacauacauagcgaacaaauuugccgcaaaccagcuaccaaaaaaagaauucugggacuacugccaggaaaaguauggcaaaauagaaaaagaaaaaaccuacgccgaauacuucgcugaaguauuuaaaaaagaaaaagaggcucuaauaaaauaa

SEQ ID NO: 11520 - RNA, 3384 nt, Artificial Sequence
  Cas13b variant__Prevotella buccae__WP_004343973.1__Cas13b
augcaaaaacaagauaaacuauuuguagaccgcaagaaaaacgccaucuucgccuuucccaaauacauaacaaucauggaaaacaaagaaaaaccagaaccuauuuacuacgaacucacagauaaacacuucugggcagcauuccuaaauuuggccagacauaauguauauacaacaauuaaucacaucaacagaagacuagaaauagccgaacuaaaagacgauggauacaugauggguauuaaagggaguuggaaugaacaagcaaagaaauuagauaagaaaguuagauuaagagauuuaauaaugaaacacuuccccuucuuagaagcagcagcauaugaaaugacaaacagcaaaucaccaaacaauaaagaacaaagagaaaaagaacaaucugaagcacucucucuuaacaacuuaaagaacguacuauucaucuuccuagaaaaacuacaaguccuacgcaacuacuacucucacuacaaauauucggaagaaucaccuaaaccaauuuuugaaacaaguuuauugaaaaacauguacaaaguauuugacgcaaacguaaggcuuguaaaacgagacuauaugcaucaugaaaauauagacaugcaacgagacuucacacaccuuaaccgaaagaaacaagucggcagaacuaaaaauaucauagauucaccgaacuuucauuaucauuuugccgacaaagaagguaauaugacaaucgcaggcuuacuauucuuuguuucguuauuuuuagauaagaaagacgccauauggaugcaaaagaaauuaaaaggguucaaagacggcagaaaucuacgagaacaaaugacaaaugaaguauuuugucgaagccgaauaagccuucccaaacucaaauuagaaaacguacagacaaaagacuggaugcaauuagacaugcuaaaugagcuagucagaugccccaaaucccuuuaugaacgccuaagagaaaaagaucgagaaucauuuaaaguacccuuugacaucuucagcgacgauuacaacgcagaagaagaaccauuuaaaaacacauuaguccgccaucaggaccgauuuccauauuucguccuaagguauuucgauuuaaacgaaauauucgaacaacuccgcuuccaaaucgaucuaggcacauaccauuucucaauauauaacaaaagaaucggcgacgaagaugaaguacgccaccuaacccaccaccuuuaugguuuugcucgcauacaagauuucgcaccacaaaaccaaccagaagaauggagaaaacugguaaaagaccuagaucacuuugaaacaucccaagaaccauacaucucaaaaacagcaccacacuaccaucuagaaaacgagaaaauaggaauaaaauucuguucagcacacaacaaucuuuuuccaucccuacaaacugacaaaacaugcaacggccguaguaaauucaauuuaggaacacaauucaccgcagaagccuucuuaucuguacacgaauuacucccgaugauguuuuacuauuuacuacucacaaaagacuacaguagaaaagaaucugcugacaaaguggaagguauuauuagaaaagaaauuucaaacauuuacgccaucuacgacgcuuucgcuaacaacgaaauaaauagcauagcagacuuaacaagaagauuacaaaauacuaacauacuacaaggucauuuaccaaaacaaaugauaucaaucuuaaaaggacgccaaaaagauaugggaaaagaagcggaaagaaaaauaggugaaaugauugacgauacacaaaggagacuagaccuuuuauguaaacaaacaaaccagaaaauucgaauagguaaacgaaaugcaggacuucugaaaucaggcaaaauagcagacuggcucguuaacgacaugaugcgauuucaaccaguucaaaaagaucaaaauaauauaccaauaaauaacucaaaagcaaacucuaccgaauauagaaugcuucaaagagcacuugcacucuuuggaucugaaaacuucagacugaaagcauacuuuaaccaaaugaaucucgucggcaaugacaacccucauccauuucucgcagaaacccaaugggaacaccaaacuaacauucuaucuuuuuacagaaacuauuuagaagcacgaaagaaauauuuaaaaggcuuaaaaccacaaaauuggaaacaauaucaacacuuccuuauucucaaaguucagaaaacaaaccgcaacacucucgucacagguuggaaaaauuccuuuaaccuaccucguggaaucuucacacaaccaauaagagaaugguucgaaaaacacaauaauagcaaaagaauauaugaccaaauacuuucauuugaccgugucggauuuguagcaaaggcuauaccccuguacuucgcagaagaauauaaagacaacguccaaccauucuacgacuacccauuuaacaucggcaacagacuuaaaccaaagaaaagacaauuccuagauaagaaagaacgaguggaauuauggcagaaaaacaaagaauuauucaaaaacuauccauccgagaaaaagaaaaccgauuuagcauaucuagacuuuuuauccuggaagaaauuugaaagagagcuucgacucaucaaaaaucaagacauagucacguggcuaauguucaaagaacuauucaacauggcuacagucgagggauuaaaaauaggcgaaauacacuuacgcgacauagauacuaauaccgcaaacgaagaaucuaauaacauucucaauagaauaaugcccaugaaacuucccguuaaaaccuacgaaacagauaauaaaggaaacauucuuaaagaacgaccguuagccaccuuuuacauagaagaaacagaaacaaaaguucuaaaacaaggaaacuuuaaagcauuaguuaaagauagaagauuaaacggccuauuuuccuucgcagaaacuaccgaccuaaaccuagaggaacauccaauaucaaaauugucagucgaccuagaauuaauaaaauaucaaaccacucgaauaaguauuuuugagaugacucucggacuggagaagaaauuaauagacaaauacucaaccuuacccacugacagcuuccgaaauaugcuugaacgauggcuccaauguaaagcgaacagaccagaacuuaaaaauuacguaaacucauuaauugcaguaagaaacgccuuuucacauaaucaauacccuauguacgaugcaacauuauucgccgaaguuaagaaauucacucucuuuccuucaguagauacuaagaaaauagaauuaaacauagcaccccaacugcuagaaaucguugguaaagccaucaaagaaauagagaaaagugaaaauaaaaauuaa

SEQ ID NO: 11521 - RNA, 3273 nt, Artificial Sequence
  Cas13b variant__Prevotella sp.__WP_044065294__Cas13b
augaacauaccagcccuaguugaaaaucaaaagaaauauuucggaacauacagcguaauggcaaugcucaaugcucaaacaguacuagaucauauccaaaaaguagccgacauagaaggcgaacaaaaugaaaauaacgaaaaccucugguuucacccaguaaugagucacuuauauaaugcuaaaaacggauacgacaaacaaccugagaaaaccauguuuauaauugaaagacuacaaucauauuucccauuccuaaaaaucauggcugaaaaccaaagagaauacagcaacgguaaauacaaacaaaauaggguagaaguuaauucaaacgacauauucgagguauuaaaaagagcauucgguguuuuaaaaauguacagagacuuaacaaaccacuauaaaacguacgaagaaaaacuaaacgauggaugcgaguucuuaacaucaacagaacaaccauuaucagggaugauuaacaacuauuacacaguagccuuacgaaacaugaacgaacgauacggauauaaaacggaagaucucgcauuuauacaagacaaacgcuucaaauuuguaaaagacgcauacgggaaaaagaaaucacaagugaacacaggauucuuccuaagucugcaagacuacaacggagauacccaaaagaaacuacaccuaaguggcguaggaauagcuuuauuaauaugccuguuccuagacaaacaauauauuaacauauuccucucaagguuaccaauauucucauccuauaaugcccaauccgaagaacgaagaauaauaauacguuccuuuggcaucaauucaauaaaauuacccaaagauagaauacauucggagaaaaguaauaaaucaguagcuauggauaugcuaaaugaaguaaaacguuguccagaugaacuauuuacgacguuaucugcggaaaaacaaucucgauucagaauaauaucagacgaucauaacgaaguccuaaugaaaagauccagcgacagauuugucccacuauuacuacaguacauagauuacggaaaacuuuuugaucauauaagauuccauguuaauaugggaaaacugagauaccuccuaaaagcagacaaaacgugcauagacggacaaacaagaguacgaguuauugaacaaccucuaaaugguuuuggaagauuagaagaagccgagacuaugaggaaacaagaaaacggaacguucgguaauaguggcaucaggaucagagauuuugaaaacaugaaacgagacgacgcaaauccugcaaacuauccauauauaguagauacauacacacauuacauuuuagaaaauaacaaaguugaaauguuuauaaacgacaaagaagauuccgcgcccuuacucccuguaauagaagacgacagauacguaguaaaaacaauaccuagcuguagaaugucaacgcuagaaauaccugcgauggcuuuucacauguucuuauuuggcucaaagaaaacagaaaaauuaauaguagacguccacaaucguuacaaaaggcuuuuucaagccaugcaaaaagaagaaguaacagcugaaaacauagcauccuucgggauagcggagucugauuuaccacagaaaauccucgauuuaauuucaggcaacgcgcacggaaaagacguagacgcauucauaagacuaaccguggaugauauguuaacagauacagaaagaagaauaaaaagauuuaaagacgacaggaaaaguauaaggucagcagacaauaaaauggguaaacgcgguuucaaacaaauaaguacaggaaaacucgcagacuuuuuagcaaaagauauagugcuauuccaaccaucagugaaugacggugaaaacaaaauaacuggauuaaauuaccguauuaugcaaucugccauugccguguaugacucaggcgaugacuacgaagcaaaacaacaauuuaaacuaauguucgaaaaagcccgucuaaucggaaaaggaacaacagagccccaccccuuucuauacaaaguauuugcaagaagcauaccagcaaaugccguagaauuuuacgaaagauaccuuauagaaagaaaauucuauuuaacaggucugaguaacgaaauaaagaaaggcaacagagucgacguaccauucauccgcagagaccaaaauaaauggaaaacaccagccaugaaaacccuagguagaauauacucggaggacuuaccaguagaacuaccgagacaaauguucgauaaugaaauaaaaagucaccucaaaucauuaccccaaauggaaggaauagacuuuaacaaugcaaauguaacauauuuaauagcagaauauaugaaacgcguauuagaugacgauuuccaaacauucuaccaauggaauagaaauuacagauacauggauauguuaaaaggggaguacgauaggaaaggaucuuuacaacacugcuuuaccucuguagaagagagagaaggauuauggaaagaaagagccagcagaacagaaagauacagaaaacaagcuagcaauaagaucaggaguaaucgucaaaugcgaaacgcaaguucugaagaaaucgaaacaauucuggauaaacgacuuaguaauaguagaaacgaauaccaaaaaucagaaaaagucauuagacgauauagaguacaagacgcacuuuuauuccuauuagcuaagaaaacauuaacagaacuggcagauuuugacggggaaagauuuaaacucaaagaaauaaugcccgaugcagaaaaagguaucuuaucagaaauaaugccaaugucauucacguucgaaaaaggaggaaagaaauacacaauaacauccgaaggaaugaaacuuaaaaauuauggagauuucuucguauuagccagugacaaacgaauagguaaccuacuagaacucguagguagcgauaucgugagcaaagaagauauaauggaagaauuuaacaaauacgaccaaugccggccagaaaucaguagcaucguauucaacuuagaaaaaugggcuuuugauaccuauccagaauuguccgcaagaguagauagagaggaaaaaguagauuucaaaucaauacuaaaaauacuauuaaacaacaaaaacauaaacaaagaacaaagcgacauacuaagaaaaauaagaaacgccuucgaccauaacaauuacccagauaaaggaguaguagagauaaaggcuuuacccgaaauagcuaugaguauaaagaaagcauucggagaauaugccauaaugaaauaa

SEQ ID NO: 11522 - RNA, 4152 nt, Artificial Sequence
  Cas13b variant__Artificial____PspCas13b-GS-HsADAR2DD(E488Q,del984-1090)
augaauauccccgcucuaguugaaaaucaaaagaaauacuucggaacuuauagcguaauggcaauguuaaaugcucaaacugucuuagaucacauacaaaaaguagcagauauagagggggaacaaaacgaaaacaacgaaaaccuaugguuccauccugucaugucucacuuguacaaugcuaaaaacgguuaugauaaacaaccagagaaaacaauguuuauaauagaaagacugcaguccuauuuuccauuucucaaaauaauggcagaaaaucaaagagaauauucaaauggaaaauacaaacagaauagaguagagguaaauucaaaugacauauuugaaguacuuaaaagagcauuuggcguauuaaagauguauagagaccuuacuaacgcguacaaaacuuaugaagaaaaacuaaaugauggaugugaguucuuaacguccacggaacaaccucuaucugguaugauaaauaauuacuauacaguagcauuacggaacaugaaugaacgauacgguuacaaaacagaagacuuagcguuuauccaagauaagcgauucaaguucguaaaagacgcauauggcaaaaagaaaagccaaguuaacacuggauuuuucuuaucacuucaagacuauaacggagacacacaaaagaaauuacaccugucaggcguagguauugcucuacucauauguuuauuucuagacaaacaauacauaaacauuuucuugucaagauuaccuauauucaguucauacaacgcucagagcgaagaaaggaggaucauaauaaggagcuuuggcaucaauaguauuaaauuaccaaaagauagaauacacucugaaaaaucaaacaaaucaguugcuauggauauguuaaaugaaguaaaacgaugccccgacgaauuauucacuaccuuauccgcagaaaaacaaaguagauuuagaauuauuagugacgaucauaaugaaguacuuaugaaaagaucuucugacagauucguaccgcuucuauuacaauauauugacuacgggaaauuauuugaucacauccguuuucauguuaauaugggcaaacugagauauuugcucaaagcugauaaaaccugcauagacggccaaacaagaguacggguuaucgaacaaccacuuaacggguucggacgacuagaagaagcagaaacaaugcgaaaacaagaaaauggaacuuucgguaacuccggcauacgaauuagagauuuugaaaacaugaaacgagaugaugccaauccagcaaacuacccauacaucguagauacauauacucacuauauauuagaaaauaauaaaguagaaauguucauaaacgacaaagaagauucugcaccucuauuaccaguaauagaagaugauagauaugucguuaaaacaauaccaucuugcaggaugagcacuuuagaaauaccagcgauggcuuuucacauguuucuauucggcucaaagaaaacugaaaaacuaauaguugacguacacaauagauacaagcgacuuuuucaggcaaugcaaaaagaagaaguuacagcugaaaauauagcuucguucggaaucgcagaaucggacuuaccucagaaaauauuagauuuaauaucaggaaaugcccaugguaaagacgucgacgcuuucauaagauuaacaguagaugacauguuaaccgauacugaaagacguauaaaacgauuuaaagaugauagaaagucuauccgauccgcggacaacaaaauggguaaacguggauuuaaacaaauuucaacuggaaaacuagcugacuuccucgcgaaagauauaguauuguuucaaccuucugucaacgauggggaaaacaaaauuaccggacugaacuacagaauaaugcaaucugcaaucgccgucuaugauagcggagaugauuaugaagcuaaacaacaauucaaacuaauguuugaaaaagcccgguuaaucgguaaaggcacaacugaaccccacccauuucuauacaagguuuucgccagaaguauaccugcaaaugcgguagaauuuuacgaaagauaccuaauugaaagaaaauuuuauuuaacaggacuaaguaacgaaaucaagaaaggaaacagaguugacguaccauucauaagaagagaccaaaacaaauggaaaacacccgcuaugaaaaccuuagguagaaucuauuccgaagauuuaccuguugaauuaccuagacaaauguucgauaaugaaauuaaaagccaucuaaaaucacuaccucaaauggaaggaauugauuuuaauaaugcaaaugugaccuacuuaauagcagaauauaugaaacgaguauuagaugacgacuuucaaaccuuuuaucaauggaacaggaauuaccgauacauggacaugcuaaaaggggaauaugauagaaaagguagucuucaacauugcuuuacaucaguagaagaacgugaagggcuauggaaagaaagggcaucaaggacggaacgauaucguaagcaagcaucaaacaaaauuagaaguaauagacagaugagaaaugcauccuccgaagaaaucgaaacaauccuugauaagcguuuaucaaauucuagaaaugaauaucagaaaagcgaaaaagucauaagaagguacagagugcaagacgcauuauuauuucuucuggcaaagaaaacacuuacagaacuagcagacuuugacggagaaagauuuaaauuaaaagaaauaaugccggacgcagaaaaaggcauccuuagugaaauaaugccaaugagcuucaccuucgaaaaaggcggaaagaaauauacaauuacaucagaaggaaugaaacuaaagaacuacggcgacuucuuuguauuagcuuccgauaaacgaaucggaaauuugcuagagcuaguaggcagugacauaguuucaaaagaagacggcucccuacaacuacccccacuagaaaggcuaacauuagggucacaacuucauuuaccacaaguacucgccgacgcaguuucgagacucguauuaggaaaauuuggagaucuaacagacaauuuuaguaguccucaugcuagaagaaaagucuuggcaggaguagucaugacaacugguacugacguuaaagacgccaaagugauauccguuagcacuggcacuaaaugcaucaauggagaauauaugagcgauagaggauuagcccuuaaugauugucaugcagaaauuaucuccagaagauccuuacuaagguuucucuauacucaauuagaacuauauuuaaauaacaaagaugaucaaaaacguagcauauuccaaaaaucagaaagaggggguuuucgacuaaaagaaaaugugcaauuccacuuauacauaucaacaucccccugcggggacgccagaauauuuuccccacacgaaccgaucuuagaagaaccugcagauagacauccaaaccgaaaagcgagagggcaacuaagaacuaaaauagaaucuggccaaggaaccauuccaguuaggucaaacgcguccauccagacaugggaugggguucugcagggagagagacuccuaacuaugucauguagugauaaaaucgcucgauggaauguuguaggaauacaaggcucacuucuaaguauauuuguugaaccaauauacuucucaucaauuauacucgguucuuuguaccauggagaucauuugaguagagcuauguaccaaagaaucaguaacauagaggaucuaccuccucuauacacacuaaacaaaccccuucucaguggaauuucaaacgcugaagcaagacagcccggaaaagcucccaauuucucaguuaauuggacuguaggagauuccgcuauagaagucauaaaugccacaacuggaaaagaugaacuaggucgagcgucaaggcuuuguaaacaugccuuauauugcagauggaugcgaguacaugguaaagucccaucacacuuacuacguucgaaaauaacuaaaccgaacguauaccaugaauccaaauuagcagcgaaagaauaucaagcagcaaaggcaagacucuucaccgccuuuauaaaagcaggauuaggugcuuggguagaaaaacccaccgaacaagaccaauucagucuaacauaa

SEQ ID NO: 11523 - RNA, 4152 nt, Artificial Sequence
  Cas13b variant__Artificial____PspCas13b-GS-HsADAR2DD(E488Q,T375G,del984- 1090)
augaauaucccagcacuuguagaaaaucaaaagaaauacuucggaacuuauaguguaauggcaaugcuuaaugcucaaacaguuuuagaccauauucaaaaaguagcagacaucgaaggagaacaaaacgaaaauaaugaaaacuuaugguuccaucccguaaugucucaucucuauaaugcuaaaaaugguuaugacaaacaacccgagaaaacaauguucauuauugaacgccuucagaguuacuuuccauuuuuaaaaauaauggcagaaaaucaaagagaauacucaaacggcaaauauaaacaaaaccgaguugagguaaauucuaacgauaucuuugaagucuuaaagagagcuuucggcguucuuaagauguaccgagacuuaaccaaugcuuauaaaacauacgaagaaaaacuuaaugauggcugugaguucuuaacaaguacugaacaaccccuaucuggcaugauaaauaauuauuacacaguagcccuacgcaauaugaacgaaagauauggguacaaaacagaagaucucgccuuuauccaggauaagagauuuaaguucguuaaagaugccuauggaaagaagaaaucacaaguaaacaccggauucuuucuaagucuucaagacuauaacggagacacucaaaagaaacuacaucuauccgggguugguauugcacuauuaauauguuuauuucuggacaaacaguauauuaacaucuuucuauccaggcuuccuauauucagcucguauaaugcccaaucagaagaacgcagaaucauaauaagaucauucgguauaaauagcauaaaauuaccaaaagacaggauucauagcgaaaaaucaaacaaaucgguggcuauggauauguuaaacgaaguaaaaagauguccggaugaacuguuuacuacauugucugcggaaaaacaaaguagauuuagaauaauaagcgaugaucauaaugaaguuuuaaugaaaagaucgucggauagauuuguaccacuccugcuucaauacauugauuacggaaaauuauucgaucacauaagguuucauguuaacauggggaaauuaagauauuuauuaaaagcagauaaaacaugcauagauggacaaacacgagucagaguaauagaacaaccauuaaauggauuugggagacuagaagaagcagaaaccaugagaaaacaggaaaaugguaccuuugggaacucagguauacguauaagagacuuugaaaauaugaaaagagaugacgcuaacccggccaacuauccauauauaguugacacauauacacauuauauuuuggaaaauaacaaaguagaaauguuuaucaacgauaaggaagacuccgcaccauugcucccaguaauagaagacgacagauacguaguuaaaacuauaccaucaugcagaaugaguacacucgaaauccccgcuauggcauuucauauguuuuuauuugguucaaagaaaacagaaaaauuaaucguagacguccauaacagauauaaaagacuauuucaagcaaugcaaaaagaagaagucacagcugaaaauauugcaucauucggaauagccgaauccgacuuaccacagaagauauuagaucuaauuucggggaaugcacauggaaaagacguagaugcauucauucgauuaacuguugacgauaugcuaacagauacugaacgccguauuaaaagauuuaaagacgacagaaaaucaauaagaagugcugacaauaaaauggggaaaagaggauucaaacaaauaaguacaggaaaacuagccgauuucuuagccaaagacauaguccuauuucaaccgaguguaaacgacggagaaaacaaaauaacuggccuaaacuacagaauuaugcaaagugcaauagcugucuacgauucaggagacgauuaugaagcaaagcaacaauuuaaauuaauguuugaaaaggcuagauuaaucggaaaaggaaccacugagccacauccauucuuauauaaaguauucgcaagaucaauuccagcuaacgcaguugaauuuuacgaacgauaccuaaucgaaagaaaauuuuaucuuacaggauugucaaaugaaauaaagaaaggaaauagaguagauguaccauucauaagacgcgaccaaaacaaauggaaaacacccgcuaugaaaacauuaggacgcaucuauuccgaagaccucccuguugaacuaccuagacaaauguucgacaacgaaauaaaaucgcaucuuaaaucccugccacaaauggaaggcauagauuucaauaacgcaaaugucaccuaccuaauagcagaauauaugaaaaggguauuagacgaugauuuccaaaccuucuaucaauggaacagaaauuauagauacauggauaugcuuaagggugaguaugauagaaaagggucccuacaacacugcuuuacaucuguagaagaaagagagggucuauggaaggaacgcgcaagcagaacugaacgcuauagaaaacaagcaucuaacaaaauaaggagcaacagacagaugagaaaugcaucauccgaagaaaucgaaacuauacuugauaaacgacuuuccaauuccaggaaugaauaccagaaaagcgaaaaaguuaucaggcgauauagaguucaagaugcauuacuguuucuccucgcaaagaaaacguugacagaacuagcugacuuugauggagagagguucaaacuaaaagaaauaaugccagaugcugaaaaagguauacuuucagaaauaaugccuaugucauucacauuugaaaaaggaggaaagaaauacacaauaacaucggaagguaugaaauugaaaaacuauggagacuucuuuguacuagccagcgauaaaagaauugguaacuuauuagaauuaguuggaucagauaucguaucaaaagaagauggaucacuucaacuaccaccguuagaaaggcuaacauuagguucccaauuacaccuaccacaagugcuagcggaugcaguaaguagguuaguuuuagggaaauuuggugaccuaacagacaacuucucaucaccacacgcccgccgcaaaguacuagcugggguagucaugacuacagggacagacguaaaagaugcaaaaguaauuaguguaucaacaggaggaaaauguauuaauggugaauacaugucugacagaggccucgcacuuaaugauugccacgcugaaauaauaucuagacgaucauuacuccgauuuuuauacacacaacuggaacuauaucuaaacaauaaagaugaccagaaaagauccauuuuucaaaaaucggaaagaggaggguuccgacuaaaagaaaauguacaauuccacuuguauaucucuaccucaccaugcggugaugcuagaauauuuucuccucaugaaccuauucucgaagaaccagccgauagacacccgaaccggaaagcaaggggucaacugcgaacaaaaauagaaucaggccaagguacaauaccgguaagaucaaaugcuuccauucaaaccugggaugggguguuacaaggugaacgccuauuaacuaugagcugcucagauaaaauagcuagauggaaugucguggguauucaaggaagucuacuaaguauauuuguugaaccaauuuauuuuucuucaaucauccuaggaagccuauaccauggcgaucacuuaucacgagcaauguaccaacgaaucucgaauauagaagaccucccuccucuuuauaccuuaaauaaaccguuauuaucagguauuucaaaugcagaagcacgacaaccagggaaagcaccgaacuuuaguguuaauuggacgguaggugacucugcaauagaagucauaaaugcaaccacaggaaaagaugaauugggccgcgcaagcagacuaugcaaacaugcauuguacuguagauggaugagaguacacggaaaaguaccuagccaccuacuccgaagcaaaauaacaaaacccaacguauaccaugaaagcaaacuggccgcaaaggaauaccaagcggcuaaagccagauuauucacagcuuuuauaaaagcuggacugggggcuuggguagagaaaccaacagaacaagaucaauucucucuuaccuaa

SEQ ID NO: 11524 - RNA, 2862 nt, Artificial Sequence
  Cas13b variant__Alistipes sp.__WP_047447901.1__Cas13b
augaguaacgaaauaggagcauuuagggaacaucaauuugcuuacgcgccaggaaaugaaaaacaagaagaagcaacuuuugcuacuuauuuuaauuuagcucuuucaaauguagaaggaaugauguucggggaaguagaaucaaacccugacaaaauagaaaaaucacuggauacauugcccccagcgauauuaaggcaaauagcaaguuuuauauggcuuucgaaagaagaccauccagacaaagcauauuccacggaagagguaaaagucauugucacagaucuaguaagaagacucugcuucuacagaaauuauuucagucauugcuucuaccucgacacacaauauuuuuacucagacgagcuaguagauacuacugcgauaggugaaaagcuaccauacaauuuucaucacuucaucacuaauagauuauuuagauauucacucccagagaucacacuauuccgcuggaaugaaggcgaaagaaaauacgaaauuuuaagagacggguuaaucuucuucuguuguuuauucuuaaagaggggucaagccgaaagauucuuaaacgaauuaagauucuuuaaaagaacagacgaagaagggcgaauaaaaagaacaauauucacaaaauacugcacaagagaaagucauaaacacauaggaauagaagaacaagacuuuuuaauuuuucaagacauuaucggagacuuaaauagaguaccuaaaguuugugauggaguaguagauuuaucaaaagaaaaugaaagauacaucaaaaauagagaaacaagcaaugaauccgacgaaaauaaagcaagauacagauuacuuauaagagaaaaggauaaauuuccauacuaucucaugagauauaucguugacuuuggaguacuuccuuguaucacauucaaacaaaaugacuauucaaccaaagaaggaagaggacaguuccauuaccaagacgcugccguugcccaagaggaaagaugcuauaauuucgucguaagaaacgggaauguauacuauucauauaugccgcaagcccaaaaugucguaagaauauccgaauuacaaggcacaauuucaguugaagaacuacgcaauauggucuacgcaaguauuaaugggaaagauguuaauaaaucaguagaacaauauuuauaccauuuacaccuacuauaugagaaaauauuaacaauaagugggcaaacuauaaaagaaggucgcguagauguugaagacuacagaccacucuuagacaaauuauugcuacgaccagcuagcaauggagaagaacuaagacgagaauuaagaaaauuguuacccaaacguguuugcgaccuucuaucaaacagguucgauugcagugaagggguaucagcaguagagaaaagauuaaaagcaauacuacuaagacaugaacaauuacuacucucccaaaacccugcccuccacauugacaaaauuaaaagcgucauugauuaccuuuaccuauucuuuagugacgacgaaaaauucagacaacaacccaccgaaaaagcgcaccgaggauuaaaagacgaagaauuucaaauguaccacuaucuaguaggcgacuaugauagucauccacuggcuuuauggaaagaacuagaagcaucaggaagacuaaaaccugaaaugagaaaacuaacuagcgccacuagccuacauggauuauacauguuaugccuuaaaggaacuguagaauggugcagaaaacaacuaaugucgaucggaaaaggaacagcuaaaguagaagcgauugccgaucgaguaggguuaaaacuuuacgacaaauuaaaagaauauacaccagaacaauuagaaagagaaguuaaacuuguaguaaugcauggauaugcugcugcugccacuccaaaaccaaaagcacaggccgcaauacccagcaaacugacagaacuuagauuuuacuccuuucuugguaaaagagaaaugucguuugccgcauuuauaagacaagacaagaaagcacaaaaacuuugguuaagaaacuuuuacaccguagagaacaucaaaacuuuacagaaaagacaagccgcugcagacgcugccugcaagaaauuauacaacuuaguuggugaaguagaaaggguacauacuaacgacaaaguccucguauugguagcacaacgauauagagaaagauuacuaaacguaggaucaaagugugcaguaacgcuugacaauccugaaagacaacaaaaauuagcagauguauacgaaguacaaaacgcuugguuaucaauccgauucgaugaucucgauuucacacuuacacaugucaaucuaucaaacuuaagaaaagcguauaaccuuauaccaagaaaacauaucuuagccuuuaaagaguaucucgacaacagaguaaaacaaaaauuaugcgaagaaugucgcaauguaagaagaaaagaagaccuuugcacaugcuguucacccagguauucgaaccuaacgucaugguuaaaagaaaaucacagugagucaagcauagaaagagaagcagcgacuaugauguugcuugauguugaaagaaaauuacuauccuuucuacuagaugaaagaaggaaagcaauaauagaauacggaaaauuuauaccauuuucagcauuaguaaaagaauguaggcuugcagaugccggccuauguggaauaagaaaugauguacuacaugacaacguaaucagcuacgcagacgcaauuggaaaacuaucugcauauuuccccaaagaagcaagcgaagccguggaauacauuagaagaacaaaagaaguaagagaacaaagaagagaagaauuaauggcaaacuccucacaauaa

SEQ ID NO: 11525 - RNA, 3348 nt, Artificial Sequence
  Cas13b variant__Bacteroides pyogenes__ERI81700.1__Cas13b
auggaaaguauaaaaaacagccaaaaaaguacaggaaaaacuuuacaaaaagacccuccauacuucggucuuuacuuaaauauggcucuacuaaauguaaggaaaguugaaaaucacauaagaaaauggcuuggugauguggcccuuuuaccagaaaaaucaggcuuucauucccuucuuaccacagacaauuuaagcagugcaaaauggacccgauuuuacuacaaaaguagaaaauucuugccauuccucgaaauguuugacagcgauaaaaaaucguacgaaaauagaagggaaacaacugaaugcuuagacacaaucgacagacaaaaaauauccucauuacuaaaagaaguauacggaaaauuacaggacauaagaaacgcauucucacacuaccacauagaugaccaaucuguaaaacacacagcacuaauaaucagcuccgaaaugcaccgauucauagaaaacgcauauucauuugcacuacaaaaaacaagagcucgcuuuacaggaguauuugucgaaacagauuucuugcaggcagaagaaaaaggcgauaacaaaaaauucuucgcgauuggggguaacgaaggaaucaaauuaaaggauaacgcauuaauuuucuuaaucugucuauuuuuagaucgagaagaagcauucaaauuucuaagccgcgcaacugguuuuaaaaguacaaaagaaaagggauuucuugcuguaagggaaacauuuugcgcuuuauguuguagacaaccacaugaaagauuauuauccguaaauccucgugaagcacugcuuauggauaugcuuaacgaauuaaauagaugcccugacauacuauuugaaaugcuagacgagaaagaccaaaaaucauuuuuaccguuauuaggagaagaagaacaagcacacaucuuggaaaauucauuaaaugaugaauuaugugaagcaauagaugacccauucgagaugauagccagucuaucaaaaagagugcgauauaagaauagauuuccauauuuaauguuaagauauaucgaagaaaaaaauuuacugccauucauaagauucagaauagaucuaggaugcuuagaauuagcaagcuauccuaaaaaaaugggagaagaaaacaauuaugaacgcaguguaacagaucaugcuauggcauucggcagacuaacagauuuucauaaugaagaugcaguacuacaacagauaacaaaaggaauuacggaugaaguuagauuuagcuuauacgcgccuagauaugcaauauauaacaacaaaauagguuuuguacgaacuggaggguccgauaaaaucucauucccuacacuaaaaaaaaaagguggugaaggacauugcguagcuuacacccuacagaauacaaaaucauucggauuuauaaguauauaugaucuuagaaaaauacuauuacuaagcuuucuagauaaagauaaagcuaaaaauauagugucagguuuacuagaacaaugcgaaaaacauuggaaagaccucucagaaaaccuguucgaugcuauuagaacagaauuacaaaaagaguuuccuguaccauuaauaagguauacucuaccaagaucaaaaggaggaaaacuagucuccuccaagcuugcagacaaacaagaaaaauacgaaucugaauuugaaagaagaaaagaaaaauuaaccgaaaucuuaucagaaaaagauuuugauuuaucacaaauaccacgaagaaugauagacgaauggcucaauguauuacccacaagucgugaaaagaaauuaaaagguuacguagaaacacuaaaauuagacugcagagaaagauugcgaguauuugaaaaaagggaaaaaggcgaacaccccguucccccacgcauaggagaaauggcaacagaucucgcaaaagacauaauacgaaugguaauugaccaaggcguuaaacaaaggauaacuagcgcauauuacagugaaauccaacgaugccuagcgcaauaugcuggcgaugacaacagaaggcaucucgacuccaucauaagagaacucagacucaaagacacaaaaaauggacaccccuuucuagggaaaguucuaagacccgguuuaggacacacagagaaacuguaccaacguuauuucgaagaaaaaaaagaaugguuagaagcaacauuuuaucccgcagcauccccaaaaagaguaccucgauucgucaacccaccaaccggaaaacaaaaagaauuaccccucauaauaagaaauuuaaugaaagaaaggccagaauggagagauuggaaacaacgaaaaaauucucauccaaucgauuuacccagucaauuauucgaaaacgaaauaugucgacuacucaaggauaaaauaggaaaggaaccaucuggaaaacuaaaauggaaugaaauguucaaacuauauugggacaaagaauuuccaaacggcaugcagagauucuaccgaugcaaaagaagaguagaagucuucgacaaaguaguagaauacgaguacagcgaagaaggggguaauuacaaaaaauacuacgaagcuuuaauagaugaaguaguacgacaaaaaaucucaucaagcaaggaaaaaagcaaacuacaaguagaagaucucaccuuaucaguaagaagaguuuuuaaacgagcgauaaacgaaaaagaauaccaacuacgacuauuaugugaagaugacagauuacuauucauggcaguacgugaccuuuacgacuggaaagaagcacaacuggaccuagacaaaaucgacaauaugcuaggagagccugucuccguaucucaaguaauucaauuagaaggaggccagccggacgcaguaaucaaagcugaaugcaaacuuaaagacgugagcaaauuaaugcguuauuguuaugauggcaggguaaaaggacugaugcccuacuucgcgaaucaugaggcaacacaagaacaaguagaaauggaauuaagacauuaugaagaucauaggcgaagagucuucaacuggguuuuugcauuagaaaaaucaguacuaaaaaacgaaaagcuacgcagauucuacgaagaaucacagggaggaugugaacacagacguuguauagacgcauugagaaaagcaagucuaguaucggaagaagaauacgaguuuuuaguucacauacgcaacaaaagugcucacaaccaauuuccagaccuagagaucgguaaacuaccaccuaacguaacgaguggcuucugugaauguauauggucuaaauauaaagcaaucauaugcagaauaauaccauucauagaccccgagaggagauuuuucggaaaacuucuagagcaaaaauag

SEQ ID NO: 11526 - RNA, 3348 nt, Artificial Sequence
  Cas13b variant__Bacteroides pyogenes__WP_034542281.1__Cas13b
auggaaucaaucaaaaauucgcagaaaaguacaggaaaaacacuucaaaaagauccuccuuacuuuggacuauacuuaaacauggccuugcucaauguaagaaaaguagaaaaucauauacgaaaaugguuaggagacguagcccuacuucccgagaaaucaggauuucauucacuacuaacaacugacaaucuaagcagugcuaaauggacuagauucuauuauaaaagccguaaauuucuaccauuuuuagaaauguucgacucagauaagaaaucguacgagaaucggagagaaacagcagagugucuugauacaauagacagacagaaaauaaguaguuuacuuaaagaaguauacgggaaauuacaagacauacguaaugcguuuucucacuaucauauugacgaccaaagcguaaaacauacugcauuaauaauaaguucugaaaugcacagauucauagaaaaugccuauagcuucgcauuacagaaaaccagagcaagauucaccggaguauucguagaaacugacuuuuuacaagcugaagaaaaaggagacaauaagaaauucuuugccauuggagggaaugaaggaaucaaauuaaaagauaacgcauuaauauuuuuaauaugucuauuccuagaccgugaggaagcauucaaauuucucucuagagcuacaggcuuuaaaucaaccaaagaaaaaggauuccucgcaguaagagaaacuuucugugcucucuguugucgacaaccucaugaaagacuauuaagcgucaauccaagagaagcauuauuaauggacaugcuuaaugaacuaaauaggugcccagacauuuuauucgaaaugcuagacgaaaaagaccaaaagagcuuuuuaccuuuacuuggcgaagaggaacaagcucacauauuagaaaacagccuaaacgaugaacucugcgaagcgauagacgauccauucgaaaugauagcaucucuaaguaaacgcguucgguauaaaaaucgauuuccuuaucuaaugcuaagauauauagaagaaaagaaucuucugccauucauacgauuucgaauagaucuaggaugccucgaauuagcaucauauccuaaaaagaugggagaagaaaauaauuaugagagaucaguaacagaucaugcaauggcauuuggcagacuaacugacuuccacaaugaagaugcuguucuacaacaaauaaccaaaggaauaaccgaugaaguacgauuuucauuauacgcaccacgauacgcaauauauaauaacaaaauaggcuuuguaaggacaucugguucagauaaaauaucauucccaacccuuaaaaagaaaggcggugaaggccauugcguagccuauacacugcaaaauacaaaaaguuuuggauucauuagcauauaugacuuacgaaaaauauuacuuuuaaguuuucuagacaaagauaaagcgaaaaauauugucucagggcuucucgaacaaugcgaaaaacauuggaaagaucuaucagaaaauuuauucgacgccauccguacagagcuacaaaaagaguuccccguaccucuaauccgauauacccuuccucgcucaaaaggaggaaaacuuguaucuucaaaauuagcagauaaacaagaaaaauaugaaucagaguucgaacggcguaaagaaaaacuuacagaaauacucagugaaaaagauuuugaucuaucccaaaucccuagaagaaugauagacgaauggcuaaauguauuacccacaagucgagaaaagaaauuaaaaggauauguagaaacucucaaauuagacuguagagaaagauugcggguuuucgagaaaagagaaaaaggcgaacacccauuaccuccaagaaucggagaaauggcaacugaccuagcgaaagauaucauaagaauggucaucgaccaagguguaaaacaaaggauuacuucagcauacuauucagaaauacaaagaugccuggcacaauacgcaggagacgacaacagaagacaccuagacucaauaauacgagaauuaagauuaaaagacacuaaaaacggacauccauuucucgggaaaguauuaagaccuggacuaggacacacagaaaaacucuaucaaagauacuucgaagaaaagaaagaauggcuagaagccacguucuauccugcagcaagcccaaaaagagugccucgauucguaaacccacccacagggaaacaaaaagaauuacccuuaaucauacgaaaucuaaugaaagaacguccagaauggagggacuggaaacaaagaaagaauagccacccgauugaccuaccaagucaauuguucgaaaaugagauaugcagauuacuaaaagacaaaaucggaaaagaaccuaguggaaaauuaaaauggaacgaaauguuuaaacuuuacugggacaaagaauuuccuaacgguaugcaaagauuuuauagauguaaacgacgcguugaagucuucgacaaaguuguugaauaugaauauucagaggaaggaggaaauuacaagaaauauuacgaagcacuuaucgaugaaguaguacgacagaaaauaagcagcucaaaagagaaaaguaaauuacaaguugaagaucuaacacuuucagugcgcagagucuuuaaaagagcuauaaacgaaaaagaauaucaauuacgauuguuaugcgaagacgacagacuacuguuuauggcaguaagagacuuauaugacuggaaagaagcacaauuagauuuagauaaaauagauaacauguuaggagagccaguaucaguuucacaaguaauccagcuagaaggcggccaaccagacgccguaauaaaagcugaguguaaacucaaagacguaucuaaauuaaugcgauauugcuaugacggaagaguaaaaggccuaaugccauauuuugcuaaccaugaagcaacacaggaacagguugaaauggaacuaagacacuacgaagaucacagacgcagaguguuuaacuggguauucgcauuagagaaaagcgugcugaaaaaugaaaaacuaagaagauuuuaugaagaaagucaagguggaugcgaacauagaagauguaucgacgcgcucagaaaagcgucacucguuucugaagaagaauacgaauuuuuaguccacauccgaaauaaaagugcacacaaucaauucccagaccuugaaauaggcaaauuaccaccaaacgucacaucaggguuuugcgaguguauauggucgaaauauaaagcaauaauaugcagaauaauucccuuuauugauccagaaagaagauucuuuggaaagcuauuagaacaaaaguaa

SEQ ID NO: 11527 - RNA, 3675 nt, Artificial Sequence
  Cas13b variant__Bergeyella zoohelcum__WP_002664492.1__Cas13b
auggaaaauaaaaccucauuaggaaacaauauauacuacaaccccuucaaaccacaagacaaaucauacuucgccggauauuuuaacgcagccauggaaaauacggacucuguauuucgggaacugggcaaaagauuaaaaggaaaagaauauaccagcgaaaacuucuucgaugcgauauucaaagaaaauauaucuuuaguugaauaugaacgauacguaaaacuguuaagcgauuacuuccccauggccagauuauuagauaagaaagaaguaccaaucaaagaaagaaaagaaaacuuuaagaaaaacuucaaagguauuaucaaagcagugcgugauuuaagaaauuucuacacgcauaaagaacacggugaaguagaaauuacagaugaaauauucggaguacuagacgaaaugcuuaaaucuacaguacuaacagucaagaagaagaaaguuaaaacagauaaaaccaaagaaauacucaagaaaaguauagaaaaacaacuagauauauuaugucagaagaaacuagaauaucugcgagacacagcacgaaaaauagaagagaaaagaagaaaucaaagggaacgaggggaaaaagaacuugucgcaccauucaaauacucagacaaaagagacgaucuaauagcugcaauauacaaugacgcauucgauguauauaucgauaagaagaaagacuccuuaaaagaaucaucaaaagcaaaauacaacaccaaaagugauccacaacaagaagaaggugaucucaaaauaccaauaaguaaaaauggaguaguguuucuacucucacuauuucuaacuaaacaagaaauccaugccuucaaaucaaaaaucgcaggguucaaagcuacaguaauagacgaagcuacaguaucagaagccacaguaagccauggcaaaaacuccauauguuucauggcaacccaugaaaucuucucgcauuuggcuuauaagaaacuaaaaagaaaaguaagaaccgcagaaaucaacuacggagaagcagaaaacgcugaacaacuaucagucuaugcaaaagaaacacucaugaugcaaauguuagacgaacuaaguaaaguaccagacguaguauaucaaaauuuaucagaagacguacagaaaacauucauagaagacuggaaugaauaccuuaaagaaaacaauggagacguaggaaccauggaagaagaacaagugauccaucccguuauaaggaaacgguaugaagauaaauuuaauuauuuugcaaucagauuucuggacgaguucgcccaauucccaacacuaagauuccaaguacauuuaggaaacuaucuucacgacagcagacccaaagaaaaccuuauaucagacagacgaaucaaagagaaaauaacgguauucggaagacucucagaacuagaacauaagaaagcccuauucauuaaaaacacugaaacaaacgaggacagagaacacuauugggaaauauuuccaaacccuaauuacgacuuuccaaaagaaaacauaucaguaaacgacaaagacuuucccauagcaggaaguauauuagaccgagaaaaacagcccgucgcagggaaaauaggcauaaaaguaaaacuacugaaucaacaauacguaucagaaguggauaaagcagucaaagcacaccaauuaaaacaacgaaaggcuucaaaaccuagcauccaaaacauaaucgaagaaaucguaccaauaaaugaaagcaacccgaaagaagccauaguguucggaggccaaccaacggcauaccuuucaaugaaugauauucauucaauauuauacgaauuuuucgauaaaugggaaaagaagaaagaaaaacuugagaagaaaggcgaaaaagaauuacgaaaagaaauagguaaagaauuagagaagaaaauaguaggaaaaauucaagcacaaauacaacaaauaaucgauaaagauaccaacgcaaaaauacuuaaacccuaccaagauggcaacuccacagccauagacaaagaaaaauugauaaaagauuugaaacaagaacaaaacauccuucaaaaauugaaagaugaacaaacggucagagaaaaagaauauaacgacuucauagcauaccaagacaaaaauagagaaauaaacaaagucagggacagaaaccauaaacaauauuuaaaagacaauuuaaaaagaaaauauccagaagcaccagccaggaaagaaguccuauacuacagagaaaaaggcaaaguagcaguauggcuagcaaacgacauaaaaagguucaugccaaccgauuuuaaaaacgaauggaaaggugaacaacauucacuacuacagaaaagccucgccuacuacgaacaaugcaaagaagaacucaaaaaucuuuuaccagaaaaagucuuccaacacuuaccauuuaaauuaggaggauauuuucaacaaaaauauuuauaccaauuuuacacaugcuaccuagacaaacggcuagaauacauaucaggauugguucaacaagcagaaaauuucaaaagugaaaauaaaguuuuuaaaaagguagaaaacgaaugcuuuaaauuccucaagaaacaaaacuauacucacaaagaauuggacgcaaggguucaaucaaucuuaggguaccccaucuuuuuagaaagaggcuucauggacgaaaagccaacaauuauuaaagggaaaacauucaaagguaaugaagcccuauucgcagauugguuuagguauuacaaagaauaccaaaauuuccaaacauuuuacgacacggaaaacuacccucugguagaacuagagaagaaacaagcagauagaaaaagaaaaaccaaaauauaucaacagaagaaaaaugacguauuuacgcuccugauggcaaaacacauauuuaaaagcguauuuaaacaagacucaauagaccaauuuucacuagaagauuuauaccagucucgagaagaaagguuagguaaccaagaaagagcucgacaaacgggggaacgaaauacgaauuacauuuggaauaaaaccguagaccuaaaguugugcgacggaaaaauaaccguagaaaacguaaaacuuaaaaauguaggcgacuucauaaaauaugaauacgaccaacguguucaggcuuuucuaaaauacgaagaaaauauagaguggcaagcauuucuuauaaaagaaucuaaagaagaagaaaacuacccauacguaguagaaagagaaaucgaacaguaugaaaaaguacguagagaagaguugcugaaggaaguccacuuaauagaagaauauauacuggaaaaaguuaaagacaaagaaauccuaaagaaaggugauaaccaaaauuuuaaauauuacauauuaaacggccuacuaaaacaacuaaagaaugaggaugucgaaaguuauaaaguguuuaaccuaaacacagaaccagaagaugugaacauuaaucaauuaaaacaagaagccacagaccuugaacaaaaagcauucguauuaacuuauaucaggaauaaauuugcccacaaccaacucccaaagaaagaauuuugggauuacugccaagaaaaauauggcaaaauagagaaagagaaaacauacgcagaguacuucgcagagguuuucaagaaagaaaaagaagcacuaauaaaauaa

SEQ ID NO: 11528 - RNA, 3600 nt, Artificial Sequence
  Cas13b variant__Capnocytophaga canimorsus__WP_013997271.1__Cas13b
augaagaacauacaacguuuaggaaaaggcaaugaauucaguccauucaaaaaagaagauaaauucuacuuuggagguuuucucaaucuugcuaauaauaacaucgaagauuucuucaaagagauuauaacacgauucggcauaguaaucacugacgaaaauaaaaaaccaaaagaaacuuuuggagagaaaauucuaaacgaaauuuucaaaaaagauauaucaauagucgacuacgaaaaauggguaaacauuuuugccgacuacuucccauucacaaaauauuuaucacuuuauuuagaagagaugcaauucaaaaaccgaguaauauguuuuagagauguaaugaaagaacuacucaagacaguggaagcacuacgaaacuuuuacacacacuaugaccacgaacccauuaagauagaagauagaguauucuacuuccucgacaagguccuauuagacguaucccucacaguaaaaaauaaauaccugaagacagauaagacaaaagaauuccuaaaucaacauauaggagaggaacugaaagaacucuguaaacaaagaaaggacuaucuagucggaaaaggcaaacguauagacaaggaauccgaaauaauaaacggaauauacaacaacgccuuuaaagauuuuauuugcaaaagagaaaaacaagaugacaaagaaaaccauaacucagucgagaaaauacuuugcaauaaagaaccacaaaauaaaaaacaaaaaagcucggcuacgguaugggaacucuguucaaaaaguuccagcaaauacacagaaaaaagcuuccccaauagagaaaaugauaaacacugccuagagguaccaauuagccaaaaaggcauaguauuucuuuuaucauuuuuucuuaacaaaggcgaaauauaugcccucacuaguaauaucaaaggguuuaaagcaaagauaacuaaagaagaaccagucacauaugacaaaaauagcauacgauacauggcgacccauagaauguuuaguuuuuuagcuuacaaaggucugaagcguaaaauaagaacuagugaaauaaacuacaaugaagauggucaagcuucuucaaccuacgaaaaagagacacuaauguuacagaugcuagaugaauuaaacaagguaccugacgucguauaccaaaaccuaagugaagacguacagaaaaccuucauugaagacuggaacgaauaucugaaagaaaauaacggagacgucggaacaauggaagaagaacaagugauucauccuguuauaagaaaaagauaugaagauaaguucaacuauuuugcgaucagauuccuugaugaauucgcacaauucccaacacugcgcuuccaaguccaucuuggaaacuaccuaugcgauaaaagaacgaaacaaauaugcgauacaaccacugagagagaagugaaaaaaaaaauaaccguauuuggacgucuaagcgaauuggaaaauaaaaaggcaauauucuuaaacgaaagagaagaaauuaaaggaugggaagucuuccccaacccaucauaugacuucccaaaagaaaacauaagcguaaacuacaaagauuucccuauagucggaaguauccucgaccgagaaaaacaaccaguuagcaacaaaauaggaauaagaguaaagaucgcagacgaauuacaaagagaaauagacaaagccauuaaggaaaaaaagcucagaaacccaaaaaaccgcaaagcaaaucaagacgaaaagcaaaaagagagauuaguaaacgaaauagugucaaccaauucaaacgaacaaggugaacccgucguauucauugggcaaccaacagccuaucuuuccaugaacgacauacacucaguguuauacgaauuccuaauaaacaagauaucaggcgaagcauuagaaacgaaaauaguagagaaaauagaaacacagauaaaacaaauaaucgggaaagaugcaacaacaaaaaucuuaaaaccauacacaaacgcaaauaguaacagcauaaacagagaaaaacuauuacgcgaccuagaacaagaacaacaaauacuaaaaacacuauuagaggaacaacaacaaagggaaaaggauaaaaaagacaaaaaaagcaaaagaaaacacgaacuauacccaucggaaaaaggaaaaguagcaguauggcuagccaacgacauaaaaagauucaugccaaaagcauuuaaagaacaguggcgaggguaucaccacagccugcugcaaaaauaccuugcauauuacgaacaaagcaaagaagaacuaaaaaacuuauuacccaaggaaguauucaaacacuucccauucaaacuaaaagguuacuuccaacaacaauacuugaaccaauuuuauacagacuacuuaaaaagaaggcuuagcuauguaaacgaacugcuacuaaauauucaaaacuucaaaaacgacaaagaugcucuaaaagcuacugaaaaagaauguuucaaauucuuuagaaaacaaaacuacauuauaaauccgauaaauauacaaauacaaaguauacuaguauacccaauauuccuaaaaagaggauuccuagacgaaaaaccaacaaugauagaucgcgaaaaauucaaagaaaacaaggacaccgaauuagccgauugguuuaugcacuacaaaaacuauaaagaagacaacuaucaaaaauucuacgccuacccacuggaaaagguagaagaaaaagaaaaauucaaaagaaacaaacaaauaaauaaacaaaagaaaaacgacguauacacauuaaugauggucgaguacaucauucaaaaaaucuuuggagauaaguucguugaagaaaacccauuaguucuaaaaggaaucuuucaauccaaagcugagcgacaacaaaacaacacucacgcagcaaccacccaagaaagaaaucuaaauggaauauuaaaucaaccuaaagacauuaaaauucaaggcaaaauuacagucaaggguguuaaacucaaagauaucggcaacuuccgaaaauacgaaauagaccaacgagucaauacauuccuagauuacgaaccacguaaagaauggauggcauacuuacccaacgacuggaaagaaaaagaaaaacaaggacaauuaccaccuaauaacgugauugauaggcaaauaaguaaauaugaaaccgucaggucaaaaauuuuacuaaaagacguacaagaauuagaaaaaauaauuagugaugaaaucaaagaagaacacagacaugaucuuaaacagggaaaauacuacaacuuuaaauauuauauacuaaauggacuacucagacaauuaaaaaacgaaaauguagaaaacuacaaagucuuuaaauuaaacacaaauccagaaaaagugaauauaacacaacucaaacaggaagcaacugaccuugagcagaaagcuuuuguacuaacauauauaagaaacaaauuugcacacaaccaauuaccaaaaaaagaguucugggacuauugccaagagaaguaugguaaaaucgaaaaagaaaaaacauacgcagaauauuuugcagaaguauucaaaagagaaaaagaagcucuaaucaaauaa

SEQ ID NO: 11529 - RNA, 3657 nt, Artificial Sequence
  Cas13b variant__Capnocytophaga cynodegmi__WP_041989581.1__Cas13b
auggaaaauaaaaccagcuuagguaacaauauauacuacaaccccuuuaaaccgcaagacaagucguacuucgcagguuacuuaaaugcagcaauggaaaacauugauucaguauuucgugaauuagguaaaagacuuaaaggaaaagaauauacaucagaaaacuucuucgacgcuauauuuaaagaaaauauuagcuugguagaauaugaaagauacguuaaacuguuaucugauuacuucccgauggcaagauuacuagacaagaaagaaguaccgauaaaagaacgaaaagaaaacuucaagaaaaacuuuaggggaauaauaaaagcgguacgagacuuacgaaacuuuuacacacacaaagaacauggagaagucgaaauaacggacgaaauauucggaguauuagacgaaaugcuuaaaaguacaguauugacaguuaagaagaagaaaauaaaaacagacaaaacaaaagaaauucugaagaaaagcaucgaaaaacaacuagacauacuaugccagaagaaacuagaauaccucaaagauacagcacggaaaauagaagagaaaagaagaaaucaaagagaacgaggcgagaagaaacucguacccagauucgaauauuccgacagaagagaugaucuaauagccgccauuuacaacgacgccuuugauguauacaucgacaagaagaaagacucccugaaagaaaguuccaaaaccaaauauaauacggaaaguuauccacaacaagaagaaggugauuugaaaauaccuauuaguaaaaacggaguuguauuccuacuaagccuauuccucaguaaacaagaaguacacgccuucaaaucaaaaauagcgggauucaaagcuacgguaauagacgaagcuacggugucacaccgcaaaaauucaauaugcuucauggccacacacgaaauauucucccaccucgcauacaagaaacuaaaaagaaaaguaagaacugcugaaaucaauuacuccgaagccgaaaaugcugaacaacuaaguauauaugcuaaagaaacucuaaugaugcaaauguuagaugaacuaagcaaaguaccggauguaguguaucaaaacuuaagcgaagacguacagaaaacauuuauagaagauuggaaugaauauuuaaaagaaaacaacggugauguggguacaauggaagaagaacaaguaauacacccagucauaagaaaaagauacgaagauaaauucaacuacuuugcaauaagguucuuagacgaguucgcacaauucccaacgcuaagauuccaaguucaucuaggaaacuaucuacacgacucacguccaaaagaacaucuaaucucagaccgacgcauaaaagaaaagauaacaguauucgggcgacugucagaacuggaacacaagaaagccuuauucaucaaaaacacugaaacaaacgaagacagaaaacacuauugggaaguauucccaaauccuaauuaugacuuuccaaaagaaaacauuagcguaaacgacaaagauuucccaauagcaggaucgauauuagacagagaaaaacagccuacugcuggaaaaaucggaauaaaagucaauuuacuaaaccaaaaauacauaucagaaguagacaaagccguuaaagcacaccaauuaaaacaacgcaacaacaaaccuagcauacaaaauauaauagaagaaauaguccccauaaacgggagcaacccaaaagaaaucauagucuuuggaggccaaccaaccgcauauuuaucaaugaacgacauacauaguauacucuaugaauuuuucgauaaaugggagaaaaagaaagaaaaacuggagaagaaaggagaaaaagaauuaagaaaagaaauaggaaaagaacuugaagagaaaauuguaggcaaaauacaaacccaaauacaacaaaucaucgacaaagacauuaaugcaaaaauucucaaaccauaucaagaugacgacucaacagccauagacaaagaaaaauugaucaaagaccuuaaacaagagcagaaaauauugcaaaaacugaaaaacgaacaaaccgcacgagaaaaagaauaucaagaaugcauugccuaucaagaagaaucuaggaaaauaaaaagauccgauaaauccaggcaaaaauaccuaagaaaucaacuaaaacguaaauaucccgaaguacccacaagaaaagaaauacuauacuaucaagaaaaaggaaaaguagcaguauggcucgcaaaugacauaaaacgauuuaugccaacugacuuuaaaaaugaauggaaaggagaacaacauucccuccuccagaaaagccuagcguauuaugaacaaugcaaagaagaacuuaaaaaccuguuaccucagcaaaaaguauuuaaacaccuaccauuugagcuuggagggcauuuucaacaaaaauaucucuaucaauuuuacacacgauaccuggacaaaagacuagaacacauauccggauuaguacaacaagcagaaaacuucaaaaacgaaaacaaaguauucaagaaagucgaaaaugaaugcuuuaaauuccuaaagaaacaaaacuacacacacaaaggccuagaugcccaagcucaaucgguucucggauaucccaucuuccuagaacgaggauucauggaugaaaaaccaacuauaaucaaaggaaaaaccuucaaaggaaacgaaagucucuucacagacugguucagauacuacaaagaauaccaaaauuuccaaacauuuuaugacacagaaaacuauccauuaguugaacuggagaagaaacaagcagaccgaaaaagagaaacaaaaauauaccaacagaagaaaaaugaugucuuuacacugcuaauggcaaaacacauuuuuaaauccguauuuaaacaagacucgauugaucguuucaguuuagaagauuuauaccaaucaagagaagaaagauuggaaaaccaagaaaaagcuaaacaaacaggcgaaagaaacacaaauuacauauggaacaaaacaguagaucuaaaccuaugugaugguaaaguaacuguagaaaauguaaaacugaaaaauguuggaaauuucaucaaauacgaauacgaucagagaguucagacuuuucuaaaauaugaagaaaauaucaaauggcaagcauuccucauaaaagaguccaaagaagaagaaaauuacccuuauauuguagaacgugaaauugaacaguacgaaaaaguaaggagggaagaacuacucaaagaaguucaucuaauugaagaguacauacuagaaaaagucaaagauaaagaaauccucaagaaaggagauaaucaaaacuucaaauauuacauacuaaacggacuacuuaaacaacugaaaaacgaagacgucgaaucuuauaaaguauucaaucuaaauacuaaacccgaagauguaaauauaaaucaacuaaagcaagaagccaccgaccuagaacaaaaagccuuuguauuaaccuacaucagaaacaaauucgcccauaaccaacuaccaaagaaagaguucugggauuacugucaagaaaaauauggaaaaaucgaaaaagagaaaacauacgcagaguauuucgccgaaguauuuaaaagagagaaggaagcauugaugaaauaa

SEQ ID NO: 11530 - RNA, 3438 nt, Artificial Sequence
  Cas13b variant__Chryseobacterium sp.__WP_047431796.1__Cas13b
auggaaacacaaacaaucggucacggcauugcauacgaucacucuaaaauccaagauaaacauuucuuuggaggcuuucuaaaucuagccgaaaauaauauuaaagcgguacuaaaggcuuucucggaaaaauucaaugucggcaacguugacgucaaacaguuugcagacguaaguuuaaaagacaaccuuccagacaaugauuuccagaaaagaguaucauuccuaaaaauguacuucccgguaguagacuuuauaaacaucccaaauaauagagcaaaauuccgaucagaccuuacaacauuauucaaaucuguagaccaacuuagaaauuuuuauacacacuauuaccacaaaccauuagauuuugacgcaucacuuuuuauacuauuggacgauauuuuugcaagaaccgccaaagagguacgggaucagaaaaugaaagacgacaaaacacgccaauuauugucaaaaucacucucagaagaacuucaaaaaggcuacgaacuacaauuagaacgucuuaaagaacuaaacagacucggaaagaaagugaauauacaugaucaauuaggaauuaaaaacgguguuuugaacaacgcauuuaaucaccuaauauacaaagacggugaaucauucaaaaccaaacuaacauacucuucagcauuaacaucguuugaaucagcugagaacgggauugaaauuucccaaucaggacuacucuucuuauuaucaauguucuuaaaaagaaaagaaaucgaagacuugaaaaaucguaauaaaggauucaaagccaaaguugugauagacgaagacggcaaagugaacggucucaaauucauggccacgcacuggguuuucucauacuuauguuuuaaaggcuuaaaaucaaaauuaagcacagaauuucacgaagaaacccuacuaauucaaauuaucgacgaguuaucaaaaguccccgacgaguuauauugugcuuucgacaaagaaacuagagacaaauuuauagaagacauaaacgaguauguuaaagaaggacaucaagauuucucacuggaagaugcaaaaguaauacacccagucauaagaaaacgauacgaaaauaaauuuaauuacuuugcaauuagauuucuagacgaauuuguaaaauuuccgagccuaagauuucaaguacacguaggaaauuauguccacgauaggagaauuaaaaauauagacgguaccaccuuugaaacagagagaguuguaaaagacagaauaaaaguauucggcagauuaucagaaauaagcucauauaaagcacaauacuuaucuucaguaagcgacaaacacgacgaaacuggaugggaaauauuuccaaauccgaguuauguauucauaaacaacaauauccccauacauauuucaguagauacaucauuuaagaaagaaauugcagauuucaagaaauuacggagagcccaaguucccgacgaacugaaaauaagaggcgcagaaaagaaaaggaaauuugaaaucacacaaaugaucggcucuaaauccguccucaaucaagaagaaccuauugcacuacucagccuaaacgaaauaccagcacuauuauacgaaauacuaauaaacggaaaagaacccgcagaaaucgagcgaauuaucaaagacaaauuaaacgaaagacaagauguaauuaaaaacuacaacccagaaaacugguuaccagcaucgcaaauaucucgcagacugcguaguaacaagggcgaaagaauaauuaauacagacaaauuauuacagcuagucaccaaagaauuacuuguaacugaacaaaaacuaaagauuauaucagauaacagagaagcacuaaaacaaaagaaagaggggaaauauauaagaaaguucauauuuacaaacucagaacuaggaagagaagccauaugguuagcggacgacauaaaaagauuuaugccggcagacguaagaaaagaauggaaagguuaccaacauagccaacuacaacaaucucuagcauucuacaacucccgcccaaaagaagcccuagcaauuuuagaaucaagcuggaaucuaaaagaugagaaaaucauuuggaacgaauggauacuuaaaaguuuuacacaaaacaaauucuuugaugcuuuuuauaaugaauauuuaaaaggccgcaagaaauacuuugccuuucuaagcgagcacauuguacaauacacuagcaacgccaaaaaucuccaaaaauuuauuaaacaacaaaugccuaaagacuuguucgaaaagagacauuauauuauagaagacuuacaaacagagaaaaacaaaaucuuaucaaaaccauuuauauuuccacgaggaauauucgacaagaaaccuacuuuuaucaaaggaguaaaaguagaagauagcccagaauccuuugcgaacugguaucaauacggcuaccaaaaagaucaccaauuucaaaaauucuaugacuggaaacgugauuacuccgacguauuccucgaacauuuaggaaaaccauucauaaacaauggugaccgacggacccuaggcauggaagaauugaaagaaagaauaauaaucaaacaagauuuaaaaauaaagaaaauaaaaauacaagacuuauuuuuaagauuaauagcagaaaaucucuuucaaaaaguauucaaauacucagcaaaacuaccucuaucggauuucuacuuaacccaagaagaaagaauggaaaaagaaaacauggcagcccuacaaaauguacgagaagaaggcgacaaaucuccaaacaucauaaaagauaacuucauauggucaaaaaugauaccauauaagaaaggacaaaucauagaaaaugccgucaaacuaaaagauauaggaaaauuaaacguccuaucacuagacgacaaaguccaaacauuacugucuuacgacgacgcuaaaccauggucaaaaaucgccuuagaaaaugaguucucaauaggagaaaacaguuacgaaguaauaagacgcgaaaaacuguucaaagaaauacaacaauucgaaucagaaauacuauuuagaucuggcugggacggaauuaaucacccagcccaacucgaagacaaccgcaaccccaaauuuaaaauguacaucgucaacgggauucuaagaaaaucagcgggguuauacucacagggagaagauauaugguuugaauacaaugccgacuuuaauaaccuagacgcagacguauuagaaacaaaaucagaauuaguccaacuagccuucuuaguaacggcaauccgcaauaaauuugcgcacaaccaauuaccagcaaaagaauuuuacuuuuauauacgagccaaauauggauucgcagacgaaccaagcgucgcuuuaguauaccuaaauuucacaaaauaugcaaucaaugaguucaagaaaguaaugauauaa

SEQ ID NO: 11531 - RNA, 3453 nt, Artificial Sequence
  Cas13b variant__Flavobacterium branchiophilum__WP_014084666.1__Cas13b
auggaaaacuuaaauaaaauccuagauaaagaaaaugaaauuugcauaagcaaaauauucaacacaaaaggaauagcagcacccauaaccgagaaagcccucgacaauauaaaaucaaaacaaaaaaacgaccuaaacaaagaagcaagacuucacuacuucucaauaggccacagcuucaaacaaauugacacaaaaaaagucuuugacuauguucuaaucgaagagcucaaagaugaaaagccauuaaaguucauaacacuacaaaaagauuucuuuacuaaagaguucucuauaaaacuacaaaaacucaucaacuccauacggaacaucaauaaccacuauguucacaacuuuaacgacaucaacuuaaauaaaauagacucaaauguuuuccauuucuuaaaagaaucauucgaauuagcaauaauagagaaauacuacaaagucaacaaaaaauacccacuagauaaugaaaucguacuauuccucaaggaacuauuuauaaaagacgaaaacacugcacuacuaaacuauuucacaaaccucagcaaagacgaagccauagaauacaucuuaacauucacaauaacagaaaacaaaauauggaacauaaacaacgaacacaacaucuuaaacauagaaaaaggcaaauaccuuaccuucgaagcaauguuauuccuaauaaccauauuccucuauaaaaacgaagcuaaucaucuacuaccuaaacucuacgauuuuaaaaacaacaaauccaagcaagaacuauucacuuucuuuucuaaaaaguuuaccucacaagacauagacgcugaagaaggucauuuaauaaaguuuagagauaugauucaguauuugaaccacuauccaaccgcauggaacaaugaccuaaaacuagaaucugagaauaaaaauaaaauaaugacaacaaaacucauagacucaauaauagaguuugaacuaaacuccaacuaccccucauuugcgacggacauacaauucaagaaagaagcaaaggcauuccuauuugccagcaauaaaaaaagaaaccaaaccuccuucucaaacaaauccuacaacgaagaaauccgacacaacccacacauuaaacaauacagagacgaaauagccagcgcuuuaacuccaauauccuuuaacguuaaagaggacaaauucaaaauauucguaaaaaagcauguucuagaagaauacuuccccaauucaaucggcuacgaaaaguuccuugaauacaacgauuuuacagaaaaagaaaaagaggacuucggacuaaaacuuuacaguaaccccaaaaccaauaaacuaauugaaagaaucgacaaucauaaauuagucaaaucccacggaagaaaccaagaucgcuucauggacuucaguaugagauuccucgccgaaaacaacuauuucggaaaagaugcuuuuuuuaaauguuauaaauucuacgacacccaagaacaagacgaauuucuucaaucuaaugaaaauaacgacgacgucaaauuccauaaagguaaaguaaccaccuacauuaaauaugaagaacaccuaaaaaacuacucauacugggacuguccauucguugaagaaaacaacaguaugagcguuaaaauaucaaucggaucagaggaaaaaauccuaaaaauacaaagaaaccuaaugaucuauuuucucgaaaacgcacucuacaacgaaaacgucgaaaaucaaggauacaaacucgucaacaacuacuaucgcgaacuaaaaaaagacgucgaagaaagcauagcaagccuggaucuuauaaaauccaauccugacuucaaaucaaaauacaaaaaaauacuaccaaaacgauuacuccacaauuacgcccccgcaaaacaagacaaagcaccagaaaacgcauuugaaacccuuuuaaaaaaagcagacuuccgcgaggaacaguauaaaaaacuguuaaagaaagccgaacacgaaaagaacaaagaagacuucguuaaaagaaacaaagguaaacaauuuaaacuccacuuuauacgaaaagccugccaaaugauguacuucaaagagaaauauaacacacuaaaagaagguaacgcagcauucgaaaaaaaagacccuguaaucgaaaaaagaaaaaacaaagaacacgaauuuggacaccacaagaacuuaaacauaacacgugaagaauuuaacgauuacuguaaauggauguucgcguuuaauggcaaugacagcuauaaaaaauaccuaagagaucuauucuccgaaaaacacuucuucgacaaccaagaauacaaaaaucucuucgaguccagcguaaaccucgaagcauucuacgcaaaaacaaaagaacuauucaaaaaauggauugaaaccaauaaaccgacuaauaacgaaaauagauacacauuagagaacuacaaaaaccuaauacuccagaaacaaguauucauaaauguauaucacuucaguaaauaccuuauagauaaaaaccuccuuaacucagaaaacaauguaauacaauauaaaucgcuagaaaaugucgaauaccuaauaucagacuucuacuuccaaucaaaacuaucaauagaucaguauaaaacaugcggaaaacuauucaauaaacuaaaauccaacaaacuggaagauugccuacuauacgaaauagcauacaauuauauugauaaaaaaaacguccauaagaucgacauacaaaaaauucuuacaaguaaaaucauacuuaccauaaaugacgcaaauacacccuauaaaauauccguuccauucaacaaacucgaacgauacacagaaaugauagcaaucaagaaucaaaacaaucucaaagcacgauuucuaauagacuuaccacuauacuuaucuaaaaacaaaauaaagaaaggaaaagacuccgcgggcuacgaaauaauuauaaaaaacgaccucgaaauugaagauaucaauacaauuaauaacaaaaucauaaacgacagugucaaauucacugaaguacucauggaauuagaaaaauacuucauucugaaagacaaguguauccucucaaaaaauuacauagacaauagugaaauccccucauuaaagcaauucuccaaagucuggauaaaagaaaacgaaaacgaaauaauaaacuaccgaaauauugcaugccauuuucacuuaccacuccucgaaacuuucgauaauuugcuacuaaacguagaacaaaaauucaucaaagaagaguugcaaaacguuucaacaauaaacgauuuaucaaaaccccaagaauaccuaauccuccucuuuauaaaauucaagcacaacaauuucuaccucaacuuauucaacaaaaacgaaaguaaaaccauuaaaaacgacaaagaaguaaaaaaaaaccgaguuuuacaaaaauucauaaaccaagucauacuaaagaaaaaauaa

SEQ ID NO: 11532 - RNA, 3642 nt, Artificial Sequence
  Cas13b variant__Flavobacterium columnare__WP_060381855.1__Cas13b
augaguagcaaaaacgaaaguuacaacaaacaaaagacuuucaaucacuauaaacaagaagauaaauacuucuucggcggcuucuuaaacaaugcagaugacaacuuacgccaaguaggcaaagaauuuaaaacccgcauaaauuucaaucauaacaauaaugaacuagcaagcguuuuuaaagauuacuucaacaaggaaaaaagcguggcuaaaagagaacaugcucucaaucuacuaagcaacuacuucccgguacuagaaagaauccaaaaacauaccaaucacaacuucgaacaaacgagagagauauucgaauuacuauuagacacuauaaaaaaacuaagagauuauuauacccaucauuaucacaaaccaauuacaaucaacccgaaaguauacgacuuucuagaugauacccuacucgacguucuaauuacaauaaaaaagaaaaaaguaaaaaaugacacaucccgcgaacucuuaaaagaaaaguucagaccagaacuaacacaacuaaagaaucaaaaaagagaagaacugaucaaaaaaggcaagaaacuacuagaagaaaaucucgaaaacgccguauuuaaucacugucuacgccccuuccuagaagaaaacaaaacugacgacaaacaaaauaaaacaguaucauugcgaaaauaucgaaaaucgaaaccaaacgaagagacgucaauaaccuuaacccaaagugggcuuguauucuuaaucucauuuuuccuccacagaaaagaauuccagguauucacaucaggccucgaaggauucaaagcaaagguaaacacaauaaaagaagaggaaauaucauuaaacaaaaauaacaucgucuacaugauaacacacuggucuuauagcuauuauaauuucaaaggccuuaaacauaggauaaaaacagaccaaggaguauccacacuagaacagaacaacaccacccacuccuuaaccaauacaaacaccaaagaagcacucuuaacccaaauagucgauuaccucucgaaagucccaaaugaaauauacgaaacacuguccgaaaaacaacaaaaagaauuugaagaagacauaaaugaauacaugcgggaaaaucccgaaaacgaagacucaacuuucucaucaauaguaucacacaaagugauacgaaaacgguacgaaaacaaauuuaacuacuucgcaaugcgcuuccuagaugaguacgccgaacucccuacacuucgguucaugguaaacuucggagauuacauaaaagauagacaaaaaaaaauacuagaguccauucaauucgauucggaacggauaauuaaaaaagaaauacacuuauucgaaaaacuaggacuagucaccgaguacaaaaaaaacguguaucuaaaagaaacauccaacauagaucucucuagauuuccccuauucccuagcccaucuuacguaauggcgaacaauaacauacccuuuuacaucgauucccgaucaaacaacuuggacgaauauuuaaaccaaaaaaaaaaggcccaaucccaaaaccgcaaacgaaaccuaacauuugaaaaauacaacaaagaacaaagcaaagaugcaauaaucgcaaugcuacaaaaagaaauagguguaaaagaccuccaacaacgcuccaccauaggacuacuaaguugcaacgaauuaccuagcaugcuauacgaaguaaucgucaaagacauaaaaggggcagaauuagaaaacaaaauugcacaaaaaaucagggaacaauaccaaucaauacgagacuuuacauuagauuccccacaaaaagacaacaucccuaccaccuuaaccaagacaaucaguacugacacaagcguaaccuucgaaaaucaaccaauugauaucccaaggcuaaaaaaugcccuacaaaaagaacuaacccuaacacaagaaaaacuacuuaacgucaaacaacacgaaauagaaguagauaacuacaacagaaauaaaaacacauacaaauucaaaaaccaaccaaaagacaaaguagacgauaauaaauugcaaagaaaauaugucuuuuacagaaaugaaaucgggcaagaagccaacuggcuugcuagcgaccuaauccauuuuaugaaaaauaaaagcuuauggaaaggcuauaugcacaacgaacuucaaucauuccuagcguuuuucgaagauaaaaaaaacgacugcauagcucuccucgaaaccguuuucaaccucaaagaagacugcauauuaaccaaagaucucaaaaaccucuuucucaaacauggaaacuuuauugacuucuacaaagaauaucuaaaacuaaaagaagauuuucuaaauaccgaaagcaccuucuuagaaaacgguuucaucggguuaccacccaaaaucuuaaaaaaagaacugucaaaacgacuaaacuauauauucauaguauuccaaaaacgacaauuuauaauaaaagaacucgaagaaaaaaaaaauaaccuauacgcggacgcaaucaaccuaucaagaggcauauuugacgaaaaacccacaaugaucccauucaaaaaaccaaacccagacgaauucgccagcugguuuguagcauccuaccaauacaauaacuaucaauccuucuacgaacuaacaccugauaaaauugagaacgauaaaaaaaaaaaauauaaaaaccucagagccauuaacaaaguaaaaauacaagauuauuaccucaaacucaugguagauacccuauaucaagaccucuucaaccaaccacucgauaaaucuuuaucugacuuuuacguaucaaaaacagacagagaaaaaauaaaagcagacgcaaaagccuaucaaaaacgaaaugacucauuccuauggaauaaaguaauacaccuaucucuccagaacaacagaauuaccgcuaauccuaaauuaaaagauauaggcaaauacaaacgcgcacuacaagacgagaaaauugcaacacuauuaacguacgaugaucgaacuuggacauacgcacuacaaaaacccgaaaaagaaaacgaaaaugacuacaaagaacuacacuacacugcauuaaauauggaacuucaagaguaugaaaaaguacgaucgaaaaaacuccuaaaacaaguucaagaauuagagaaacaaauacuggacaaguuuuacgauuuuucaaacaacgcuacacacccagaagaccucgaaauagaagacaaaaaaggaaaaagacaccccaauuucaaguuauacauaacaaaggcauuacuaaaaaacgaaagcgaaauaaucaacuuagaaaauauagacaucgaaaucuuaaucaaauacuaugacuauaacaccgaaaaacuaaaagagaaaaucaaaaacauggacgaagaugagaaagccaagauuguuaacacaaaggaaaacuacaauaaaaucacuaacguacuaauaaaaaaggcacuaguauuaauaauaauaagaaacaaaauggcucacaaccaauacccacccaaauucauauacgauuuagccacacgcuucguccccaaaaaagaagaagaauacuuugcuuguuacuucaaccgugucuuugaaaccauaacaacugaguuaugggaaaacaaaaaaaaagcaaaagaaauaguauga

SEQ ID NO: 11533 - RNA, 3540 nt, Artificial Sequence
  Cas13b variant__Flavobacterium columnare__WP_014165541.1__Cas13b
augagcuccaaaaaugaaaguuacaacaaacagaaaacauucaaccacuacaaacaggaagauaaauacuuuuucggaggcuuccucaauaaugcagaugacaaucuccgacaaguagggaaagaauuuaaaacaagaauaaacuucaaccauaacaacaacgaacuagccagugucuuuaaagacuacuuuaacaaagagaagucagucgcaaaacgcgaacacgcacucaaucuacuaucaaauuauuucccugugcuggaaagaauacaaaagcacacgaaccacaacuucgaacaaacgagagaaauauucgaauuacuacuagacaccauaaaaaaacuaagagacuacuauacgcaucauuaccauaaaccaaucacuauuaacccaaaaauuuacgacuucuuagacgacacacuacucgacguucuuaucacaauaaaaaaaaaaaaagucaaaaacgacaccagcagagaacucuuaaaagaaaagcuccgacccgaacuaacccaacuaaagaaucagaaaagagaagaacuuauaaaaaaaggaaaaaaacuacuagaagaaaacuuagaaaacgccgucuucaaucauugcuuaagaccuuuccuagaagaaaauaaaaccgacgauaaacaaaacaaaacugucucccuacgcaaauacagaaaaucaaaaccgaaugaagaaacaaguauaacacucacccaaucaggcuuaguauuuuuaauguccuucuucuuacacagaaaagaauuccaaguauuuaccucuggccuagaaggcuuuaaagccaaagucaauaccauuaaagaagaagaaauuucccuuaacaaaaacaacaucguauauaugauaacccauuggucauauagcuauuacaacuuuaaaggacucaaacacagaauaaaaacagaucaaggcgucucgacauuagaacaaaacaacacaacacacucccucacuaacacaaacacaaaggaagcucuauuaacacagauuguagauuauuuauccaaaguaccaaacgaaauauacgaaacucuuagugaaaagcaacaaaaggaauuugaagaagauaucaaugaauauaugagagagaauccagaaaacgaagacucaacauuuucauccauaguaucacacaaaguaauccggaaaagauacgaaaauaaauucaacuauuucgccaugcgauucuuagacgaauaugcagaauuaccuacauuacgcuucauggugaacuuuggugacuacaucaaagacagacaaaagaagauucuugaaucgauacaguucgacucagaaagaauaauaaaaaaagaaauccaccuauuugaaaaguuaucccuaguuacagaauauaaaaaaaaugucuaucuuaaggaaacauccaacauugaccugagccgcuuuccacuguuccccaacccaagcuauguuauggcuaacaauaacauaccauucuauauugacucacgguccaacaauuuagaugaauaccugaaccaaaaaaaaaaagcgcaaucccaaaacaaaaaaaggaaccuuacguucgaaaaauacaauaaagaacagagcaaagaugcgauaaucgcgaugcuccaaaaagaaauaggaguuaaagauuuacaacaaagauccacaauuggacuucuaagcugcaaugaacucccaucaaugcuauacgaagucauaguaaaagacauaaaaggagcagaacucgaaaacaaaauugcucaaaaaauacgcgaacaauaccaaaguauaagagacuuuacucuggauaguccacaaaaagauaacauaccaaccacacuuauaaaaaccaucaacaccgacucaucaguaacuuuugaaaaucagccuauagauauaccacgcuuaaaaaacgcaauacaaaaagaauugacccuuacccaagaaaaauuacuuaaugucaaagaacacgaaaucgaaguugauaauuacaaucgcaacaaaaacaccuacaaauuuaaaaaucaacccaaaaacaaaguugacgacaaaaaacugcaacgaaaauacguuuucuaucgaaacgaaauuagacaagaagcaaauugguuagccagcgacuuaauacacuuuaugaaaaacaagaguuuauggaaaggauacaugcacaacgaacuucaaagcuucuuagccuucuuugaagauaaaaaaaaugacugcaucgcccuacuagaaacagucuucaacuugaaagaagacugcauucuaacaaagggacuuaaaaaucuauucuuaaaacacgguaacuucaucgauuucuacaaagaauaucuaaaacuaaaagaagauuuccuaaacacagaaucaacauuucuagaaaacggcuuaauaggucuaccuccaaaaauucuuaaaaaagaacuuuccaaacgauucaaauacaucuuuaucguguuccaaaaaagacaauucauaaucaaagaauuagaagaaaaaaagaauaaccuuuaugcagacgcaauaaaucuauccagaggcauuuucgaugaaaaaccuaccaugauuccauucaaaaaaccaaaccccgaugaguucgcuucaugguucguugcaaguuaucaauacaauaauuaccagucauucuacgaacuaacuccagacaucguugagagagauaaaaagaaaaaauacaaaaaccuccgcgcaauaaauaaagucaaaauucaggacuacuacuuaaaacuuaugguagacacccuauaccaagacuuauuuaaccagccucuagacaaaucacuuuccgauuuuuacguaucaaaagcagagagagaaaagauuaaagcagacgccaaagcuuaccaaaaacgaaaugacuccagucucuggaacaaaguaauccaccucucucuacaaaacaaccgaauaacagccaacccaaaacuaaaagauauuggcaaauacaaaagggcauuacaagacgaaaaaauagcgacacuacuuacauacgaugaucgaaccuggacguacgcccuacaaaaaccagagaaagaaaacgaaaaugauuacaaagaacuacacuacacagcauuaaauauggaauuacaagaauaugaaaaaguaagauccaaagaauuacucaagcaaguacaagaacuagaaaaacaaauacuagaagaauacacagauuuucucuccacgcaaauccacccagcagacuucgaaagagaagguaauccaaauuuuaaaaaauaccuagcacacuccauacuugaaaaugaagaugaccuugacaaauuaccugagaaagucgaagcaaugagagaacuagacgagacaauaaccaauccaauaauuaaaaaagcuaucguccucauaaucauaagaaauaaaauggcacauaaccaguacccaccuaaauucauauaugaccuagcaaacagauucguaccuaaaaaagaagaagaauacuuugccacauacuuuaaucgaguauuugaaacaauaacaaaagaacuuugggaaaacaaagaaaaaaaggacaaaacccaagucuaa

SEQ ID NO: 11534 - RNA, 3642 nt, Artificial Sequence
  Cas13b variant__Flavobacterium columnare__WP_063744070.1__Cas13b
augagcuccaaaaacgaaucguacaauaaacagaaaaccuuuaaccauuacaaacaagaagacaaauacuucuuuggaggauuuuuaaacaaugcagaugacaaccuccgccaagucggaaaagaguucaaaaccagaauaaacuuuaaccacaauaacaacgaacuagcuagcguuuuuaaagacuacuuuaauaaagaaaaaucuguagcaaaaagggaacacgcucugaaucuacuaagcaacuauuuccccguccuagaacgaauacaaaaacacacaaaccauaauuucgaacaaacgagagaaauauuugaacuacuacuagacacaaucaagaaacucagagauuacuacacacaccauuaucacaaaccaauaacgauaaaccccaaaauuuacgacuuccucgacgacacucuacuagauguccucauaacaaucaaaaagaagaaagucaaaaaugacacaagcagagaacuucucaaagaaaaacucaggcccgaacuaacucaacucaaaaaccagaaaagagaagaacuaaucaagaaaggaaagaaacuuuuagaagaaaacuuagaaaacgcaguuuucaaucacuguuuacgaccuuuccucgaagaaaauaaaacagacgauaaacaaaacaaaaccgucucacucagaaaauaccgaaaaucaaaaccaaacgaagagacaagcauaacuuuaacacaauccggauugguauuuuugaugucauucuuucuucaucgaaaagaguuccaaguuuucacaucggguuuagaagguuucaaagccaaagucaacacuauaaaagaagagaaaauaucucuuaacaaaaauaacauagucuacaugauaacccacugguccuacucuuacuacaacuucaaaggacucaaacaccgcauaaaaacagaucaaggaguauccacccuagaacaaaacaacaccacucacagccucaccaauacuaacacgaaagaagcauuauuaacccaaauuguagauuaccucagcaaaguuccaaacgaaaucuacgaaacacuaagcgagaaacaacaaaaagaguucgaagaagauaucaacgaauacaugcgugaaaacccugaaaacgaggacaguaccuucagcucaauagugagccauaaaguuauacgaaaacgcuaugaaaacaaauucaauuacuuugccaugcgauuucucgaugaauaugcagaacuacccacgcuacgauuuauggugaacuuuggugacuauauaaaagaucgacaaaagaaaauacucgaauccauacaauucgacucggaacgaauaaucaagaaagagauccaccuauucgaaaaauuaggacucguaacugaauacaagaaaaauguauaucucaaagaaacaucuaacauugaccugucgagauucccacuuuucccauccccgucauacgucauggcaaauaacaacauaccuuuuuauauugacucucgcucuaacaaccuagacgaauaucucaaccagaaaaagaaagcacaaucccaaaacagaaaaagaaaucuaacauucgaaaaauacaacaaagaacaaagcaaagaugccauaauugcaaugcuccaaaaagaaaucggcguaaaagaucuacaacaacguucaacgauagggcucuuaaguugcaacgaacucccaucaaugcuuuacgaaguuauaguaaaagauaucaaaggagcagaacuagaaaacaaaauagcucagaaaauacgcgaacaauaccaaucaauacgagauuucacccucaauucaccccaaaaagacaacauaccaacaacuuuaauuaaaaccauaucaaccgacacaagcgucacuuucgaaaaccaacccaucgauauuccccgucucaaaaacgcuauacaaaaagagcuugcacuaacacaagaaaaacuacuuaacguaaaacaacaugaaauugaagucaacaauuauaaucgcaacaaaaauacauauaaauuuaaaaaccaacccaaagacaaaguagacgacaacaaauuacaacgaaaauauguauuuuacagaaacgaaauuggacaagaagcgaauuggcucgcaagcgaucucauccacuucaugaaaaauaaaucucuguggaaaggcuauaugcacaacgaacuccaaaguuuucucgcauucuucgaagacaagaaaaacgauugcauagcacuucuggaaaccguuuucaaccuaaaagaagauugcauucucacuaaagaccuaaagaacuuauuucugaaacacggcaauuucauagacuucuacaaagaauaucuaaaacucaaagaagacuuccuuaacacggaaucaaccuuccucgaaaauggcuuuaucggccuaccaccaaaaauacucaagaaagaacuaucaaaaagacucaauuacaucuucauuguauuccaaaaacgacaauucauaauaaaagaauuggaagagaagaaaaacaaccucuacgcagacgccauaaaccuaucaagaggaaucuuugaugaaaaaccuacuaugauaccauucaagaaacccaauccugacgaauuugccucuugguucgucgccucauaccaauauaacaacuaccaaucauucuacgaacuaacaccagacaaaaucgaaaacgacaaaaagaagaaauacaaaaaccuuagagcaauaaacaaaguaaaaauacaagacuacuaccuaaaacuaauggucgauacacuauaucaagaucuuuucaaccaaccacucgacaaaucccucucugacuucuacguauccaaaacagauagagagaaaauuaaagcagacgcaaaagcauaucaaaaacguaacgauuccuucuuauggaacaaaguaauccaccuaagucuccaaaauaacagaaucacagcaaauccaaaauugaaagauaucggaaaauacaaaagagcccuacaagacgagaaaauagcaacccuacuuacauacgacgauagaaccuggacauacgcacuacaaaaaccagaaaaagaaaaugaaaaugacuacaaagaauuacacuacaccgcauuaaauauggaauuacaagaauaugaaaaaguacgaaguaagaaacuacucaaacaaguacaagaacucgagaaacaaauacucgacaaauuuuaugauuuuucgaacaaugccacgcaccccgaagacuuagaaauagaagacaagaaaggaaaacgucacccaaauuuuaaauuauacauaaccaaagcauuacuuaaaaacgaaucagaaaucauaaaccuagagaauauagacaucgaaauacuaauaaaauauuacgacuauaacaccgagaaacucaaagaaaagaucaaaaacauggaugaagacgaaaaagcaaaaauaguuaacacuaaagaaaacuauaacaaaauaacaaauguccuaaucaagaaagcccuaguccuaauaauaaucagaaacaaaauggcucauaaccaauauccacccaaauucauuuacgaucucgcuacaagauucguucccaaaaaggaagaagaauauuucgccugcuauuucaaccgugucuuugaaacaauuacuacagaauuaugggaaaauaagaagaaagccaaggaaauaguuuaa

SEQ ID NO: 11535 - RNA, 3645 nt, Artificial Sequence
  Cas13b variant__Flavobacterium columnare__WP_065213424.1__Cas13b
augaguucaaaaaacgaaucauacaacaaacaaaaaaccuucaaucacuauaaacaagaagauaaauacuucuucggaggauuucugaacaaugccgacgauaauuuaagacaaguaggaaaagaguucaaaacucgcauuaauuuuaaccacaauaacaacgaacuugcaucaguauucaaagauuacuuuaacaaagaaaaaucaguagcaaaaagagaacacgcccucaauuuacuaucuaacuacuuuccuguacuagagagaauacagaagcacaccaaucacaacuucgaacaaacccgagaaauauucgaauuacuccuugacacaaucaaaaaauuacgcgauuacuacacccaccacuaucacaaacccauaaccauaaaccccaaaauauacgacuuccucgacgauacucuucucgauguacucauaacaauuaaaaaaaaaaaagugaaaaacgacacaucccgagaacuacuaaaagagaaauuacguccagaacuaacacaacuuaaaaaccaaaaaagagaagaacuaauaaaaaaaggaaaaaaauuauuagaagaaaaccucgaaaacgcaguauuuaaucauugucuaauaccuuuccucgaggagaauaaaacagacgacaaacaaaacaaaacuguaucucuuagaaaauaccggaaaucaaagccuaacgaagaaacaaguauuacacugacacaaucagguuuaguuuucuugaugaguuuuuuccuccacagaaaagaauuccaaguauucaccucaggccuagaacgcuuuaaggccaaaguuaauacaauuaaagaggaagaaaucucacugaauaaaaauaacauaguguacaugauaacgcacuggucauacuccuacuacaauuuuaaaggucuuaaacaccgaauaaaaaccgaucaaggagucaguacucucgaacagaacaacaccacacauucauuaaccaacaccaacacaaaagaagcacuucucacacaaauugucgacuaccucucgaaaguacccaaugaaaucuacgaaacauuaucagaaaaacaacaaaaagaauucgaagaggauaucaacgaguacaugagggaaaacccagaaaacgaagauucgacauuuucaagcauaguaucacauaagguaauacgaaaacgguaugaaaacaaguuuaacuacuuugcaaugagguuccuagacgaguacgcagaauuacccaccuuaagauucauggucaacuuuggagacuauauuaaagacagacaaaaaaaaauccuagaaucuauacaauucgacucagaaagaauaauaaaaaaagaaauacaccuguuugaaaagcuuagccuaguuacagaauauaaaaaaaacgucuaccugaaagaaaccuccaacaucgaucuuucacguuucccacuuuuuccuaauccaucauaugucauggccaacaacaauaucccauucuauauagacucccgauccaauaaccucgacgaauaccuuaaucaaaagaaaaaagcccaaagccaaaacaaaaagagaaauuuaacauucgaaaaauauaacaaagagcaaucaaaagacgcaaucauagcaaugcuacaaaaagaaauaggagucaaggaccuccaacaaagaagcacuauaggauuacugucuugcaacgaacuuccaucaaugcuauacgaagucauagugaaagacauaaaaggagccgaacuugaaaacaaaauagcccaaaagauccgugaacaauaccaauccauucgcgauuucacucuagacagcccacaaaaagauaacauaccaacaacacucaucaaaaccauaaacacagacuccucaguaacguucgaaaaccaaccaauugacauaccaagacucaaaaaugcauuacaaaaagaacuaacccugacacaagaaaaauuacuaaacgucaaagaacacgaaaucgaaguagacaauuacaacagaaacaaaaacaccuauaaguucaaaaaccaaccuaaaaacaaaguugacgauaaaaaacuacaaagaaaauacguauucuacagaaacgaaauaagacaagaagcaaacuggcuagcaucugauuuaauccacuucaugaaaaacaaaagcuuauggaaaggguauaugcacaacgaacuacaaaguuuccuagcuuucuucgaagauaaaaaaaacgacuguaucgcacuacucgaaacgguauucaaucuaaaagaagauugcauuuuaacaaaagggcuuaaaaaucucuuucuaaaacacgguaacuucauagauuucuacaaagaauaccugaaacuaaaagaagacuuucuauccaccgaaucaacauuccuagaaaauggauuuauaggacuaccaccaaaaaucuuaaaaaaagaacuauccaaacguuuaaaauacauauucaucguauuccaaaaacgucaauucaucauaaaagagcuagaagaaaaaaaaaacaaccuauacgcagacgcaaucaaucuaucacgaggcauauuugacgaaaaaccaaccaugauuccauucaaaaaacccaauccggaugaauuugcaagcugguuuguugcuucuuaccaauacaauaacuaccagaguuuuuacgaacugacaccugauauugucgaaagagacaaaaaaaagaaauacaagaacuuacgagcaauaaauaaaguaaaaauccaagacuauuaccuuaaacuaaugguggacacccuauaccaagaccuauucaaccaaccacuagauaaaagccuuucagacuucuauguaucuaaggccgagagagaaaaaauuaaagcugacgcgaaggcauaucaaaaacuuaaugauucaucccuauggaacaaaguaauacaccuaucacuacaaaacaacagaauaaccgcaaauccuaaacugaaagauauaggaaaauauaaaagagcacuacaagaugaaaaaauagcaacccuccuuacauacgaugcccgcacguggaccuaugcucuccagaaaccagaaaaggaaaacgaaaaugacuauaaagaguuacacuacacagcucuaaauauggaauugcaagaauacgaaaaaguucgaaguaaggaauuacuaaaacaaguacaagaacuagaaaaaaaaauucucgacaaauucuacgauuucuccaauaacgcaagccacccugaagaccuugaaauugaggacaaaaaaggaaaacgccacccaaacuuuaaacuauacauaaccaaagccuuacuaaaaaaugaaagcgaaauuauaaaccuagaaaacauugacaucgaaaucuugcugaaauauuaugacuacaauacagaagaacuaaaagaaaaaauuaagaauauggacgaggacgaaaaagcaaaaauaauaaacacaaaagaaaacuauaacaaaauaacaaacguccucauaaaaaaagcucuuguacuaauaaucaucagaaacaaaauggcacacaaccaauauccuccaaaguuuaucuacgaucuagcuaacagauuuguuccaaaaaaagaagaagaauauuucgcaaccuauuuuaacagaguauucgaaaccaucaccaaggaacucugggaaaacaaagagaaaaaagacaaaacgcaagucuaa

SEQ ID NO: 11536 - RNA, 3468 nt, Artificial Sequence
  Cas13b variant__Flavobacterium sp.__WP_045968377.1__Cas13b
auggauaacaacaucacaguagaaaagaccgagcuaggucuagggauaacauauaaucacgacaagguagaagacaaacauuauuucggagguuucuucaaccuggcccaaaacaacauagaucuaguagcacaagaguuuaaaaaaagguuacuaauacaaggaaaggacuccaucaauauauucgccaacuacuuuagcgaucaguguuccauaacaaaccuagaaaggggcauaaaaauacuagcagaauacuuuccagucguaagcuacauagaucuugaugaaaagaacaaaucgaaaucaauacgugaacaccuaauauuauuacuagaaacuauaaauaaucuacgcaacuauuauacacacuauuaccacaaaaaaauaauaauagacggaucccuauuuccccuacucgacacaauccugcuuaaaguaguccuagaaauaaaaaagaaaaaauugaaagaagacaagacuaaacaacuacugaaaaaaggacuugaaaaagaaaugacuauacuauucaaucuaaugaaagcagaacagaaagaaaaaaaaauaaaagguuggaauauugacgaaaacauuaaaggcgcagugcuaaaucgagccuucagccauuuacucuacaacgacgaauuaucagauuaucgaaaaucaaaauacaauacagaagacgaaacacuaaaagacacacucacggaauccggcauauuauuucuccucagcuucuuccuaaacaaaaaagaacaagaacagcuuaaagcaaauaucaaaggcuauaaaggaaaaauagcaucaauccccgacgaagaaaucacacucaaaaauaacucauuaagaaacauggcaacacauuggaccuauucacaucuaacguacaaaggcuuaaagcaccgcauaaaaacugaucaugagaaagaaacucuacuaguaaauauggucgacuacuuauccaaagucccccacgaaauauaccaaaaccuauccgaacaaaauaaaucucuuuuucuugaagauauaaaugaguauaugagagauaacgaagaaaaucacgauucguccgaagcuagucgcguaauccacccaguaauacgaaaaagauacgaaaacaaauucgccuauuucgccauacgcuuccuagacgaauucgccgaauucccuacucuccgauucauggugaacguaggaaacuacauccacgauaaccguaaaaaagacaucggcggaaccucucuaaucacuaaccgaacaauuaaacaacagaucaacguuuucggaaauuuaacagaaauacacaaaaaaaaaaacgauuacuucgaaaaagaggagaacaaagaaaaaaccuuagaaugggaacuauuuccuaacccaaguuaucauuuucaaaaagaaaauauaccaauuuucauagauuuagaaaaaaguaaagagaccaaugaucuagcaaaagaauaugcaaaagaaaaaaaaaaaauauucggcucauccagaaaaaagcaacaaaacacagcaaaaaaaaaccgcgaaaccauaauaaaccucguauucgauaaauauaagacauccgacagaaaaacaguaacauucgaacagccaaccgccuuacucucauucaaugaacuaaauuccuuucuauacgccuuccuuguagaaaacaaaacugguaaagaauuagagaaaauuauaauagaaaaaauagccaaccaauaucaaauccuaaaaaacugcagcaguacaguagauaaaacuaacgauaacauaccaaaaucgauaaaaaagaucguaaacaccacaaccgacucuuucuacuucgaaggaaaaaaaauagacauagaaaaauuggaaaaagacauaaccauagagauagaaaaaaccaacgaaaaacuagaaacgauaaaggaaaaugaagaaagugcucaaaacuauaaacgaaaugaaagaaacacacaaaaacgaaaacucuauagaaaauauguauucuucaccaaugaaaucggaaucgaagcaacauggauuacaaacgauauccuuagauuucuagacaacaaagaaaacuggaaagguuaccaacauucagaguuacaaaaauuuauaucucaauacgacaacuacaaaaaagaagcccuagguuuauuagaaucagaauggaaucuagaaucugacgccuucuucggccaaaaccuaaagagaauguuccaaaguaacucaacauucgaaacuuuuuacaaaaaauaccucgacaacagaaaaaacacacuugaaacauaccuaucagcaaucgaaaaccuaaagaccaugaccgacguaagaccaaaaguccuaaagaaaaaauggacagaacuauuccgauucuuugacaaaaaaauauaccuacucucaacaauagaaacaaaaauuaacgaacuaauaacuaaaccaauaaauuuaagccgaggaauauucgaagaaaaacccacuuucauuaauggaaaaaaucccaacaaagaaaacaaccaacaucuauucgcuaacugguucaucuacgccaaaaaacaaaccauacugcaagacuucuacaaucuaccacuagaacaacccaaagcaauaacaaacuuaaaaaaacacaaauacaagcucgaacguuccaucaacaaccucaaaaucgaggacauauacauuaaacaaauggucgauuuccuauaccaaaaauuauucgaacaaagcuucauaggaucacuacaagaccucuacacaucaaaagaaaagcgcgaaauagaaaaagguaaagccaaaaacgaacagacaccagacgaaaguuuuaucuggaaaaaacaaguagaaauaaacacccacaacggcagaauaauagccaaaacgaaaaucaaggauauuggaaaauucaaaaacuuacuaacagacaacaaaauagcacaucuuaucucauaugaugaucgcauaugggacuuuucacuaaacaacgacggagacauaaccaaaaaauuauacagcauaaacacugaacuggaauccuacgaaacaauaagacgagaaaaacugcuaaaacaaauacaacaauuugaacaauuucuacucgaacaagaaacagaauacucagcagaacgaaaacaucccgagaaauucgaaaaagacuguaaccccaacuucaaaaaauauaucaucgaaggcguucuaaacaaaauaauacccaaucacgaaauagaggagaucgaaauccuaaaaucuaaggaagauguauuuaaaauuaacuucuccgauauacuaauuuuaaacaaugacaacauaaaaaaaggcuacuuacucaucaugauaagaaauaaauuugcacauaaucaacuuauagacaaaaaucuauuuaacuuuucccuacaguuauacagcaaaaacgaaaaugaaaacuucucagaguacuuaaauaaaguaugccaaaacauaauacaagaauuuaaagaaaagcucaaauaa

SEQ ID NO: 11537 - RNA, 3480 nt, Artificial Sequence
  Cas13b variant__Myroides odoratimimus__EHO06562.1__Cas13b
augaaagauauuuugaccaccgacacaacagaaaaacaaaacagauucuacucacacaaaauagcagauaaauacuucuucggaggauauuucaacuuagcaucaaauaauaucuacgaagucuucgaagaagucaauaaacgaaacacauucggcaaacuagcaaaaagagacaauggaaaccuuaaaaacuauauaauucacguauuuaaagaugaacuauccaucucagacuuugaaaaacgaguugcaaucuuugcaucauacuuuccaauacuugagacaguagauaagaaaagcauaaaagaaagaaauagaacaaucgauuuaacucuaucucaaagaauaagacaauucagagaaauguuaauaagccugguaacagcagucgaccaacuccgaaacuucuauacacacuaucaccacucggauauuguuauugagaauaaaguacuagacuuucuaaauucgucauuuguuagcacagcacuacacguuaaagacaaauaccuaaaaaccgacaaaacgaaagaauuucucaaagaaacuauagcagcagaauuagacauccucauagaagcauacaaaaagaaacaaauagaaaagaaaaauaccagauucaaagcuaauaaacgagaagauauacugaacgcaauauacaacgaggcauuuuggucguuuauaaacgauaaagacaaagauaaggauaaggaaaccguaguagcaaaaggugcagacgccuacuuugagaaaaaccaccacaaauccaacgauccggauuucgcccucaacaucuccgaaaaggguaucgucuacuuauuaaguuucuucuuaacaaauaaagaaauggacucucuaaaagcaaaccuaacaggauucaaaggaaaaguagacagagaauccgguaauucaauaaaauacauggcaacacaaagaauauacuccuuccauacauaucggggcuuaaaacagaaaauaagaacaagcgaggagggaguaaaagaaacgcucuuaaugcaaaugauagacgaguuaucaaaaguaccaaacgucguauaccaacaccucucuacaacacaacaaaacucauuuaucgaagacuggaacgaauacuauaaagauuacgaagacgauguagaaacagacgaccucucacgaguaauacauccagucaucagaaaacgauacgaagacagauucaacuacuucgcaauuagauuuuuagacgaguucuuugacuuccccacauugagauuccaaguacaucucggagacuacguucacgaccgaaggacuaaacaacuagggaaaguagaaucagacagaauaaucaaagaaaaagugaccguauucgcuagacuuaaagacauaaauuccgccaaagcaucuuacuuccacucacucgaagaacaagacaaagaagaauuagacaacaaauggacgcuauuucccaauccaucauaugacuucccuaaagaacacacauuacaacaccaaggagaacagaaaaacgccggcaaaauuggaauauacguuaaacuccgagauacgcaauauaaagaaaaagcugcauuagaagaagcccgcaaaucauuaaaucccaaagaacgaucagccacuaaagcaucaaaauacgacauaaucacccaaauaauagaagccaaugacaacguaaaaagcgaaaaaccauuagucuucaccgggcaaccaaucgcauaccuaaguaugaacgacauacacucaaugcuauucucacuacuuacagauaacgccgaacugaagaaaacacccgaagaaguagaggcaaaauuaauagaucaaauaggcaaacaaaucaacgaaauauuaagcaaagacacagauaccaaaauccucaagaaauauaaagacaacgauuuaaaagaaacagacacagauaaaauaacccgagauuuagcacgagauaaagaagaaauugaaaaauuaauacuggaacaaaaacaaagagcagaugacuacaacuacacaucuagcaccaaguucaauauagacaaaucaaggaaaagaaaacauuuacuauucaaugcugaaaaaggaaaaauuggagucuggcucgccaacgauaucaaaagguucauguucaaagagaguaaaucaaaauggaaaggauaccaacacacugaacuacaaaaacuauucgccuauuucgauacaaguaaauccgaucuugaauuaauauuaagcaacaugguaaugguaaaggacuauccuaucgaacugauagaccucgugaagaaauccagaacccuagucgacuuucuuaacaaauaucuagaagcaagacucgaauauauugaaaauguuaucacacgagucaaaaauucuaucggaacaccacaauuuaaaacaguaagaaaagaauguuucaccuuccuaaagaaaagcaauuauacgguaguaucacuagacaaacaaguagaaagaauacuaaguaugccccucuucauugaacgaggauucauggacgacaaaccaacaaugcuagaaggaaaaaguuauaaacaacacaaagaaaaauuugcggacugguucguacauuauaaagaaaacucaaacuaucaaaauuucuaugacacugaaguauacgaaauaacaacagaagacaaacgcgagaaagcgaaaguaacaaagaaaauaaaacaacaacagaaaaaugacgucuucacguuaaugaugguuaacuauaugcuagaagaaguuuuaaaauugucuucgaaugauagacuaagccuuaaugaacuguaccaaacuaaagaagaaaggauaguaaacaaacaaguggcaaaagauacacaagaacgaaacaaaaauuacauauggaauaaaguuguagacuuacaacuuugcgacggccuaguacacauugacaacguaaaacucaaagacauaggaaauuucagaaaauacgaaaaugauagcagaguaaaagaguuccuuaccuaccaaucagacauuguauggagcgcauaucuaaguaaugaaguugauagcaacaaacuuuauguuauagaaagacaacuagacaacuacgaaagcauacggagcaaagaauuauuaaaagaaguccaagaaauagaaugcucagucuauaaccaaguagcaaauaaagagucacuaaaacagucaggaaacgaaaacuuuaaacaauacgugcuccaaggauuguuaccgauuggaauggacguuagagagaugcuaauccuaucuacugacgucaaauucaagaaagaagaaauaauucaauuaggacaagcuggagaagucgaacaagacuuauauucucucauuuauauaagaaacaaauucgcccauaaucaauuacccauaaaagaguucuuugacuuuugcgaaaauaacuaccguuccauaucagacaacgaauauuaugcugaauacuacauggaaauauucaggucgauuaaagaaaaauacgccaacuaa

SEQ ID NO: 11538 - RNA, 3474 nt, Artificial Sequence
  Cas13b variant__Myroides odoratimimus__WP_006261414.1__Cas13b
augaaagacaucuuaacaacugauacaacugaaaaacaaaaccgauuuuacucacacaagauagcagacaaauacuucuucggaggauauuucaauuuagcauccaauaauauauaugaagucuuugaagaaguaaauaaaaggaacacauuuggaaagcuagccaaaagagacaauggaaaccuuaaaaacuacauaauccauguauucaaagaugaacuaucaauuagcgacuucgaaaaacgaguagcaauauucgcuagcuacuuuccaauacuagagacagucgacaagaaaucaaucaaagagagaaaccgaaccauugacuuaacacuaucccaacgcauaagacaauuccgagaaaugcuuauaucacuuguaacagcaguugaccaacucagaaacuucuacacacacuaccaucacuccgagauaguaaucgaaaacaaaguccuugacuucuuaaacucaucucuuguaucaaccgcucuacacguaaaagacaaauaucuaaaaacugauaaaacuaaagaauuucucaaagaaaccauagcagcggaauuagauauauugauagaggcuuacaaaaagaaacaaauagaaaagaaaaacacuagguuuaaagcaaacaaacgagaagacauccucaacgcaauauauaacgaggcuuuuuggucauucaucaacgacaaagacaaagauaaagaaacuguaguagccaaaggagcagacgcuuacuucgagaaaaaccaucacaaaucaaaugauccagauuuugcucuaaauauuuccgaaaaaggaauugucuaucucuuaucauuuuuccuaacaaauaaagaaauggacagccuaaaagcaaacuuaaccggauucaaagguaaaguagacagagaaagcggaaauaguaucaaauacauggcuacgcaaagaauauacucguuucacacuuauaggggauuaaaacagaaaauaagaacguccgaagaaggggucaaggaaacacuauuaaugcaaaugauagacgaacuuucaaaaguacccaacguuguauaccaacaccuaucaacaacccaacaaaacagcuucauagaagacuggaacgaauauuacaaggacuaugaagacgacguagaaaccgacgaccuaaguagaguuauacaucccgugaucagaaaacgguaugaagacagauucaacuacuucgcaauacgauuuuuagacgaguucuuugauuuucccacuuuaagauuccaaguacauuuaggagauuacguucacgaccgcagaacaaaacaacuaggaaaaguagaaagcgaccgaaucauaaaagaaaaaguaacaguauuugcaagauuaaaagauauaaacucagccaaagcaaauuacuuucacucgcuugaagaacaagauaaagaagaauuagacaacaaauggacacuauuuccaaacccauccuacgauuucccaaaagaacacacacuccaacaucaaggagaacagaaaaaugccgguaaaauuggcaucuauguaaaacuaagagacacacaauacaaagaaaaagcagcauuagaagaagcuagaaaaaguuugaacccuaaagaacgaagugccacaaaggcuucuaaauacgauaucauaacccaaauaauagaagccaaugauaacgucaaauccgaaaaaccuuuaguauuuacuggucaaccaauugccuaccuaagcaugaacgacauccauucaaugcucuuuagucuucuaacagacaaugcagaauuaaagaaaacucccgaagaagucgaagcuaaacuaauagaucaaauaggaaaacaaauaaaugaaauauuaucuaaagauaccgacaccaaaauauuaaagaaauauaaagacaacgaccuaaaagaaacagacacagauaaaauaacacgugaucuugcacgagauaaagaagaaauagaaaaauuaauacucgagcaaaaacaacgcgcagacgacuauaauuacacaucaucuacaaaauuuaacauagacaaaucacgaaaacgaaaacacuuacucuuuaaugcugaaaaagguaaaauaggaguaugguuagcaaaugacaucaaaagguuuaugacugaagaauuuaaaucaaaauggaaaggauaccaacauaccgaacuccaaaaacuauucgccuauuacgacacaagcaaauccgacuuagaucucauucucagugacaugguaaugguuaaagacuacccaaucgaacuuauagcacugguuaagaaaucgcgaaccuuagucgacuucuuaaacaaauaccucgaagcuaggcuaggauacauggaaaacguaauaacaagaguuaaaaacuccaucgguacgccacaauucaaaacaguacgaaaagaauguuuuaccuuccuaaagaaaucaaacuacacaguagugucauuagacaaacaaguagagagaauacuaucaaugccauuauuuauagaaagaggauuuauggaugauaaaccgacaaugcuagaaggaaaaucauaucaacaacacaaagaaaaauucgcagacugguuuguucauuacaaagaaaauucuaacuaucaaaauuucuaugacacagaaguguacgaaauaacaaccgaggauaaaagagaaaaagcaaaaguaacuaagaaaauaaaacaacaacagaaaaaugacguauucacacuaaugaugguaaacuacauguuagaagaaguucuaaaauuaagcagcaacgaucgacuaagucuaaaugaacuguaccaaacaaaagaggaaagaauaguaaacaaacaaguugcuaaagacacacaagaaagaaauaaaaacuacaucuggaauaaaguuguagaccuacaacuaugcgaaggccuaguacguauugauaaagucaaacuaaaagacauaggaaacuuccgaaaauaugaaaacgauucaagagugaaagaguuccuaacauaccaaucagacauaguguggagugcauaucuaaguaacgaagucgauucuaauaaacuauauguaauagaaagacaacuagauaauuacgagucgauacgaucaaaagaacuccuuaaagaaguacaagaaaucgaguguucagucuacaaucaaguugcaaacaaggaauccuuaaaacagaguggaaacgaaaacuuuaaacaauacguccuucagggacuuguaccaauaggaauggacguccgcgagaugcuuauacucucuacugauguaaaauuuaucaaagaagaaaucauccaacucggacaagcaggcgaaguagaacaagaucuauacucacucauuuacauccggaacaaauuugcacauaaucagcuaccuauaaaagaguucuucgauuuuugcgaaaauaauuaccgaucaauaucagauaaugaauacuaugcagaauacuacauggaaauauucagaagcauaaaagaaaaauacacuucuuga

SEQ ID NO: 11539 - RNA, 3474 nt, Artificial Sequence
  Cas13b variant__Myroides odoratimimus__EKB06014.1__Cas13b
augaaagacauauugacuacagauacaacagagaaacaaaauagguuuuacagucauaaaauugccgacaaauacuucuucggggguuacuucaaucuagcaucaaauaauauauaugaagucuuugaagaaguaaacaaacgcaacacguuugguaaauuagcuaaaagagacaacggaaaccuuaaaaacuacaucauacacgucuuuaaagaugaguuaucaauauccgauuucgagaaaagaguagcaauauucgcgaguuauuucccaauuuuggaaacaguagauaagaaaaguauaaaagaaagaaacagaacaauagaucuaacacucucacaacggauacgacaauuccgagaaauguuaauaaguuuagugaccgcaguggaccaauuacgaaacuucuacacccacuaccaucacagugaaauaguaauagaaaacaaaguacuagacuuuuugaacucuucacucgugucaaccgcccuacacgucaaagauaaauaucucaaaacagauaaaacgaaagaguuccuuaaagaaacaauagcagcagaacucgauauacuaauagaagcauacaaaaagaaacaaauagagaagaaaaauacacguuuuaaagcaaacaaaagagaagacauacucaacgccauuuacaacgaagcauuuuggucuuucauaaaugacaaagauaaagauaaagaaaccguaguagcaaaaggagcagaugcauacuucgagaaaaaccaccacaaaaguaacgaccccgauuuugcacucaacauauccgaaaaaggaauuguauaucuucugaguuucuuuuuaacaaauaaagaaauggacucccugaaagcaaaucuaacagguuucaaaggaaaagucgaccgugaaucaggaaauaguauaaaauacauggcgacccagagaauauacagcuuucauacauaucgcggccuaaaacagaaaauuagaaccucagaagaaggaguaaaagaaacccuacuaaugcaaaugauagacgaauuauccaaaguaccaaauguagucuaccaacaucuaaguacaacccaacaaaacaguuucauagaagacuggaacgaauacuacaaagacuaugaagaugauguugaaacagaugaccuaaguagggucauccacccuguaauaagaaaaagauaugaagaucgcuuuaacuacuuugcaauuagauuuuuagaugaguucuucgacuucccaacacuaagauuccaaguucauuuaggcgacuacguacaugaucgaagaacaaaacaacuagggaaaguagaaucagacagaauaaucaaagaaaaagucacaguauuugcaagacugaaagacaucaacucggcaaaagcaagcuauuuucacagcuuagaagaacaagauaaagaagaacuugacaacaaauggacacuguucccaaacccgagcuacgacuuccccaaagaacacacacuacaacaucagggagaacagaaaaaugcagguaaaauaggaaucuacguuaaacuaagagacacacaauacaaagaaaaagcagcacuagaagaagcaagaaagagcuuaaacccaaaagaacgcucugcgacaaaagcuagcaaauaugauaucauaacacaaaucauagaagcuaaugauaacgucaaaagugaaaaaccauuaguauuuacaggacaaccaaucgcauacuuaucuaugaacgacauucauaguauguuauuuucauuauugacagauaaugcagaacuaaagaaaaccccugaagaaguggaagcaaaacuaauagaccaaauuggaaaacagauaaaugaaauccuaagcaaagauacagacaccaaaauauuaaagaaauauaaagacaaugaccuaaaagaaacugacacagacaaaauuacacgcgacuuagcacgagauaaagaagaaauagaaaaacuaauacucgaacaaaaacaaagagcagaugacuacaauuauacuucaucuacaaaauuuaacauagacaaaucucgcaaaagaaaacauuuacuauuuaacgcagaaaaaggcaaaaucgggguauggcuggcaaaugacauaaagagauucauguucaaagaaaguaaaucaaaguggaaaggauaucagcauacagaauuacaaaaauuguucgccuacuucgauaccagcaaaucggacuuagaacuuauacuauccgauaugguuaugguuaaagauuauccaaucgaacuuauagaucucgucagaaaaucacgcacgcuaguagacuuuuuaaauaaauaccuagaagcucgacucggauauauugagaauguuauaacacgagugaagaacagcauaggcacaccacaauucaaaaccguuagaaaagagugcuucgccuuucuaaaagaaagcaauuauacagucgcaucacuugacaaacaaauagaaagaauacuuucaaugccauuauuuauagaaagaggauuuauggauuccaaaccaaccaugcuagaagguaaaagcuaucaacaacauaaagaagacuucgcagacugguucguacauuauaaagaaaacucuaacuaccaaaacuuuuacgauacagaaguuuacgagaucauaacagaagauaaaagagaacaagcaaaagucacaaagaaaauaaaacagcaacagaaaaacgauguauuuacacuuaugauggugaauuauaugcuugaagagguacugaaacuaccaucaaacgaucgacucagccuaaacgaauuauaccaaacaaaagaagaaagaauagugaauaaacaaguagcaaaagacacacaagaacgaaauaaaaacuauaucuggaauaaagucguugacuuacaauugugcgaaggacucguucgaaucgacaaagucaaacuaaaagauaucggcaauuuuagaaaauacgaaaacgauagucgggucaaagaguuuuugacauaccaaagugacauaguauggucuggcuaccuaaguaaugaaguagacucgaauaaacuauacgucauagaaagacaacuagacaacuacgaaucaauacgauccaaagaacuauugaaagaaguccaagaaaucgagugcauaguauacaaucaaguagcuaacaaagagagccugaaacagucaggaaaugaaaacuuuaaacaauauguacuacaaggccuacuacccagagguacagauguaagagaaaugcuuauacugucaacagauguaaaauucaagaaagaagaaauuaugcaacuagggcaaguccgagaaguagaacaagaccuauacucacucauauauauacggaauaaauucgcacauaaccaauugcccauaaaagaauuuuucgacuucugcgaaaacaauuauagaccaauaagugauaacgaauauuacgccgaauacuacauggaaauauuccgauccauaaaagaaaaauaugcaagcuaa

SEQ ID NO: 11540 - RNA, 3480 nt, Artificial Sequence
  Cas13b variant__Myroides odoratimimus__WP_058700060.1__Cas13b
augaaagacauacucaccacagauacaacugaaaaacaaaaccgcuucuacucgcacaaaauagcagacaaauauuucuuuggagguuacuuuaaucuagccucuaacaacauauacgagguauuugaagaaguaaacaaaagaaauacuuuuggcaaacuugcaaaacgggauaacggaaaucuuaaaaacuauaucauucacguuuuuaaagaugaacuaagcauuagcgacuucgagaaaagaguagcuaucuuugcaagcuauuuucccauacucgaaacaguagacaagaaaagcauaaaagaaagaaaccgaacgauagaccuaacucucucucaacgcauuagacaauuuagagaaaugcuuauaagccuaguaacggccguagaccaacucagaaacuucuauacacacuaccaccauuccgauaucguuauagaaaacaaaguauuagauuuccuaaauucgucauucguuucaacugcacugcauguaaaagacaaauaccugaaaacagacaaaacuaaagaauuuuuaaaagaaacaauagcugcagaacuagauauauuaauagaggcuuauaaaaagaaacagaucgaaaagaaaaacacaagauuuaaagccaauaaacgugaagacauucuaaaugcaauuuacaacgaagcguuuuggucauucauaaacgacaaagacaaagauaaagacaaagaaacaguaguagcgaaaggagcugaugcauauuuugagaaaaaucaucauaaaagcaacgacccugauuucgcauuaaacauauccgaaaaagggaucgucuaccuacuaucauucuuuuuaaccaacaaagaaauggauagccuaaaagccaaccuuacaggcuuuaaaggaaaagucgacagagaaucugggaauagcauaaaauacauggccacccaaaggaucuacagcuuucacaccuacagaggauugaaacagaaaauuagaaccucagaagaaggaguaaaagaaacauuacucaugcaaaugauagaugaacuaagcaaaguacccaauguaguauaccaacaccugagcacgacgcaacaaaauagcuucaucgaggauuggaacgaauacuauaaagauuacgaggaugacguagaaacagaugaccucagcagaguaacacacccaguaaucagaaaacguuaugaagaucgauuuaacuacuucgcaauacgcuuucuagaugaguucuucgacuucccgaccuuaagguuucaaguacauuuaggggauuauguacacgaccgaaggacaaaacaacuagguaaagucgaaucagacagaauaauaaaagaaaaaguaacugucuucgccagacugaaagacauuaacagugcaaaagccucuuauuuccacucacuagaggaacaagacaaagaagaacuagacaauaaauggacguuauucccaaacccuagcuacgacuuucccaaagaacauacucuacaacaccaaggagaacagaaaaacgcgggaaaaauaggcauauaugugaaacuaagagacacccaauacaaagaaaaggcugcacuagaagaggcacgaaaaucauuaaacccaaaagagcguucagccacuaaagcaucaaaguaugauaucaucacacaaauaaucgaagcuaaugacaacguuaaaucugaaaagccccuagucuuuacaggucaaccaauagcauaccucucaaugaacgacauacacucuaugcuauucaguuuacucacagauaaugcagaacuaaagaagacaccagaagaaguugaagcaaaauuaauugaccaaauagguaaacaaauaaaugaaauacuauccaaagauacugacacaaaaauacuaaagaaauauaaagauaaugaucuaaaagaaacagauacagacaaaauaacaagagaucuagccagagacaaagaagaaauagaaaaauuaauccuagaacaaaaacaaagagcagacgauuacaacuacacaucaaguacaaaauucaauauugauaaaucuagaaaaagaaaacaccuauuauuuaaugccgagaaaggaaaaauaggagucuggcuagcuaacgauauaaaaagauuuauguuuaaagaaaguaaaucuaaauggaaggguuaccaacacaucgaacuacaaaaauuauucgcauacuucgacacaucaaaaucugaccuagaacugauauuaagcaacaugguaaugguaaaagauuauccuauagaacuaauugaucuagucaagaaaagcagaacacucgucgacuuucuaaacaaauacuuagaagcucgauuagaauauauagaaaacguaauaaccagagugaaaaacagcauuggcacaccccaauuuaaaacaguaagaaaagaaugcuuuacauuucuaaagaaaagcaauuacacaguaguuucccuagauaaacaaguugagcguauucuaucaaugccacuauucauagagcggggcuucauggacgauaaaccaacuauguuagaaggaaagagcuacaaacaacauaaagaaaaauuugcagauugguuuguacacuacaaagaaaacaguaacuaucaaaacuuuuaugacacagaaguauacgaaauuaccacggaagauaaaagagaaaaagcaaaaguaacaaagaaaauaaaacaacaacagaaaaacgauguuuucacacuuaugaugguuaauuauaugcuagaagagguacuaaaauuauccaguaacgacagacuuagcuuaaacgaauuauaccaaacaaaagaagaaagaaucguuaacaaacaaguagcaaaagauacacaagaaagaaacaaaaacuauauauggaacaaaguuguugaucuacaacuaugugacgguuuaguucauauugacaaugugaaacuaaaagacauagguaauuuucgaaaauacgaaaaugacaguagaguaaaagaguuucuaacuuaccaauccgauaucguauggucggcauaucuaucuaaugaggucgacagcaauaaacucuacguaauagagaggcaacucgacaacuacgaauccauuagaagcaaagaacuauuaaaagaaguacaagaaauagaauguucuguauacaaccaaguagcuaauaaagaaagccuuaaacaaucaggaaacgagaacuucaaacaauacguauuacaaggccuccuaccaauuggaauggacgucagagaaauguuaauauuaucaacagacguaaaauuuaagaaagaagaaauuauacaauuaggacaagcuggagaaguugaacaagauuuauauuccuuaauauauauacgaaauaaauucgcccacaaccagcucccaauaaaagaguucuuugacuuuugcgaaaacaauuauagaucaaucucggacaacgaauauuaugcagaauacuacauggaaauuuucagauccaucaaagaaaaauacgcgaacuaa

SEQ ID NO: 11541 - RNA, 3465 nt, Artificial Sequence
  Cas13b variant__Paludibacter propionicigenes__WP_013446107.1__Cas13b
augaaaacaagcgccaauaacauauacuucaacggcauaaacuccuuuaagaaaauauuugauucaaagggagcaauagccccaauagcagaaaaaaguugcagaaacuucgacaucaaagcacaaaaugauguaaacaaagagcaacgaauacauuauuuugcaguaggacacacauucaaacagcuggacacagaaaaccuauuugaauauguuuuagacgaaaacuuaagggcuaaaagaccaaccagauuuaucucccuacaacaauucgacaaagaauuuaucgaaaauauaaaacgucuaauaucugauauacgaaacaucaauucccacuauauacacagauuugacccucuaaaaauagaugcaguuccaacaaacaucauagacuuucuuaaagaaucauuugaacuugcaguaauacaaauauaccucaaagaaaaaggcauuaauuaucuucaauucucagaaaauccgcaugcugaucaaaaacuaguugcauuccuacacgauaaguuccuuccacuugaugaaaaaaaaaccuccauguuacaaaacgaaacaccacaauuaaaagaauacaaagaauacagaaaauauuuuaaaacacuuagcaaacaagccgcaauagaccaauuacuuuucgcagaaaaagaaacagacuacauauggaaucucuucgacucacauccaguccucacaaucuccgcaggcaaauaccuauccuucuacuccugccuuuuucuccucuccauguuccuauauaagucagaggcaaaccaacuuauaucuaaaaucaaaggauuuaaaaaaaauacaacggaagaagaaaaauccaaacgugaaauauuuacauucuuuuccaaacgcuucaauucaauggacauagacucagaagaaaaccaacuuguaaaauucagagaucuaauacucuaccuuaaucauuaccccguagcauggaauaaagacuuagaacuagacaguagcaaucccgcuaugacugacaaacuaaaaucaaaaauaauagaacuugagaucaacagauccuucccccucuaugaaggaaaugaaagauuugcgaccuucgcaaaauaucaaauauggggaaaaaaacaccuuggcaaaucaauugaaaaagaauacaucaacgcaucauucacagacgaggaaauaacugcauacacguacgaaacugauaccugccccgaguuaaaagaugcacacaaaaaacuagcagaucuaaaagcagcuaaaggccucuucggaaaacgcaaagaaaaaaacgaaucagauaucaaaaaaacugaaaccucuauaagagaacuucaacaugaaccaaacccuauaaaagauaaauuaauacaacgaauagaaaagaaucuccuaaccguaucauauggacgcaaucaagacagauuuauggauuuuuccgcuagauuccuagcugaaaucaauuauuucgggcaagaugcaagcuuuaaaauguaccacuucuacgcaacugacgaacaaaacucagaauuagaaaaauaugaacuaccgaaagauaaaaaaaaauaugacucucuaaaauuccaccaaggaaaacuaguccacuucauaucauacaaagaacaccuuaaacgcuacgaaagcugggacgacgcuuuuguaauagaaaauaaugcgauacaguuaaaacuaucuuucgauggaguagaaaacacaguaaccauucagagagcacuauuaaucuaucuccucgaagacgccuuaagaaauauacaaaacaacacagcagaaaaugccggcaaacagcuucuacaagaauacuauucccacaauaaagcugauuuaucagcauucaagcaaauacuaacucaacaagauuccauugaaccacaacaaaaaaccgaauuuaaaaaacuacuuccccgaaggcuauuaaauaauuauucgccugccaucaaucaucuccaaacaccacacagcucacuaccacuaauacuagaaaaagcucuacucgcagaaaaaagauauugcucccuuguagugaaagcaaaagccgaaggaaauuaugacgacuucauaaaaagaaauaaagguaaacaauuuaaacuucaauucauacgaaaagcuuggaaucuuauguacuucagaaauagcuaccuucagaauguccaagcugcaggccaucacaaauccuuccauauugaacgggaugaauucaacgacuucuccagauacauguuugcauucgaagaauuaucucaauacaaauauuaccuuaaugaaauguuugaaaaaaaagguuucuuugaaaauaaugaauucaaaauccuauuucaaagcggaaccucacuugaaaaccuauaugagaaaacaaaacaaaaauucgaaaucuggcuggcaucuaacacggccaaaaccaacaaaccagacaacuaccacuuaaauaacuaugaacaacaauucucaaaccaacuauuuuucauaaaccuuagccauuuuaucaauuauuuaaaaucaaccggaaagcuucagaccgaugccaauggacaaauuauuuaugaagcacuaaauaacguacaauaccuaauacccgaguacuacuauacugacaaaccugaacgaagcgaaucgaaaucuggaaauaaauuauauaacaaauuaaaagccacaaaauuagaagaugcccuacuauacgaaauggcaauguguuacuugaaagccgauaaacaaaucgcagacaaagccaaacauccuauaacaaaauuacuaacaucagauguugaauucaauauaacgaacaaagagggaauacaacuauaucaucuauuaguacccuucaaaaaaauagacgcuuuuauuggacuaaaaaugcauaaagaacaacaagacaaaaaacaucccacauccuuucuagcuaacauaguaaacuacuuagaacucguuaaaaaugacaaagacauacgaaagacuuacgaagccuuuucaaccaauccagugaaaaggacccuaacauacgaugauuuagcuaaaauagauggacaucucauaucaaaaagcauaaaauuuaccaauguuacccuagagcuagaaagauauuuuaucuucaaagaaucacuaaucgucaaaaagggaaacaauauagacuucaaauacaucaaaggcuuacgaaauuacuacaauaacgaaaaaaaaaaaaacgaaggcaucagaaacaaagcuuuccacuucggaauacccgauucaaaaaguuacgaccaacuuauacgcgaugcugaaguaauguuuaucgcaaacgaaguaaaaccaacccacgcaaccaaguacacagaccuaaacaaacaacuccacacuguuugcgauaaauuaauggaaacgguacacaacgacuauuucagcaaagaaggagaugguaaaaaaaagcgcgaagcagcaggacagaaauacuuugaaaacauaauauccgcuaaauag

SEQ ID NO: 11542 - RNA, 3396 nt, Artificial Sequence
  Cas13b variant__Phaeodactylibacter xiamenensis__WP_044218239.1__Cas13b
augacgaacacacccaaaagacgaacacuacauagacacccuaguuacuuuggcgcauuucuaaauauagcccgacauaacgcauucaugauaauggaacaucuaucaaccaaguacgacauggaagauaaaaauaccuuagacgaagcacagcuaccaaaugcaaaacuauuuggaugccuaaaaaaacgauacggcaaacccgaugucacagaaggggucagucgagaccuacgcagauacuuuccauuuuuaaacuauccgcuauuucuacaucuagaaaaacaacaaaaugcugaacaagccgcaacauaugauauaaacccagaagacauugaauucacauuaaaaggauucuuuagguuacuaaaucaaaugcggaacaauuacagucacuauauaucaaauaccgacuauggaaaauuugauaaacuaccaguacaagacauauaugaagcagcaaucuuucgucuacuagaccgaggcaaacauacaaagcgcuucgauguauucgaaucaaaacauacucgccaccucgaaaguaauaauucagaauauagaccccgcucucuagcaaacucaccugaccacgaaaauacugucgcguuuguaacaugucucuucuuagaaagaaaguaugcuuuucccuucuuaucuagauuagauugcuuccguuccaccaaugacgcagcggaaggcgacccuuuaauacgaaaagcaucacacgaaugcuauacaauguucugcuguagacucccccaaccaaaacucgaauccuccgauauacuauuagacaugguaaacgagcuuggaagaugcccauccgcacuauauaacuuauuaucagaagaagaucaggcaagauuccacaucaaacgugaagaaauaaccggauuugaagaagacccggaugaagaauuagaacaagaaauaguccuuaaacgacauagugaccguuucccauauuuugcucucagauauuuugacgacaccgaggcauuucaaacgcuaagauuugacguauaccuuggaagauggagaaccaaaccaguuuacaaaaaacgcauauauggccaagaaagagaucgaguauuaacacaaucuauacgcacauucacaagacuuucuagauuacucccaaucuaugaaaaugucaaacaugacgcuguaagacaaaacgaggaagauggaaaacuaguaaaccccgacguaacuagucaauuucauaaauccuggauacaaauagaauccgacgacagggcuuuucuuagugaucgcauagaacacuuuucuccccacuacaauuuuggugaucaagucauuggacuaaaguucauuaacccagacagauacgcggcaauucaaaacguauuccccaaacuaccuggugaagaaaaaaaagacaaagaugcaaaauugguaaacgaaacugcagaugcaaucauaucaacacacgaaauacgaucacuuuuucuuuaccacuacuugagcaaaaaaccaauaagcgccggagaugaacgaagauucauucaaguagacaccgaaacauucauaaaacaauauauugacacaauaaaauuauuuuucgaagacaucaaauccggagaauuacaacccauagcagacccaccaaacuaucaaaaaaaugaaccccuaccauacguccguggagauaaagaaaaaacacaagaggaaagggcacaauaucgagaacgacaaaaagaaaucaaagaaagacgaaaagagcuuaauacauuacuucaaaaccgcuacgggcucagcauacaauauaucccaucacgucuaagagaauaccuacuaggauacaaaaaaguaccauaugaaaaacuagcacuccaaaaacuaagagcccaaagaaaagaagucaaaaaacgaauaaaagacauagaaaaaaugagaaccccacgagucggcgaacaggcaacaugguuagcagaagacaucguguuccuuaccccaccgaagaugcacacuccagagcggaaaacaacaaaacacccacaaaagcuaaacaaugaccaauuccgcauaaugcagucgucuuuagcauauuuuucaguuaauaaaaaagcaaucaaaaaauuuuuccaaaaagagacagguauaggauuaagcaauagagaaaccucacacccuuucuuauaccgcaucgacguaggucguugccgaggaauccuugauuuuuacaccggauaucuaaaauacaaaauggacuggcuugaugaugcaauaaaaaaaguugauaaucgaaaacacgguaaaaaagaagcaaaaaaguaugaaaaauaccuaccaucaaguauucaacacaaaacaccacuagagcuagauuauacgagacuaccaguguaucugccacgaggccuauucaaaaaggcaauaguaaaggcucuagcugcccacgcagauuuccaaguagaaccugaggaggacaauguaauauucuguuuagaccaauuacuagacggcgauacacaagacuuuuauaauuggcaaagauacuaccgaucugcgcuaaccgaaaaagaaacugauaaucaauuaguacuagcacacccauacgcagaacaaauucucgguacgaucaaaacacuagaagggaaacaaaaaaacaacaaacucggcaacaaagcaaagcaaaaaauaaaagaugaacuaauagaccuaaagcgggcaaaaagacgacuccuagaccgugaacaauauuuacgagccguucaagcugaggauagggccuuauggcuaaugauacaagaaagacaaaaacaaaaagccgaacacgaagaaauagcauucgaucaacuagauuuaaaaaauaucacgaaaauccugacagaaucgauugaugcacggcucaggauacccgauacaaaaguagauauuacugacaaacuaccauuacgacgauacggagacuugcgacgaguagccaaagauagacgguuaguuaaccucgcaucauacuaucauguagcaggacucucagaaaucccauacgaucuaguaaaaaaagaacuagaagaauaugauagaagacgaguggccuuuuuugaacacguauaucaauucgagaaagaaguuuaugaccgauacgcagccgaauuaagaaacgagaaccccaaaggagaaucgacauauuucucacauugggaauauguagcuguugcaguaaaacacagcgcagacacucacuuuaacgagcuguuuaaagaaaaaguuaugcaacuaagaaacaaauuccaucacaaugaauucccuuauuucgacugguuauuaccugaaguagaaaaagcuucugcagccuuauacgcagacagaguauuugauguagccgaaggauauuaucaaaaaaugcgaaaauuaaugcgacaguaa

SEQ ID NO: 11543 - RNA, 3408 nt, Artificial Sequence
  Cas13b variant__Porohyromonas gingivalis__WP_012458151.1__Cas13b
augaacacuguuccagcuucugagaacaaaggccaaucgagaaccguagaagacgacccacaauauuuugguuuauaucuaaaucuagcuagggaaaaccuaauagaaguagaaagccaugucaggauuaaauuuggcaaaaaaaaauuaaaugaagaaagucuaaaacaaagccuuuuaugcgaucaucuccuuaguguugauagguggacgaaaguuuauggacauucgcgaagguaccucccauuuuugcauuauuucgauccugauucacaaauugaaaaagaucacgacaguaaaacaggaguagacccagacagcgcacaaagacucaucagagaacuauauuccuuacuagauuuccuucguaacgacuucucacauaacagacuagacggaacaacuuuugaacaucuugaaguaucaccagauaucagcucguucauuacuggcacauacagccuugcaugugguagagcucaaagucgcuuugcuguuuucuuuaaaccagaugacuuuguacuagcgaaaaauagaaaagaacaacucauaagcguugcagacggaaaagaaugucuaacagugucuggcuucgcauuuuuuauaugccucuuuuuagaccgagaacaagcgucaggaauguugucacgaauacgaggauuuaaaagaacagaugagaauugggcuagggccguacaugaaaccuucugugacuuaugcauccgucauccccaugacagauuggaaucuaguaauacuaaagaagccuuauuacuagauauguuaaacgaacuaaaccgcugcccacguauacuauaugauaugcuaccagaagaagaaagagcacaauucuuaccagcacuagaugaaaacucaaugaacaaccuaagcgaaaacucauuagaugaagaaaguagauugcuuugggacggaucuucagauugggcagaagcccuaacuaaaagaauacgccaccaagaucgcuucccauaccucaugcuacgcuucauugaagaaauggaucuacuuaaagguauaagauuccguguugauuugggugagauagaacucgauucguauuccaaaaaaguaggaagaaauggagaauaugauagaaccauaaccgaccaugcguuagcauuugguaaauuauccgauuuucaaaaugaagaagaaguauccagaaugauauccggagaagcaucguauccaguucguuucagucuguucgccccaagauaugcaaucuaugauaacaaaauugguuauugucauaccagcgauccagucuacccaaaaucaaaaacuggagaaaaaagagcccuaagcaauccacaaucaaugggauucauaaguguacaugaccuaagaaaauuauuacuaauggaauugcuaugugaaggaaguuuuagcaggaugcaaucugauuuucuaagaaaagcaaaccgaauccuugacgaaaccgccgaaggaaaauuacaauucucggcucuauuucccgaaaugagacacagauuuauaccaccacaaaauccuaaaucaaaagauagaagagagaaagcugaaacaacauuagaaaaauauaaacaagagauuaaagguagaaaagacaaguuaaauucgcaauuacucagcgcauucgacauggaccaaagacagcuaccaucgcgacuauuggacgaauggaugaacauaagaccagcaucucacuccguaaaacucagaacauauguaaaacaacuaaaugaagacuguagacuucgucuaagaaaauucagaaaagauggcgauggaaaagcuagggccauucccuuaguaggugaaauggcaacuuuucucucacaagauauaguaagaaugauuauaagcgaagaaaccaagaaacuuaucacuuccgcuuauuacaaugaaaugcaaagaucauuagcacaauacgcuggcgaagaaaaucggagacaauucagagcaauaguagcagaauuaagacuauuagacccaagcucuggucauccauuccucucagcgacuauggaaacagcacacagguacacagaaggauuuuauaaauguuaccuggagaaaaaacgagaaugguuagcaaaaauauuuuacagacccgaacaagaugaaaacacaaaaagacgaauuucuguauucuucguuccugacggugaagccagaaaacuacucccauuauuaauacgacgacgaaugaaagaacaaaaugaccuccaagauuggauaagaaacaaacaagcacacccaaucgauuuaccuucacaucuauucgauaguaaaguaauggaauuacucaaagucaaagauggaaaaaaaaaauggaaugaagcguuuaaggacugguggucaaccaaauacccggauggaaugcaaccauucuauggacugcgaagagaacucaacauccaugguaaaucaguaaguuacauuccgucagacggaaaaaaauuugcagacuguuacacccaucuaauggaaaagaccgucagggauaagaaacgagaacugaggacagcaggaaaaccaguaccaccagaucuugcugcagauaucaaaagaucguuucacagagcaguaaacgaacgcgaauuuaugcuaagacuuguccaagaggaugauagauuaauguuaauggcgauuaauaaaaugaugacagacagagaagaagauauccuaccuggccuaaaaaacauagauucaaucuuagaugaagaaaaccaauuuucccuagcaguacacgcaaaaguacuagaaaaagagggugaaggaggugauaauucucuaucauuaguucccgcaacaauagagauaaaauccaaaagaaaagacuggaguaaauauauaagauacagauaugaucguagagucccgggucuuaugucacauuuuccugaacauaaagcaacuuuagacgagguaaaaacauuauuaggagaauacgauagauguagaauaaaaauauuugacugggcauuugcgcuagaaggagcgauaaugagcgaucgagaucucaaaccuuauuuacaugagaguaguaguagagaaggaaaaaguggggaacauucaacacuaguaaaaauguuaguagaaaaaaaggguugccuuacgccagacgaaucucaauauuuaauacuaauaagaaauaaagcagcacacaaccaauuuccgugugcugcagaaaugcccuuaaucuaucgcgacguaucggcaaaaguagguagcauagagggcucaagcgcaaaagaucuacccgaaggcucaagucuuguugauucauuguggaaaaaauaugaaaugauaaucagaaaaauauuaccaauacuagauccagaaaaccgauucuucggcaaacuguugaauaacaugagccagcccauaaaugacuuauaa

SEQ ID NO: 11544 - RNA, 3408 nt, Artificial Sequence
  Cas13b variant__Porohyromonas gingivalis__ERJ81987.1__Cas13b
augaauacaguucccgcaagcgaaaauaagggccaaaguagaacuguagaagacgacccacaauacuuuggacuuuaccuaaaucuagcuagagaaaacuuaauugaaguagaaucacauguuaggauaaaauucgguaaaaaaaaauuaaacgaagaaaguuugaaacaaaguuuacuaugcgaccaccugcuaucgguagauagauggaccaaaguuuauggacauagccgaagauaccucccauuucuacacuauuuugaucccgacucacaaaucgaaaaagaucaugauucaaagacagguguagauccagacagugcccaaagacuuauaagagaauuauacucuuuauuagacuuccuaaggaaugacuuuagccauaacagguuagacgguacaacuuuugaacaucuagaaguaucuccagauauaucuaguuuuauaacgggaacauacucauuagcauguggacgcgcacaaucucgauuugcggauuucuucaagccagaugauuucguacuagcaaaaaaccgaaaagaacaacuaauaucaguagccgacggcaaagaaugccuaacagucaguggucuagccuucuucaucuguuuauucuuagaccgcgaacaagcaagcggaaugcuaagccguauuagaggauuuaaacgaacagacgaaaacugggcaagagcagugcacgaaacauucugugauuuauguauaagacauccacaugaucgacuagagucauccaauacaaaagaagcacuauuacuagauaugcuuaaugaacuaaauagauguccacgaauuuuauaugauaugcuaccugaagaagaaagagcccaauuccuacccgcuuuagacgaaaacucuaugaauaaccugagugaaaacucgcuaaaugaagaaucacgauuacuuugggacggaucaagcgacugggcugaagcccuuaccaaaagaauuaggcaccaagauagauuucccuaccuuaugcuacgauuuaucgaggaaauggaucuacugaaaggaaucagauuuagaguagaucuuggagaaauagaacuagauuccuauagcaaaaaaguuggaagaaauggagaauacgauagaacaauaacagaccaugcauuggcauucggaaaguuaagugacuuucaaaacgaagaagaagucagucgaaugaucaguggagaagcgucauacccagucagauucagucucuuugcaccuagguacgcaaucuaugauaauaaaaucggauacugucacacuagugaucccguauacccuaaaucaaaaacaggagaaaaaagagcauuaagcaauccucaaagcaugggauuuauaucuguacacgauuuaagaaaacucuuauuaauggaacuucugugugaagguucauuuagcagaaugcaaucagguuuucuacggaaggcgaaucgcauucuugaugaaacagcggaaggaaaauugcaguuuucagccuuauuucccgaaaugcgccauagauuuauacccccccagaauccaaagucuaaagauagacgagaaaaagcagaaacaacgcuggaaaaauauaaacaagaaauaaaaggaagaaaagacaaauugaacagucaacuacucucagcauucgauaugaaucagagacaauugccaaguagauuacuagaugaauggaugaacaucagaccagcuagucauagcguaaaacuucguacauauguaaagcaacuaaacgaagauugcaggcucagauuaagaaaauuucgcaaagauggagauggaaaagcaagagcaauaccacuuguaggcgaaauggccacuuuuuuaucacaagacauagugagaaugauaauuagcgaagaaacaaaaaagcuaauuacaucugcuuauuauaaugaaaugcaacguucuuuagcacaauaugcuggagaggagaaucgaagacaauuuagggcaauaguugcggaacuucaucuauuagauccgucaucuggccauccauucuuaucagcuacgauggaaacugcacaucgauacacugaagacuucuacaaauguuacuuagaaaaaaaaagggaauggcuagcaaaaacguucuaucggcccgagcaggaugaaaauacaaaaagacguauaagcguuuuuuucguuccagacggagaagcacgcaaacuucugccucuacuaauacggagacgaaugaaggaacaaaaugaccuacaagauuggauacgaaacaaacaagcucacccuaucgaccuucccagucacuuauucgauucaaagaucauggaacuguuaaaaguaaaagaugggaaaaaaaaauggaacgaagccuucaaagacugguggagcaccaaauaucccgauggcaugcaaccauucuauggauuacgacgagaacuaaauauacacggcaaaucuguuuccuacauuccuagugaugguaaaaaauuugcggacuguuauacacacuuaauggaaaaaaccguucaggacaaaaaaagggaacugcgaaccgccggcaaaccugucccaccugaucuagcagcugauauaaaacgaaguuuccaccgagcagucaaugaacgcgaauucauguuacgauuaguacaagaagaugaccgccuaauguuaauggcuauaaacaagaugaugacagaucgcgaagaagacauacuaccuggccuaaaaaauauagacucaaucuuagacgaagaaaaucaauuuucccuagccguccacgccaaaguauuagaaaaagagggugaaggcggugauaacaguuuaaguuuaguaccagcaacaauagaaauaaaaaguaaaagaaaagacuggaguaaauacauaagauaucgauacgaucguagggucccaggccugaugagucacuuucccgaacauaaagcaacacuugacgaaguaaaaacacuuuuaggagaguaugaccgaugucgaauuaagauauucgacugggcauuugcauuagaaggggcaauaaugucagauagagauuuaaaacccuaccuacaugaaucuucaaguagagaaggaaaaucgggagaacauucaacacuaguaaaaaugcuuguagagaaaaaagguugccugaccccugacgagucacaauauuuaauacucauccguaauaaagcagcucauaaccaauucccuugcgccgcagaaaugccacugaucuacagagacguuagcgcaaaagucggaucaauagaaggaucaagugccaaagacuuaccugaaggaucaagcuuaguagacucacuuuggaaaaaguaugaaaugauaauacguaagauauuaccuauauuagaucaugaaaacagauucuucggaaaacuucuuaacaacaugucacaaccuauaaacgauuuauaa

SEQ ID NO: 11545 - RNA, 3408 nt, Artificial Sequence
  Cas13b variant__Porohyromonas gingivalis__ERJ65637.1__Cas13b
augaauacugugcccgcuagugaaaauaaaggucaaagccgaacgguagaagacgacccucaauauuucggcuuauaccucaaccuagcaagagagaaccuaauagagguugaaucacacguaagaauaaaguucggaaaaaaaaaacuaaaugaagaaucacuaaaacaaagucucuuaugcgaucacuuauuaucaguugacagauggacuaaaguauauggucauucacgaagauaccucccauuuuuacacuauuuugacccggacagccaaaucgaaaaagaccacgacagcaaaacaggaguugacccagauucugcacaacgacucauccgcgaacuauauucacuuuuagacuuucucaggaaugacuuuagucauaaucgacuagacggaacaacauuugaacaccuagaaguuucccccgauauaagcuccuuuauaacagguacauauagccuugccuguggcagagcucagagcagauuugccgauuuuuuuaaaccagacgacuuuguacucgcaaaaaacagaaaagaacaacucauaucaguagcagacggaaaagaaugucugacuguaucaggacuugcauuuuuuauuugcuuauuucuagacagagaacaagcaucaggcaugcucucuagaaucagagguuucaaacgaacugacgaaaauugggcgcgagcaguacaugaaaccuuuugugauuuauguauuagacacccacaugacagacucgagagcucaaauaccaaagaagcgcuauuauuagauauguuaaaugaacucaaucguuguccaagaauacuauacgacauguuacccgaggaagaaagagcacaauucuuaccagcgcuagacgaaaacucaaugaauaacuuaagugaaaacagucuuaacgaagaaaguagauuauuaugggauggaucaagugacugggccgaagccuuaacaaaacguauaagacaccaggauagguucccauauuuaaugcuuagguuuauagaagaaauggacuuacugaaaggaauacguuuuagagucgauuuaggcgaaauagaauuagauaguuacaguaaaaaagucggcagaaauggagaauacgauagaacaauaacggaucacgcauuagcuuuuggcaaauuaagcgauuuucaaaacgaagaagaaguaucgagaaugauuaguggugaagcuagcuacccagucagauuuagccucuucgcaccaagauaugcaauauaugauaauaaaauuggauacugucauaccucagacccgguuuauccaaaaaguaaaaccggcgaaaagcgcgcauuaucaaacccaaggaguaugggauuuaucagcguucaugaccuucguaaauuauuauuaauggaacuauuaugugagggaagcuuuuccagaaugcaaagugauuuucuuagaaaagcuaauagaauucuagaugaaacagccgaaggaaaauuacaauucucagcacucuucccagaaaugcgacaccgauuuauaccaccucaaaauccaaaaaguaaagacagaagagagaaagcagaaacaacucuagaaaaauacaaacaggaaauuaaagguagaaaagauaaacuaaauucucaacuucuuagugccuucgauauggaucaaaggcaacuaccuagcagacuacuagacgaauggaugaacauaagaccugccucccacucaguaaaacuccguacauacgucaaacaacuaaaugaagauugccguuugagacuacaaaaauuuagaaaagauggcgacggcaaagcaagagcaauuccacucguaggagaaauggcaacauucuugucacaagauauaguacgaaugauuauaucagaagaaacuaaaaaauuaaucacaagcgcauacuauaaugaaaugcaaagaagccuagcucaguacgcaggagaagaaaaucgacaccaauuucgagcaauaguugcagaauuaagauuauuagacccaucauccggucauccauuuuuaucagcaacgauggaaacggcacauagauauacugaagacuuuuacaaauguuaucuagaaaaaaaaagagaauggcuagccaaaacuuucuaucgaccagaacaagacgaaaauacaaaacguagaauauccguauuuuucguccccgacggagaagccagaaaauuauugccccuauuaauaagaagaagaaugaaggaacaaaaugaucuccaagauuggauaagaaacaaacaagcgcacccgaucgaccucccgagucacuuguuugauucaaaaauuauggaauuacuaaaagucaaagauggaaaaaaaaaauggaaugaagccuucaaagacugguggaguaccaaauauccagauggaaugcaaccauuuuacggauuacgaagagaacuaaauauccacggaaaaucuguauccuacauaccaucagacgguaagaaauucgcagacugcuacacacauuuaauggaaaaaacgguacaagauaaaaaaagggaauugcguacagcagggaagccaguaccuccagacuuagccgccgauaucaaaaggaguuuccauagagccguaaaugaaagagaauuuauguugagacuaguacaagaagaugauaggcuaaugcuaauggccauaaauaagaugaugaccgaccgagaagaagacauuuuaccaggacuaaaaaauauagauucaauuuuagacgaagaaaaucaauuuagccucgcaguacacgcaaaaguuuuagaaaaagaaggagaaggaggcgacaauagucuuucucuaguaccggccacaauagagaucaagucaaaacgaaaagauuggucgaaauacauaagauauagauacgaucgacgugugccaggacuaaugucucauuucccagaacauaaagcaacuuuagacgaaguaaaaacauuauuaggcgaauaugaccgaugcagaauaaagaucuucgacugggccuucgcacuugaaggcgcuauuaugucagauagggacuugaaacccuauuuacacgaaucuaguucacgagaaggaaaaaguggugaacacagcacuuuggucaaaaugcucgucgaaaagaaaggcugcuuaaccccugacgaaucucaauacuuaaucuuaauaagaaacaaagcagcacauaaucaauuuccaugugcagcagagaugccacuaauauaccgagacguaucugcaaaagucgguucaauagaagguagcuccgcuaaagaucuuccagaaggaagcucacucguggacucacucuggaaaaaauaugaaaugauuauaaggaaaauacuacccauauuagacccggaaaauagguuuuuuggaaaauuacugaacaauaugagucagccaauaaacgauuuguag

SEQ ID NO: 11546 - RNA, 3408 nt, Artificial Sequence
  Cas13b variant__Porohyromonas gingivalis__WP_021665475.1__Cas13b
augaacacugugcccgcauccgagaacaaaggccaaagcagaacaguggaagacgauccucaguauuuuggauuauaccuaaacuuagcucgugagaaucuaauugaaguggaaagucaugucagaauaaaauucggcaaaaagaaacucaaugaagaaucauuaaaacaaagccuauuaugcgaucaucuacuaucaguggaucgcuggacuaaagucuacggacacaguagaagauauuugccuuucuuacacuacuuugacccagauagccaaaucgaaaaagaucacgacucaaaaacaggaguugauccagacagcgcacaacgauugauaagagagcuauauucguuacuagacuuucugcgaaaugacuucucacacaauagauuagauggaacaaccuuugaacauuuagaaguaucaccugauauaagcucauucaucacgggcacauauucuuuggcaugcgggagagcucaaaguagauuugcugauuucuucaaaccagaugauuucguacuggcuaaaaaucgaaaagaacagcuaauuagcguagcagauggaaaagaaugucuaacagugaguggauuagcauucuuuauaugucucuuucuagauagagaacaggcaucagguaugcuaucaagaaucagaggguuuaaacggacaaaugaaaacugggccagagcaguacacgaaacauuuugcgaccuauguauaaggcauccccacgauagauuagaaucaucaaacacgaaggaagcacuacuauuggauaugcuuaacgaacuaaauagguguccaagaauacuuuacgacaugcuaccggaagaagaaagagcucaauuccuaccagccuuggacgaaaauucuaugaauaaccuaucagaaaauaguuuaaaugaagaaucacgacuauuaugggacggaaguucagauugggcagaggcuuuaacuaaacgaauaagacaccaagaucgauuuccauacuugaugcuaagguuuauugaagaaauggaccuacuaaaaggaauacguuuucgaguagauuuaggcgaaauagaauuagacucauacagcaagaaagucggucgaaauggugaauaugaccgaacaaucacugaccacgcacucgccuucgguaaacucucagacuuccaaaacgaagaagaagucucaaggaugauaucaggagaggcuucuuacccaguucgauuuagcuuauuugcaccacgguaugcaaucuaugauaauaaaauuggguacugccauacaucagaucccguuuaccccaaaucaaaaacaggagaaaagagggccuuaucuaauccacaaaguaugggguuuauuaguguacacgauuuaaggaaauuauuacuaauggaacuacuaugcgaaggcucuuucuccagaaugcaaucagguuuccuaagaaaagcaaaucgaauacuagacgaaacagcugaaggaaaacuacaauuuucugcauuguuccccgaaaugagacauagauuuauuccaccccaaaauccaaaaucaaaagauagaagagaaaaagcugaaaccaccuuagaaaaauauaaacaagaaaucaaagguaggaaagauaaacuaaacagucaguuauugagugcauucgauaugaaucaaagacaauuaccaucacgauuacucgacgaauggaugaacauaagaccagcaagccauucaguaaaacuaagaaccuauguaaagcaacucaaugaagacugccgauuacguuuaaggaaauucagaaaagacggagacgguaaggcuagggcuauuccgcuugucggugaaauggcgacauuccugucucaagacauaguuagaaugauaauuuccgaagaaacgaagaaacuuaucacaagcgcauauuauaacgaaaugcaacgaucacuggcucaauacgcaggagaagaaaauagacgacaauucagagcuauaguagccgaacuacaucuauuggacccuucaucgggccauccauuucuaucagccacaauggaaacagcacacagauacacagaagacuuuuacaaauguuaccuagaaaagaaaagagaauggcuugcaaaaaccuucuacaggccagaacaagacgaaaacacuaaacgaagaauauccguauucuucguacccgacggagaagcaagaaaacuccuuccucuauuaauuagaagaagaaugaaagaacaaaacgauuugcaggauuggaucagaaacaaacaagcccacccaauagacuuaccuucacaucuuuuugacagcaaaauuauggaacuacuuaaaguaaaggacgggaaaaagaaauggaacgaggcuuucaaagauugguggagcaccaaauaucccgaugguaugcaaccauucuacggccuacgaagagaauuaaauauacacggaaaaucggucucauacauaccuucagacgguaagaaauuugcagauuguuauacccaucuuauggagaaaacaguacaagauaagaaaagagaacucagaacagcugguaaacccguaccacccgauuuagcagcagacaucaaaagaaguuuucauagagcaguaaaugaaagagaguucaugcuacgccuaguacaagaagacgacagauuaaugcuaauggccauaaacaaaaugaugacagauagagaagaagauauucucccaggccuuaaaaauauagacucaauacuagacaaagaaaaccaauuuucguuagcagugcaugcaaaaguuuuagaaaaagaaggagaagguggggauaacucuuugucucuagucccagcaacgaucgaaauaaaaucaaaaagaaaagauuggagcaaauacauccgauauagauacgauaggagaguaccaggacuaaugucacauuuucccgaacauaaagcuacauuagaugaagucaaaacacuacuaggagaauacgauagauguaggauaaaaauauuugacugggcauuugcauuagagggagcaauuaugagugacagagaccuaaaaccauaucuacacgaaucaucuucaagagaagggaaaucgggggaacacaguacccuaguaaaaaugcucguagagaagaaaggaugucuaacaccagaugaaagccaauaucuaauucucaucagaaauaaagccgcacauaaccaauuuccaugcgcagcagaaaugccacuaaucuaccgugacguuucagcaaaaguagguaguauagagggaaguuccgcaaaagacuuacccgaaggcucaucauuaguagacucauuauggaagaaauacgaaaugauaauaagaaaaauacucccaauauuggaucaugaaaaucgauucuuuggaaaauuauuaaauaauaugucacaaccaauuaacgaucuguaa

SEQ ID NO: 11547 - RNA, 3408 nt, Artificial Sequence
  Cas13b variant__Porohyromonas gingivalis__WP_061156637.1__Cas13b
augaacacuguacccgccuccgaaaacaaaggccagaguagaacuguagaagacgacccacaauauuucggucuauaccugaauuuagccagagaaaaucugauugaaguugaaagucauguaaggaucaaauuugggaaaaagaaauuaaacgaagagagucuaaaacaaucccugcucugcgaucauuuauuaaguguagacagauggacaaaaguauauggacacucaagacgauaucuaccguucuugcauuauuucgacccagauucacaaauugagaaagaccaugauagcaaaacaggagucgacccggacuccgcacaacgacuaaucagagaacuuuauucauuauuagacuucuuacgaaaugacuuuagucacaaucgcuuagauggaaccacauuugaacaucuugaaguaaguccagauauaaguucuuucauaaccgguacuuauuccuuagcauguggucgugcacaaagcagauucgcagauuucuuuaaaccagaugacuucguucuagccaaaaauagaaaagaacaacuaauauccguagcagauggaaaagaaugucucacugugagcggauuagcauucuucaucugucuuuucuuagaccgagaacaagccucaggcaugcuaucaaggaucagaggauucaaaagaacagaugagaauugggcaagagcuguacacgaaacguuuugugaucuauguauacgacacccacacgacagacuagaaucgaguaacacaaaagaagcgcuccuccucgauauguuaaacgaauuaaauagauguccacgcauacuauaugauauguuaccagaagaagaaagagcacaauuuuuaccagcucuugaugaaaauucgaugaauaauuuaagcgaaaacucguugaaugaagaaagcagacuacuaugggauggcucgucagacugggcugaagcacuaacaaaaagaauaaggcaucaagauagguuccccuaucuaaugcugcgauucauagaagaaauggauuuauuaaaaggcauacguuuucggguagaccuaggcgaaauagaacuugacaguuauaguaaaaagguugggagaaauggagaauacgauagaacaauuacagaucaugcacuugccuucggaaaacuuucagacuuucaaaacgaagaagaaguaucuagaaugaucucaggggaggcaucauaccccguacgauucagcuuauuugcgccccgcuaugccaucuaugauaauaaaauugguuacugucauacaucagacccagucuauccaaaaucaaagacuggugagaagagggccuuaucuaauccucaaucuaugggauuuauaucaguacaugauuuacgaaaacuauuauuaauggaacuacuaugugaagguagcuuuucuagaaugcaaucaggauuccuaagaaaagcgaaccgaauuuuggaugaaacugcagaaggaaaauuacaauucucagcuuuauucccggaaaugagacaucguuuuauaccuccucaaaauccaaaaucgaaagauagaagagaaaaagcagaaaccacauuagaaaaauacaaacaagaaaucaaaggaagaaaagauaaacuaaacucccaacucuuaagcgcauucgacaugaaccaaagacaacucccaagcagauuacuagacgaauggaugaauauccgaccagcaucacacucaguaaaauugagaacauauguaaaacaacuaaaugaagauugucgacuuagguuacguaaauuuagaaaagauggagacgguaaagcuagagcuauaccacuuguaggagaaauggcaacauuccuaagucaagacauaguucgaaugauaauauccgaagaaacaaagaaacuaauuacaagugcauauuacaacgaaaugcaaagaucccuggcacaguaugcuggcgaagaaaaucguagacaauucagagcuauuguagcugaacuacauuuacucgacccaucuuccggccacccuuucuuguccgcaacgauggaaaccgcccacagauacacagaggacuuuuacaaauguuacuuagaaaagaaaagagaauggcuagcgaaaacauucuaccgucccgaacaggacgaaaacacaaaaagaagaaucucaguuuucuuuguaccagacggagaagcuagaaaacucuuaccauuauuaauaagaagaagaaugaaagaacaaaaugacuuacaagacuggauaagaaauaaacaagcacauccaauagauuugccaucacauuuauucgauagcaaaauuauggaacugcuaaaaguaaaagacgguaaaaagaaauggaaugaagcauuuaaagauugguggucuacaaaauauccagauggcaugcagccauucuauggauugcgucgugaauuaaacauucacggaaaaaguguauccuauauuccaucggaugggaagaaauucgccgacuguuacacacauuuaauggagaaaacaguacaagauaagaaaagggaauuaagaacagcaggaaaaccaguaccaccagaccuugccgcagauauuaaaagaucuuuucauagagcaguaaacgaacgagaguucauguugcgauuaguucaagaagacgaucgucuaauguuaauggcaauuaauaaaaugaugacugaucgcgaagaagauauauuacccggacugaaaaauauagauucaauacuagauaaagaaaaucaauuuucucuugcaguucacgccaaaguacuugaaaaagaaggagaaggaggcgacaacagccucagccuaguacccgccaccauagagaucaaaucaaaacggaaagacuggucaaaauauauaagguauagauacgauagacgaguuccaggacuuaugucacauuuuccugaacacaaagcaacauuagacgaaguaaaaaccuuacucggagaauaugaccgaugucggaucaaaauuuuugacugggccuuugcucuugaaggagcgaucauguccgacagagaccuaaaaccauauuugcaugaaucaucaagucgagaagggaaaaguggagaacacucaacauugguaaaaaugcucguugagaaaaagggcugucuaacaccagacgaaagccaauacuuaauacuuauaaggaacaaagcugcacacaaucaauucccaugugcugcugaaaugccccuaauauacagagacguaucagcaaaagucggaucaaucgaaggaucaucagcuaaagaucuucccgaaggaaguucuuuaguugauucacuauggaagaaauaugaaaugaucauacgaaaaauauuaccaaucuuagauccugaaaacagauuuuucgguaaauuacucaauaauaugagucaaccaauuaaugaucuauaa

SEQ ID NO: 11548 - RNA, 3408 nt, Artificial Sequence
  Cas13b variant__Porohyromonas gingivalis__WP_023846767.1__Cas13b
augaacacuguaccagcgagcgaaaauaaaggacaaucaagaaccguggaagaugauccccaauacuuuggauuauaucugaauuuagcacgcgagaauuuaauagaaguggaaucucauguucgaaucaaauuuggcaaaaagaaauuaaacgaagagagcuuaaaacaaucucugcuaugcgaucauuuacuuucaguugaucgcuggacaaaaguauaugggcacucaagacgauauuuaccauuccuacacuauuuugacccugacucacaaauagaaaaagaucacgacucuaaaacaggaguagauccagauucggcacaaaggcugauaagagaauuauacagccuauuagacuuccuaagaaacgauuuuucacacaacagauuagauggaacaacauuugaacaccuagaaguuucaccugacauaucuucauucauaaccggaacuuauaguuuagcaugcggcagagcucaaucacguuuugccgauuucuucaaaccagaugacuucguuuuagcgaaaaacagaaaagaacagcuaauaagcguggcugauggaaaagagugcuuaaccguaucaggacuagcguucuucauaugccuguuccuugacagagaacaagcaaguggaaugcuaucuaggauccgaggauucaaacgaacugaugaaaacugggcaagagcuguucaugaaacuuuuugcgacuuauguauaagacacccucacgacagacuagaaagcucaaacacaaaagaagccuuauuacuggauaugcuaaacgaguuaaaucgauguccacgaauacuuuaugauaugcucccugaggaagaaagagcccaguuuuuaccagcauuagaugaaaacucaaugaauaaccuuucugaaaauucucuaaaugaagaaaguagauuauuaugggacggaucuucagauugggcagaagcacucacaaaaaggauucgacaucaagacagauuccccuauuuaaugcuaagauucauugaagaaauggaucuucuaaaaggcauacgauuucgcguggacuuaggugaaauagaacuagacucauauucaaagaaaguaggacgaaacggagaguacgaccguaccauuacugaucacgcauuagcauucggaaaacuuagcgacuuccaaaaugaagaagaaguaucacgaaugauaucuggcgaagcaucauacccaguccguuuuagucuauuugcuccuagauaugcuauuuacgauaacaaaauaggauacugccauaccucugacccuguguauccaaaaaguaaaacuggagagaaaagggcauuaagcaauccaaggucgaugggauucauuucuguccaugauuuacgaaaacuacuacuaauggaacuacuuugugagggaucauucucaagaaugcaaagugacuuuuuaagaaaagcuaauagaauacuagaugaaacagcagaagguaaauuacaauucuccgcacucuucccagaaaugagacaccgauucauaccaccucaaaaccccaagucuaaagauagaagagaaaaagcagagacuacacuagaaaaauauaaacaagaaauuaaagggagaaaagacaaauuaaacagccaacuuuuaagugcuuucgauaugaaucaaagacaacuucccucaagacuacucgaugaguggaugaauauuaggccagcuagucacucaguaaaacuuagaacauacgugaaacaacuuaaugaagauugccgauuacgauuaagaaaauucagaaaagauggagacgguaaagccagagcaauaccgcucguuggagaaauggcaacauuucugagucaagacauuguaagaaugauuauaucggaagagaccaaaaaguuaauaacauccgcauacuauaacgaaaugcaacgcuccuuagcccaauacgcuggcgaagaaaacagaagacaauuucgagcaaucguugcagaacuacaucuuuuggauccaucuucaggucauccauucuuaagugcaacaauggaaacugcacaucguuacacagaagauuucuacaaauguuacuuagaaaagaaaagagaaugguuagcaaaaacuuuuuauagaccugaacaagacgaaaauacaaaaaggagaauaucugucuucuuuguaccagauggggaagccagaaaacuccuaccgcuacuaauacggaggagaaugaaagaacagaacgaucuacaagacuggauaaggaauaaacaagcccacccaauagaucugccaagucacuuauuugacucuaagaucauggaacucuuaaaaguaaaggaugguaaaaagaaauggaacgaagcauuuaaagauugguggucaacaaaauauccagaugguaugcaaccuuuuuacggucuaaggcgagaauuaaauauacacgguaaaagcgucucauacauaccuagcgauggaaagaaauuugcugacuguuacacucaucuuauggagaaaaccguacaggauaagaaaagagaacuccgaacagcaggaaaaccugucccaccagauuuagccgcugauauaaaaagaucauuccacagagccguaaacgaaagggaguucaugcuacggcuugugcaagaagacgauagauuaauguuaauggcaauaaacaaaaugaugacggauagagaagaagacaucuuaccuggacugaaaaauauagacucaaucuuagacgaagaaaaccaauuuucuuuagccgugcaugcuaaaguucuagaaaaagaaggagaaggcggcgauaacucauugucauuagucccggcaacaauagaaauaaaaucaaaacgaaaagacugguccaaauacauuagauauagauacgaucgcaggguaccaggacucaugucgcacuuucccgaacauaaagcgacacuagacgaaguaaaaacuuuacuaggagaauaugaucgaugcagaaucaaaauauuugauugggcauucgcacuagaaggggcaauaaugucugaccgagauuuaaaaccauacuuacaugaaucauccucaagagaaggaaaaucaggugaacacuccacacuggugaaaaugcuaguugaaaagaaaggaugucuaacaccagaugaaucucaguaccuaauuuuaauacgaaauaaagcagcacauaaucaauuuccuugugcggcagaaaugccuuuaauuuauagagacguauccgcaaaaguaggaucaauagaagguucaucagcaaaagaucuaccagaaggaucaucucuaguagauucacuauggaagaaauaugaaaugauaauucgcaaaauuuuaccaauauuagacccagaaaaucgauucuuuggaaaauuauugaauaacaugagucaaccaauaaaugaucuauag

SEQ ID NO: 11549 - RNA, 3408 nt, Artificial Sequence
  Cas13b variant__Porohyromonas gingivalis__ERJ87335.1__Cas13b
augaacaccguucccgcgagcgaaaauaaaggucaaucaagaaccgucgaagaugacccucaauauuucggcuuauaucuaaaucuagcacgagaaaaucuaauugaaguagaaucccauguaagaauaaaauucggaaaaaaaaaauuaaacgaagaaagucucaaacaaucacuacuuugcgaucaccuauuaucgguugauagauggacuaaaguauacggacacagucguagauaccuaccauuccuacacuauuuugaucccgacucucaaauagaaaaagaccaugacuccaagacaggagucgacccagacagugcacaacgacuuauuagagaacucuauucucuguuagacuucuuaagaaacgacuuuucacacaauagacuagauggcacaacauucgaacaucuagaagucucaccagauauauccucauucauuacaggaaccuauagucuagcguguggacgcgcucaaucaagauuugcggauuucuuuaaacccgaugacuucguacucgcaaaaaaucgaaaagaacaacucauaucaguagccgacggaaaagaaugucuaacagucucaggucuagcauucuucauaugucuguuucucgauagggaacaagcaaguggcaugcuaucaagaauaagagguuucaagagaacugaugaaaacugggcaagagcaguacaugagacauuuugugauuuaugcauaagacauccacacgaucgacucgaaagcuccaacacgaaagaagcauuauuacuagauauguuaaaugaauuaaauagaugcccgcgaauauuauacgauauguuaccagaagaagaacgggcucaauuucuaccagcucuugacgaaaauucaaugaacaaucuaagugaaaacaguuuaaaugaagaaucaaggcuauuaugggauggaagcucagauugggcugaagcccuaaccaaacgcauacgucaucaagacagauuuccauaucuaaugcuacguuuuauugaggaaauggaccuucucaaaggcaucagauuuagaguagaucuaggagaaauugaacuagacaguuauuccaaaaaaguaggcagaaacggggaauacgaccguacaaucacagaccaugcguuagccuuuggaaaauuauccgacuuucaaaacgaagaagaaguaagcagaaugauuucaggagaagcuuccuacccaguacgauuuucacucuuugccccacgauacgccauauaugauaacaagaucggauauugucacacaucugauccuguauauccaaaauccaagacaggagaaaaaagagcguugucaaauccaagaucaaugggauucauauccguacaugaucuacguaaacucuuacuuauggaauuacuaugugagggaucauuuucacgaaugcaauccgacuuccuaagaaaagcaaaccgaauuuuagaugaaacagcggaaggaaaacuacaauuuagugcguuauucccagagaugagacaccgauuuauuccaccacaaaaccccaaaaguaaggauagaagagaaaaagcugaaacaacauuagagaaauauaaacaagagauaaagggcaggaaagauaaguuaaacucccaauuacugucugcguucgacauggaccaacgccaacuuccaagccgccuccuagaugaauggaugaacauuagaccugccucgcauucuguaaagcuaagaaccuacguaaaacaguuaaacgaagauugccgccuacgcuuacagaaguucagaaaagauggugauggcaaagcaagggccauaccacugguaggagaaauggcaacauuuuuaucacaagacauagucagaaugauaauaucagaagaaacaaaaaaacuaauaacaucugcauacuauaacgaaaugcaaagaagucuagcccaauaugcaggcgaagaaaaucgacaccaguuucgcgcaauaguugccgaacuuagauuacuagaccccucguccggccauccuuuuuugucagcgacuauggaaacugcacauagauacacagaggauuuuuauaaauguuaucuagaaaaaaaacgagaauggcucgcaaaaacauuuuaccggccugaacaagacgaaaacaccaaaagaagaauaucuguauuuuucguaccagacggagaagccagaaaauuacucccacuacuaauccguagacgaaugaaagaacaaaaugaccuacaagauuggauacguaacaaacaagcacauccuauagaucuucccagucacuuauucgauaguaaaguaauggaauuguuaaaaguaaaagauggaaaaaaaaaauggaaugaagcuuucaaagauugguggagcaccaaauacccugauggaaugcaaccuuucuaugguuugagaagagagcugaacauccacggcaaaucaguaucauauauacccucagauggaaaaaaauucgcagauugcuauacacaucuaauggagaaaacagucagggauaaaaagagagaauuacguacugcaggaaaaccaguaccgccagaucuugcagcauauaucaaaagaaguuuccacagggcaguuaaugaacgugaauuuauguuacgauuaguccaagaagaugacagacuuauguuaauggccauuaacaaaauuaugacagaucgcgaagaagacauuuuacccggauuaaaaaacauugauucaauauuagauaaagaaaaccaauuuucauuagcaguacacgcaaaaguauuagaaaaagaaggugaggguggagauaauucacuaucuuuaguuccagcuacaauagaaauaaaaucaaaaagaaaagauuggucaaaauacauaagauacagauaugacagaagaguaccaggguuaaugagccacuucccggaacauaaagcaacuuuagaugaagucaaaacacuacuaggagaauacgacagaugcaggaucaaaauuuuugacugggcuuuugcacuagagggugcaauuauguccgauagagaucucaaacccuaucuacaugaaaguagcaguagagaaggaaaaaguggagaacauaguacucucguaaaaauguuagucgaaaaaaaaggauguuuaacaccagacgaaagucaauaccuuauucucauaagaaauaaagcagcacacaaccaauuuccaugcgcagccgaaauaccacuaaucuauagagauguauccgcaaaaguugggucaauagaaggaaguagcgcuaaagacuuaccugaaggaagcucacuagucgauucacuguggaagaaauaugaaaugauaauuagaaaaauauuaccuauauuagauccagaaaaucgauuuuuuggaaagcuacuaaacaauaugucacaaccuaucaaugauuuauaa

SEQ ID NO: 11550 - RNA, 3408 nt, Artificial Sequence
  Cas13b variant__Porohyromonas gingivalis__WP_005873511.1__Cas13b
augaauacaguaccagcaucagaaaauaaaggacaaagucgaacgguagaggaugauccacaguauuucggucuuuauuuaaaucucgcuagagagaacuuaaucgaaguagaaucacacguccgaauaaaauuuggaaaaaaaaaacuaaacgaagaaucauuaaaacaaucucuacuaugugaucaccuacuaucuguagacagguggacgaaaguauacggucacucuagacgauauuuaccauuuuuacacuauuucgauccagauagucaaauagagaaagaccacgacagcaaaacagguguagauccagauagugcacaaagauuaauaagagaacuauauucccuacuagauuuccugaggaaugauuucucacacaauagauuagacggcacaacauucgagcacuuagaaguuucuccggacauuucgucuuuuauuacagguacauauuccuuagcgugcgguagggcacaaucaagauuugcugacuucuucaaaccagacgacuuugugcuagcaaaaaauagaaaagaacaacuaauuagcgucgccgauggaaaagaaugucuaacagugaguggacuggccuucuucauuugccuauucuuagaucgagagcaagcgagcggaauguugucacgaauaagaggauuuaaaagaacugaugagaauugggcuagagcuguucaugaaacauuuugugaccuaugcauaagacauccccacgauagacuagaaagcucaaacacuaaagaagcacuacuuuuagacauguuaaaugaauuaaacagauguccacgaauauuauaugauaugcuaccugaagaagaaagagcccaauuccuccccgcccuagacgaaaacucaaugaacaauuuaagugaaaauagcuuaaaugaagaaucacgauuauuaugggacggaaguagugauugggcugaagcauuaaccaaacgaauaagacaccaagacagauuuccauaccuuauguuacgauuuaucgaagaaauggaccuccucaaaggcauaagauuucguguagauuuaggugagaucgaacuagacagcuacucaaaaaaaguaggaagaaacggugaguaugauagaacaauaacagaucaugcacucgcauucggaaaacuaucagauuuucaaaacgaagaagaaguaucucgaaugauuucaggagaggcaucauauccuguaagauucucacuauuugcacccagauaugcuauauaugauaauaaaauagguuacugccacacauccgacccgguauauccuaaaucuaaaacaggagaaaaacgggcguuaagcaacccucaaaguauggguuucauaaguguacauaauuuaaggaaacuauuacucauggaacucuuaugugaagggucauuuucaagaaugcaaucagauuuccuaaggaaagcaaacagaaucuuagaugaaacugcagaaggaaaauuacaauucucagcucuuuuucccgaaaugagacaccgcuucauaccaccacaaaacccaaaaucaaaagauaggcgggaaaaagcagaaacuacccuagaaaaauauaagcaagaaaucaaaggaagaaaagauaaacuaaauucacaacuguuaucagcauucgacaugaaccaaaggcaacuaccuagcagguuacucgaugaauggaugaacauaagaccagcaucccauucugucaaacuacgcaccuaugucaaacaauuaaaugaggauuguagauuaagacugcgaaaguuccggaaggauggagaugggaaagccagagcaauaccacugguuggagaaauggcaacauuccugagucaagauauuguuaggaugauaauuucagaagaaacaaaaaaauuaauaacaagugcauacuacaacgaaaugcagagaagcuuagcucaauaugcuggagaagaaaaucgucgccaauuucgugcgaucguagcagagcuacaucuauuagaccccucuucuggacauccguuucuaucagccaccauggagaccgcgcacagauauaccgaagauuucuauaaaugcuauuuagaaaaaaaacgagaaugguuggcaaagacauucuaccgaccagaacaagaugaaaacacaaaaagacgaauaucugucuucuucguaccagauggagaagcucgaaaacuacuaccacuccuaauaagaagacgcaugaaagaacaaaaugauuuacaagacuggauaagaaacaaacaagcacauccaauagaucuuccuucacauuuauuugacucaaaaauaauggagcuacuaaaagucaaagacgguaaaaaaaaauggaacgaagcauuuaaagacuggugguccacaaaauauccagacgguaugcagccauucuauggacuacgacgagaauuaaacauucauggaaaaucaguaucauacauaccuuccgacgguaaaaaauuugcagacuguuauacacacuuaauggaaaaaacaguacaagacaaaaaaagagaacucaggaccgcaggaaaaccuguuccccccgaucuagcagcagacauaaaaagaagcuuccauagagcaguaaaugaaagggaauucaugcuccgacuaguccaagaagacgaucgucuaaugcucauggccauaaacaaaaugaugacugacagagaagaagacauucuaccuggacuuaaaaauauagauuccauccuagacgaagaaaaucaauuuucucuagcaguacaugcaaaaguucuugaaaaagaaggcgaaggaggugacaauucacuaagucuagucccugccacaaucgagauaaaaagcaaaagaaaagauuggucuaaguauauucgauauagauaugauagaagagucccugguuuaaugucucauuucccagaacacaaagcaacucuggacgaaguaaaaaccuuacuuggagaauacgaccgaugcagaauaaaaauuuucgacugggcauucgcccuagaaggggccaucauguccgauagagacuuaaaacccuacuugcacgaaucgucgucacgugaagguaaaaguggcgaacauagcacacuagugaaaauguuaguagaaaaaaaaggcuguuuaacaccugacgaaagucaauauuuaauccugauacguaauaaggccgcccauaaccaauuuccaugugcagcagagaugccacucauauauagagauguaucagcgaaaguaggaagcauugaaggaucaucggcaaaggaccuaccagaagggaguaguuuagucgacaguuuauggaaaaaauacgaaaugauaauaagaaaaauucuaccaauacuagauccagaaaauagguuuuucggaaaacuucuaaacaacaugucucaaccaauaaacgauuuauaa

SEQ ID NO: 11551 - RNA, 3408 nt, Artificial Sequence
  Cas13b variant__Porohyromonas gulae__WP_039445055.1__Cas13b
augaacaccguccccgcaacagagaauaaaggacaaaguaggacaguggaagaugauccacaguauuuugguuuauaucuaaacuuggcaagagaaaaccuuauagaaguagaaagucauguuagaauaaaauuuggaaagaagaaacuuaacgaagaaucacuaaaacagucuuuauugugugaucaccuucucucuaucgacagauggacuaaaguauacggacauaguagacgauacuugccauuuuuacacugcuuugacccagauuccgggauagaaaaagaucaugauucgaaaacaggaguugauccagacucggcacaaagacuuauacgagaauuauauucucuacuagauuuucuuagaaaugauuuuagucauaacagauuagauggaacaacauuugaacaccuuaaaguaucuccugacaucucaucauucauaacgggagcauacacauucgcaugcgaaagagcucaaucaagauuugcagacuucuucaaaccagacgacuuuuuacucgcuaaaaacagaaaagaacaacuaauuucaguugcagauggaaaagaauguuuaacagucucgggauucgcauucuuuauaugcuuauuucuugacagagaacaagcaucaggcauguuaucacgcaucagagguuucaaaagaacugacgaaaacugggcaagagcaguucaugaaacuuucugugaccuaugcauuagacauccccaugaucgcuuagaaucaucaaauacuaaagaggcuuuauuauuagacauguugaaugaacuuaacagaugcccacguauauuauaugacaugcuuccugaagaagaaagagcacaauuucuuccugcauuagaugaaaauagcaugaauaaucucucggaaaauucuuuaaaugaagaaagcagacuguugugggacggaagcucagacugggcugaagcacuaacgaaaagaauacgccaucaagacagauuucccuaccuaauguugcgauucauagaggaaauggacuuacuaaaaggcauccgcuuucgaguugacuuaggagaaauagagcucgauucguauagcaagaaaguuggcagaaacggcgaauaugaccguacaaucaccgaccacgcgcuagccuucgggaaacuaucagauuuccaaaaugaagaagaagugagcagaaugaucagcggagaagcaucauacccagucagguucucucuauuugcaccccgauacgcuaucuacgauaauaaaauaggguacugucauacauccgauccuguauauccuaaaucaaaaaccggagagaaaagagcgcuuagcaauccacaaaguaugggauucauaucaguucaugacuuacggaaauuauugcuaauggaacuacugugcgaaggaucauuuucccgaaugcaaagugacuuuuuacgaaaagccaaucguauacuagaugaaacagcagaaggaaaauuacaguuuucugcucuuuucccagaaaugagacacagauucauaccaccccagaacccaaaaaguaaagaucgacgagaaaaagcagaaacaacacucgaaaaauacaaacaagaaauaaaaggaagaaaagacaaacuaaauucccaauuacuaucagccuucgauaugaaucaacgacaauuaccuucacgcuuguuagacgaauggaugaacauacgaccagcaucacacucagucaaauugagaacuuacguuaaacaauuaaacgaagauugcagauuaagauuaagaaaauuuagaaaagacggagacggaaaagcccgcgcgauaccccuaguaggagaaauggccacauuuuugucucaagauauaguucgaaugauaaucucagaagaaacuaagaaauuaauaacuucagcauauuacaaugaaaugcaacgaucgcuggcacaauacgcaggcgaagaaaauagacgccaauuuagagcuauaguugcggaacuacaucugcuugacccuucaucaggucacccauucuuaucagcaacaauggagaccgcccaccgcuauacagaagacuuuuacaaaugcuacuuagaaaagaaacgagaaugguuagcaaaaacuuucuauagacccgaacaagaugagaauacuaaaagacgaauuagcguauucuuuguacccgacggagaggcuagaaaauuacuaccauuacuuaucagacgaagaaugaaagaacaaaacgacuuacaagauuggauacgaaauaaacaggcacaucccauagacuugccuucacaccuauuugacucaaaaauaauggaauugcuaaaaguaaaagacgguaaaaagaaauggaacgaggcuuuuaaagauugguggucaacaaaauaccccgauggaaugcaaccauucuacggauuaagaagagaacucaacauacacggaaaaucaguaucauauauaccuagugacgguaagaaguucgcugauugcuacacacauuuaauggagaaaacugucagggacaagaaaagggaacuaagaaccgcagguaaaccaguaccaccagaucucgcagccuauauuaaacgaucauuccacagagcaguuaaugaaagagaauuuaugcuaagauuaguccaggaagacgauagacuaauguuaauggcaauaaauaagaugaugacagacagggaagaagauauauugccaggucuuaaaaauauugauucaaucuuagacgaagaaaaccaauuuucgcuagcuguccaugcuaaaguacuagaaaaagaaggugaaggcggagacaacucucugucacuuguaccggcuaccauagaaauuaaaucaaaacgaaaggauuggucgaaauauauuagauaucgauaugaucgacguguaccaggucuaaugucacauuucccagaacauaaagcaacauuagacgaaguaaaaacccuucuaggugaauaugauagauguagaauuaaaauuuuugacugggcauuugcauuagaaggugcaauuaugucagaucgugacuugaaaccguaucuacaugaaucaucguccagagaagguaaaagcggagaacauuccacucuagucaaaaugcuaguugaaaagaaaggaugucuuacaccugacgaaucccaguauuuaauacuaauuagaaauaaagcggcucacaaccaauucccaugugcugcagaaaugccauuaaucuacagagacguuagcgcaaaagucgguucaauagaaggaagcuccgcaaaagauuuaccagaaggaucaagucuugucgauagcuuauggaagaaauacgaaaugaucauaagaaaaauucucccuauacuggaucacgaaaaccgauucuuuggaaaacuuuuaaauaauaugagucaacccauuaaugaucucuaa

SEQ ID NO: 11552 - RNA, 3528 nt, Artificial Sequence
  Cas13b variant__Porphyromonas gingivalis__WP_052912312.1__Cas13b
augacggaacagaaugaaaaaccauacaauggaacauacuauacauuagaagauaaacauuuuugggcagcuuucuucaaccucgcaaggcauaacgcauauauaacuuuagcacacauagacagacaauuggcauacucaaaagccgacauuacaaacgaugaggauauauuguuuuuuaaaggucaauggaaaaacuuagacaacgaccuagaacgcaaagcuagacuaagaucacuaauacuuaaacacuuuucuuucuuagaaggcgcugcauauggcaaaaaauuauucgaaucgcaaucaucggguaacaaaucgaguaagaaaaaagaacugacuaaaaaagaaaaagaagaauuacaagccaaugcuuuaaguuuagauaaccucaaaucaauacuuuuugacuuuuuacaaaaauuaaaagacuuucgaaacuauuauucucauuaccgucauccggaaagcucagaacuaccacuauuugacgggaauauguuacagagauuauauaauguguucgauguaucaguacaaagaguaaaaagagaucaugaacacaacgacaagguagacccgcaucggcacuucaaucaucuuguuagaaaaggcaaaaaagacaaauacggaaacaacgacaacccuuucuucaagcaucauuucguugacagggaggaaaaaguuaccgaagcuggauugcucuuuuucguaucauuguuccuggaaaaaagagaugcuauauggaugcaaaaaaaaauacgugguuucaagggagguacggaagcauaucaacaaaugacaaacgaaguuuucuguagaucacgaauaucacugccaaaacuaaaacucgaaagucucagaacagacgacuggauguuacucgacauguuaaacgaauuaguaagauguccaaaguuacuauacgaucgauuacgagaagaagaccgagcucgauuuagaguaccggucgauauauuauccgaugaagaugauaccgauggaacugaagaggacccauucaaaaacacgcuaguaagacaccaggaucgauuuccauacuucgcucuaagauauuuugauuuaaaaaaaguauuuacaucacugagauuucauauagaucuuggaacauaucauuuugcgauauauaaaaaaaauauaggcgaacaaccagaagaucggcaucugacaagaaauuuauacggcuucggaaggauacaagauuuugcagaagaacaccgcccagaagaauggaaaagauuaguaagggaucuugauuauuuugaaacaggagauaaaccguauauuacccaaacaacuccacauuaccacauagaaaaagguaaaauaggacuaagauuuguaccggaaggacaacuucuauggccaagcccagaaguaggcgcaacccgaaccggaagauccaaauaugcacaagauaaaagauuuacagcagaagcauuucuaagcguacaugaacuaaugccgaugauguuuuauuauuuccuacucagagaaaaauauucagaagaagcaucagcugagaaaguacaaggaagaauaaaaagagucauagaagauguauaugccgucuaugaugccuucgcaagagacgaaauaaacacacgcgacgaacuggacgcaugucucgcugauaaagguauaaggcgcggccauuuaccgagacaaaugauagcuauucucucacaggaacauaaagauauggaagaaaaaguaagaaaaaaauuacaagaaaugaucgcagacacagaccacagacuagauaugcuagaucgacaaacagaccguaaaauccgaaucggcagaaaaaacgcagguuuaccaaaaucaggugugauugccgauuggcuaguaagagauaugaugagguuccaaccuguagccaaagauacaucuggaaaaccauuaaauaauucaaaagccaauucaacugaguaucguauguuacaaagagcuuuagcacuuuucggcggagaaaaagaaaggcuaacuccuuacuuccgacagaugaaucuaacaggggguaacaauccacauccauuuuuacaugaaacacguugggaaucacauacaaauauacuaagcuucuacagaucuuauuuaaaagcaagaaaagccuuuuuacaaaguauaggccgaucggauagagaagaaaaucauagauuuuuauuacucaaagaaccgaaaaccgauagacaaacacuaguagcaggauggaaaucagaauuucauuugccaaggggaauuuucacugaagccguaagggacugucucauagaaaugggguaugaugaaguaggaucauauaaagaaguagguuuuauggcaaaagcaguacccuuauauuuugaaagagcauguaaagaccgaguacaaccauucuaugauuacccauuuaauguggguaauagucuaaaaccgaaaaaaggcagauuucuaagcaaagaaaaacgugcagaagagugggaaucaggaaaagagagauuuagagaucuagaagcuuggagccacagcgcagcucgacgaauugaggaugcauucguagggaucgaauacgccucaugggaaaacaaaaaaaaaauagaacaacuucuccaagaucuaucgcuuugggaaacauuugaaaguaaauuaaaaguaaaagcagacaaaauaaacauagcuaaacuaaaaaaagagauacuggaagcaaaggagcacccauaccaugacuucaaaucuuggcaaaaauuugaaagggaguuaagguuaguaaaaaaucaagauauaaucacauggaugauguguagagaccuaauggaagaaaauaaggucgaagguuuagauaccggcacauuauaucugaaggauauaagaacagacguacaagaacaaggcucacuuaaugucuugaaucacguaaaaccgaugagauuaccuguaguuguuuauagagcagauaguagaggccauguacacaaagaagaagcuccauuagcuaccguuuacaucgaagagcgagauaccaaauuauuaaaacaaggaaacuucaagucauuugucaaagauagaagacuaaauggucuuuuuucuuuuguugauacaggagcauuagcaauggaacaauacccuaucaguaaguuaagaguagaguacgaauuagcaaaauaccaaacugcgcgaguuugugcauucgaacagacuuuggaauuggaagaaagucucuuaacacgauauccacacuuaccagacgagaguuuuagggagaugcucgagucuugguccgacccccuucuugacaaauggccugaucuucaacgggaaguaagacuucuaauagcaguacguaaugcguuuucgcacaaucaauauccaauguaugaugaaacaauauuuucuucuauaaggaaauaugauccaaguucacuggaugcuauagaagaacgaaugggucugaauauugcacauagacuaucagaagaaguaaaauuagcuaaagaaaugguagagcgcauaauucaagcauga

SEQ ID NO: 11553 - RNA, 3360 nt, Artificial Sequence
  Cas13b variant__Porphyromonas gingivalis__WP_053444417.1__Cas13b
augacggaacaaaacgaaaaacccuacaauggcacuuauuauacauuagaagauaaacauuucugggccgccuuccuuaaucuugcacgacacaacgcauauaucacacuagcacacauugaccgucaauuagcguacaguaaagccgauauaacaaaugaugaagauauccuuuucuuuaaaggccaauggaaaaaucuagauaaugaucuugaaagaaaagcuagacuaagaagccuaauucucaaacauuuuucauuucuagaaggugccgcuuauggaaagaaauuauuugaaucacaaagcucaggaaacaaaaguaguaaaaagaaagaacuaucaaagaaagaaaaagaggaacuacaagcaaaugcccuaucacuagacaaucuaaaaagcauacuuuuugacuuuuuacaaaaacuaaaagauuuuaggaauuauuacagccacuacagacauccagaaucaucagagcugccacuauucgacgguaauaugcuucaaagacucuacaacguuuuugacgugucaguacagcgggucaaaagagaucaugaacauaacgacaaaguagauccacauagacauuucaaucauuuaguuagaaaagguaagaaagauaaauauggaaauaaugauaauccuuucuuuaaacaucauuuuguggauagggaaggcacaguaacagaagcuggacuccuauucuuugugagcuuauuuuuagagaaaagagaugccauauggaugcaaaagaaaauaagaggauuuaaaggcgguacggaagcauaucaacaaaugaccaaugaaguauuuugcaggucaagaaucucucucccgaaauuaaaauuggaaucauuacgaacagaugauuggaugcuacucgacaugcucaacgaacucguaagauguccaaagagcuuauacgauagauuaagagaagaagacagggcaagauuuagaguacccguagauauacuaagcgaugaagacgauaccgauggaacagaagaagacccuuucaaaaauacgcuaguaagacaccaagaccguuucccauacuuugcacucagauauuuugaucuaaagaaaguauuuacaucauuacgauuccauauugaccuagguacauaucauuuugccauauacaagaaaaacauaggcgaacaacccgaagaucgacaccuuacaagaaauuuguacggauucgguagaauacaagauuucgcugaggaacaccgaccggaagaauggaaaagacuugucagagauuuagacuauuuugaaacuggugacaaaccguacauaacacaaacaacaccacacuaucacauagaaaaagguaaaauuggccuaagauuuguaccagaaggucaacaucuauggccaucaccagaaguaggagcuacacguacaggaagaucaaaauacgcacaagacaaaagauuaacagcugaagcauuuuuaucaguacaugaacuuaugccaaugauguucuacuauuucuuauuaagggaaaaauauucagaagaagucucagcugaaaaaguacaaggaagaauaaaaagaguuauagaggauguuuaugcaguauaugacgcuuucgcacgagaugaaauaaacacaagagaugaacuagaugcaugcuuagcagauaaaggaauaagaagaggacauuuaccacgacaaaugauagccauccucagucaagaacauaaagauauggaagaaaaaguccgcaagaaacuccaagaaaugauagcagauacagaccauagauuagauauguuggacagacagacagauagaaaaauccgcaucggucguaaaaaugcaggacuaccuaaaucaggagucguagcagauugguuagucagagacaugaugagauuucaaccaguugcaaaagacacaagcggaaaaccauuaaauaacucaaaagcaaacucaacagaauauagaaugcuacaaagagcccuugccuuauuugggggcgaaaaagaacgcuuaacaccauacuucagacaaaugaacuuaacagguggaaacaacccucacccuuucuuacaugaaacaaggugggaaucgcauacuaacauucuuucauuuuacagaucauaccuggaagcuagaaaagccuuccugcaauccauagggagaucugaccgagucgaaaaucaucguuuccuauuacuaaaagaaccaaaaacagauagacagacccuaguagcaggauggaaaggggaauuucaccuaccgcgaggaaucuuuaccgaagcagucagagacuguuuaauagagaugggauaugaugaaguaggauccuauaaagaagucggauucauggcgaaagccguaccucucuacuuugaaagagcaaguaaagacagaguacaaccauuuuaugauuacccauuuaacguaggcaauagccuuaaaccaaagaaaggacgcuuccuaaguaaagaaaaacgugcagaggaaugggaauccggcaaagaacgcuuucgacuagcgaaacucaagaaagagauauuagaagcuaaagaacacccuuaccaugauuuuaaauccuggcaaaaauuugaaagagaacuuaggcuagugaaaaaccaggauauaauaacauggaugauguguagagauuuaauggaagagaacaaaguagaaggucuagauacagguacauuauacuuaaaagacauaagaacagauguacaagagcaaggaucacuaaacguacuaaauagaguaaaaccaaugagauuacccgugguaguauacagagcagauucacgaggucaugugcauaaagaacaagcaccccuagccacaguuuauauagaagaacgggauacaaaauuacuaaaacaaggaaacuucaaaucauucguaaaagauaggcgacugaauggcuuguuuucauuuguagacacaggagcacuagccauggaacaguaucccauuagcaaacuaaggguagaguacgaacuagcaaaauaucaaacagcuagaguaugcgcauuugaacaaacacuugaacuagaagaaucauuauuaacacgguauccacauuugccagacaaaaacuuucgaaaaauguuggaaucaugguccgauccauuauuagauaaauggccggaucuucauggaaacguaagauuauuaauagcagucaggaaugcuuucagccauaaucaauauccaauguacgacgaaacacucuucucaagcauaaggaaauaugacccaagcaguccugacgcaauagaagaaagaaugggacuuaacaucgcgcauagacucucugaagagguuaaacaagcuaaagaaauggucgaaaggauaauccaagcauaa

SEQ ID NO: 11554 - RNA, 3360 nt, Artificial Sequence
  Cas13b variant__Porphyromonas gingivalis__WP_012458414.1__Cas13b
augacagaacaaaacgaacgaccguauaauggaacauauuacacacuagaagacaaacauuuuugggccgcuuucuucaauuuagcuaggcauaacgccuauauaacgcucgcacauauagacagacaacuagcuuauucaaaagccgauauuacaaaugaugaagauauauuauucuucaaaggacaauggaaaaacuuagauaacgauuuagaacggaaagcacgauuaagaucauugauccuaaaacacuuuucguuuuuagaaggcgcagccuacggcaaaaaguuauuugaaagucagaguaguggcaacaaaagcucuaaaaagaaagaacuaacuaaaaaggaaaaagaagaacugcaagcaaaugcacuaagucuugauaaccuaaagucaauccuauucgacuuuuuacaaaaauugaaagauuucagaaauuauuauagucauuacagacauccagaaagcagugaacuaccccuuuucgaugguaacauguuacaaagacuuuauaauguauuugacguaucaguacaacgagucaaaagagaccaugaacacaacgauaaaguagauccacaccgacauuucaaucaccuaguuagaaaagguaagaaggacagauauggaaauaacgacaauccauuuuucaaacaucauuuuguggauagagaagaaaagguaaccgaagcaggauuacucuuuuucgugagucuauuuuuagagaaaagagacgcaauauggaugcaaaagaaaauucgagguuucaaaggagggacagaaacguaucaacaaaugacaaacgaaguauuuuguagauccagaauaucauuaccaaaauuaaagcuagaaucauuaagaaccgaugauuggaugcuacuagacaugcuaaacgaacucguaagauguccaaagagccuauacgauagauuaagggaagaagacagagcaagauucaggguuccaguagauauacuaucagacgaagaugacacugaugguacagaagaagacccauucaaaaacacucucgucagacaucaagauagauucccauauuuugcucugcguuacuuugaucucaagaaaguuuuuaccucacuccguuuccauauagacuuagguacguaccauuuugcuaucuacaagaaaaauauuggagaacaaccugaagacagacaccuaacacggaaccucuacgguuuuggaagaauacaagauuuugcugaagaacaucgaccagaagaauggaaaagauuagucagagaccuugacuacuuugaaaccggcgauaaaccauacaucacacaaacaacuccacauuaucauauagaaaaaggcaaaauaggccucagauuuguuccagaaggacaacaucuauggcccucuccugaaguuggcgcaacaagaacaggaagaucaaaauacgcacaagacaaaagauugacugcagaagccuuuuuauccguacacgaacuaaugccaaugauguucuauuacuuuuuacuacgcgaaaaauauagcgaugaagcuagugcugaaaggguacaaggaagaauaaaaagagucauagaagauguuuaugcaguauaugaugccuuugccagaggcgaaauuaacacaagagacgaacuagaugcaugucuagcugauaaaggaauuagaagaggacaucuaccaaggcagaugauuggaauuuugagccaggaacacaaagauauggaagaaaaaguacgaaagaaacuccaagaaaugaucgucgauacagaucaucgucuagacaugcuagauagacaaacugaucgaaaaauaagaauaggacgaaagaacgcuggcuuaccaaaaucuggcguaaucgcggacuggcuugugagagauaugaugagauuucaacccguagcaaaagacacgagugggaaaccauuaaauaacucaaaagcaaacagcacagaauacagaauguuacaaagagcacuagcccuauucggcggcgaaaaagaaagguuaaccccauacuucagacagaugaaucuaacgggcggcaacaacccccauccauuccuacaugaaacacgaugggaaucccacacaaacauuuugucauuuuauagaucauauuuaaaagcacguaaagccuucuuacaauccauaggacggagugacaggguugaaaaucauagauucuuacuauuaaaagaaccaaaaacugaucgacaaacccuaguagcaggauggaaaggagaauuucacuuaccaagggguaucuucacagaagcgguacgcgacugcuuaauugaaaugggccuugacgaaguaggcucauauaaagaagucggauucauggcaaaagcaguaccucucuacuucgaaagagcauguaaagacaggguucaaccuuuuuaugacuacccauuuaacguagguaauagucugaaaccaaagaaaggaagauuucuaagcaaagagaaaagagcggaagagugggaaagcggaaaagaaagauuuagauuagcaaaacuaaagaaagaaauacuagaagcgaaagaacauccuuaucuagauuuuaaaucauggcaaaaauucgaaagagaauuacgccuagucaaaaaccaggauauaauaacauggaugauaugcagagauuuaauggaagaaaauaaaguagaaggauuagacacaggcacuuuauacuuaaaagacauucgcaccgacguacaagaacaaggaaaccucaacguucugaauagaguaaaaccaaugagacuacccguuguagucuauagagcagauucuagaggccacguucacaaagaacaagcaccacuagcaacuguauauauagaagaaagggauacaaaacuauuaaaacaagguaacuucaaaucuuucguuaaagaucgcagauuaaacggacuauuuucauuuguagauacuggagcacuagcaauggagcaauauccaauaagcaaauuaagaguggaguacgaauuggcgaaauaccaaacugcaagaguaugugcauucgaacaaaccuuagaacuugaagaaucauuauuaacaagauauccacaccuuccagauaaaaacuuucgaaaaauguuagaaagcuggucagauccucuguuagacaaauggccagauuuacauggcaacguacgacuuuugauagcaguacgaaaugcauucucacacaaucaauauccaauguacgaugaagcaguauuuagcucaauaagaaaauaugacccaaguucaccagaugcaauagaagaaagaaugggcuuaaauauagcucauagacuaagcgaagaaguuaaacaagcgaaagaaauggcagaaagaauaauacaagccuaa

SEQ ID NO: 11555 - RNA, 3360 nt, Artificial Sequence
  Cas13b variant__Porphyromonas gingivalis__WP_039417390.1__Cas13b
augacagaacagaaugaaagaccauauaacggaacauauuauacauuagaagauaagcacuuuugggcggcuuucuucaaccuagcacgacauaacgcauauauuacauuagcgcauauugauagacaacuagcguauucaaaagcugauauaacuaacgaugaagacauauuauucuuuaaaggacaauggaagaaucuagauaacgacuuagagaggaaagcaagacuuagaagccugauuuugaaacacuucucauuucuagaaggugccgcauauggaaagaaacuauucgagagucaaucaagugguaacaaaucgagcaaaaagaaagaacuuaccaagaaagaaaaagaggaauuacaagcaaaugcgcucucacuagacaacuuaaaaucaaucuuauucgauuuucuucaaaaauuaaaagauuuuagaaauuauuacucacauuacagacauccagaaaguucagaacuaccacuguucgauggaaauaugcuucaacgccuauacaacguauuugacguaucaguucaacgaguaaaaagagaccaugaacauaaugauaaaguggauccacaccggcacuuuaaucacuuaguuagaaaaggaaagaaagauagguacggaaauaaugacaauccauuuuucaaacaccauuuuguagauagggagggaacaguaacugaggcaggacuacuuuucuuuguaagucuauuccucgagaaacgagacgccauauggaugcagaagaaaauaaggggauucaaaggcggaaccgaagcauaccaacaaaugacuaacgaagucuucugccgaucaagaauuucacuaccaaaacugaaacuugagagcuuacgaaccgaugacuggaugcuguuggacauguugaacgaacuuguccguuguccaaaaagucuauacgaucgccuaagagaagaagauagggcuagguuccgagugccuauagacauacucagugaugaagacgauacagacgggacggaagaagauccauucaaaaauacuuuagugaggcaucaggacagauuucccuauuucgcucuuagauacuucgaucucaagaaaguauuuaccagcuuaagauuucauauagauuuaggaacauaucacuuugcaauauacaagaaaaauauaggagaacaaccugaagacaggcauuuaacaagaaaucuauauggguuuggacgaauacaagacuuugcagaggaacacagacccgaagaauggaaaagacucguaagagaccuagauuacuuugaaacgggcgacaaaccauacauuacacaaacaacaccucauuaucauauagaaaaaggaaaaaucggacuaagguucguuccagaaggacagcauuuauggcccucaccugaaguaggugcaacuagaacaggaagaaguaaauaugcacaagacaaaaggcuaacagccgaagccuuccuaaguguucacgaacucaugccaaugauguuuuacuauuucuuacucagagaaaaauacucagaagaaguaagcgcugaaaaaguccaagggaggauaaaacgaguaauagaagacguauaugcuguuuaugaugcuuuugcaagaggagaaauagacacguuagaucgacuagacgcaugucuagcagauaaaggaauuagaagaggccaucuuccacgccaaaugauagcuauacuuagucaagaacauaaagacauggaagaaaaaguaagaaagaaacuacaagaaaugauagcugauacugaucauagauuagauaugcuggauagacaaacagauaggaaaauaagaaucggaaggaaaaacgcaggacuaccuaaaucuggcguuauagcugauugguugguucgagacaugaugagauuccaaccaguagcuaaagauaccagcggaaaacccuuaaauaauaguaaagcaaacucaacagaauacaggaugcuacaacgugcucucgcccucuucggaggagaaaaagaaagacuaacuccauauuuuagacaaaugaaucugacaggaggaaauaauccccacccauuuuuacaugaaacucgaugggaaucacauacgaacauccuuuccuuuuauaggucauaccuaaaagccagaaaagcauucuuacaaucaauuggcagaucagauagagaagaaaaccacagguuucuacuauuaaaagaaccaaaaacagacagacaaacucuaguggcaggauggaaaucagaguuccauuuaccuagaggaauauuuacagaagcuguacgcgacuguuugauagaaaugggauaugaugaaguagguaguuauaaagaagugggcuuuauggcaaaagcagucccauuauacuuugaaagagcauguaaagaucgaguacaaccauuuuacgauuauccauuuaacguaggaaauucauuaaaaccuaagaaaggaagauuuuuaucuaaagaaaaacgagcagaagaaugggaaucaggaaaagaacguuuuagacuagcaaaacuaaagaaagaaauauuggaagcaaaagaacacccguauuuagauuuuaaauccuggcaaaaauuugaacgugaauuaagauuagugaaaaaucaagauauuauaacauggaugaugugucgcgaucuuauggaagaaaauaaagucgaagguuuagauacagguacacuuuauuuaaaagacauacgaacagauguccaugaacaaggaucacugaaugucuuaaauagagucaaaccuaugagacucccaguaguuguuuaccgcgcugacaguagaggacacguacacaaagaacaagcaccauuggcuacagucuacauagaagaaagagauacuaaacuauuaaaacaagguaacuucaaaucauucgucaaagaccgccguuuaaauggcuuauuuuccuuuguagauacuggggccuuagcaauggaacaauauccuaucucaaaauuaagaguggaauaugaauuagcaaaauaccaaacagcaagaguaugugcuuucgaacaaacauuagagcuagaagaaucauuacuuacucgauauccucaccuaccagacaaaaauuuuagaaaaaugcuagaguccuggagcgacccgcuucuugauaaauggccagaucuccacagaaaagucagacuauuaaucgcgguaagaaacgcauucucccauaaucaauauccaauguaugaugaagcagucuuuuccucaauaagaaaauacgacccaucaucaccugaugcaauagaagaacggaugggcuuaaacauagcacaucgacuaucagaagaaguaaaacaagccaaggaaauggcagagagaauaauacaagucuaa

SEQ ID NO: 11556 - RNA, 3528 nt, Artificial Sequence
  Cas13b variant__Porphyromonas gingivalis__EOA10535.1__Cas13b
augacugaacaaaaugaaaaaccauauaauggaacauacuacacccuagaagacaaacauuucugggcugcuuucuuuaaucuagcucgccauaacgccuacauaacucugacccacauagauagacaguuagcauauucaaaagcagacauaaccaaugaugaggacauacucuuuuucaaaggccaauggaaaaauuuagauaaugauuuggaacgaaaagccaggcuuagaucucuaauacuuaagcacuucucauuccuagaaggagccgcuuauggaaagaaauuauuugaaagccaaucaagcgguaauaaaucuuccaaaaagaaagaauuaaccaagaaagaaaaagaagaacuccaagcaaaugcuuuaucauuagacaacuuaaaaaguauacuauuugacuuccuacaaaaacucaaagauuucaggaauuauuacagccacuaccgccacccagaaucaagugaacuacccuuauucgacggaaauaugcuacaaagauuauauaauguauucgacguaagugugcaaagaguaaaaagagaucaugaacauaacgacaaaguagacccacauagacacuuuaaccaucucgucaggaaaggaaagaaagauagauguggaaacaaugauaauccuuucuuuaaacaccauuucguugaccgagaagaaaaaguaacggaagcaggucuacuuuucuuugucucacuauuucuagagaaaagagacgcuauauggaugcaaaagaaaauacgaggauuuaaaggcggaacagaaacuuaucaacaaaugacaaacgaaguauuuugcagaaguagaauuucucuaccaaaauuaaaauuagaaaguuuaagaacagacgacuggaugcuacuagauauguuaaacgaauuggucagaugcccaaaaagccuauaugauagacuaagggaggaagauagagcccguuuuagagucccaguagacauacuuagcgaugaagaugauacugacggaacugaagaagauccauucaaaaauacccuaguacggcaucaagauagauucccuuacuuugcuuuaagauauuucgaucuuaagaaaguuuuuacaucacugagauuucauauagaccuaggaacauaucauuucgcuauauauaagaaaaacauaggggaacaaccagaagacagacaucuaaccagaaaccuauauggauuuggacgaauacaagacuuugcagaggaacauagaccugaagaauggaaacgacucguaagagacuuagauuauuuugaaacaggcgauaaaccauauauuacacaaacgacuccacauuaccacauugaaaaaggcaaaauaggacuaagguucgugccagagggucaacuauuauggccuagucccgaagugggugcaacaaggacgggaagaucaaaauaugcacaagauaaaagauucacugcagaagcauuucuaagcguucacgaguuaaugcccaugauguuuuauuauuuccuccuacgagaaaaauacucagaagaagcauccgcagaaagaguccaagguagaauuaaacgaguaaucgaagaugucuacgcaguauaugaugcuuuugcaagaggcgaaaucgauacacuugaucgguuagacgcuugucuagccgauaaaggaauaagaaggggucaccuaccaagacaaaugauugcuauucuaagccaagaacauaaagauauggaagaaaaaguaaggaagaaauugcaagaaaugauugccgauacagaccauagauuagauaugcuagaccgacaaacagauagaaaaauucgaauaggaaggaaaaaugccggucugccuaaaagcggaguaaucgccgauugguuaguucgagacaugaugagauuucaacccguagccaaagacacauccggaaaaccauugaauaauuccaaagcaaauagcacugaauaucgaaugcuacaaagagcacuagcacuguucggaggugaaaaagagcgccucaccccauauuuuagacaaaugaauuuaacaggugguaauaauccacacccauuucuucacgaaacuagaugggaaagccauacaaauauacuaaguuuuuaccgaucuuauuugaaagcacgaaaagcauuccuacaauccauaggcagauccgaccgaguagaaaaucacagguucuuauuauuaaaagaaccaaaaacagauagacaaacccucguggcugguuggaaaggagaguuccaucugccaaggggaauauuuacagaagccguacgagacugucucauagaaaugggucuagacgaaguuggauccuacaaagaaguagguuucauggcaaaagcaguuccauuauauuuugaaagagccuguaaagauagaguccaacccuucuaugacuauccguuuaacguuggaaacucacuaaaaccaaagaaaggaagauucuuaucaaaagaaaaacgggcugaggaaugggaaagugguaaagaaagauuuagagaucuugaagcguggucccauagugcagcaagaagaauagaagaugcauucgcuggcauagaaaaugcaucuagagaaaauaaaaagaaaauugaacaacuacuccaagaucuaagccucugggaaaccuucgaguccaaacuaaaaguaaaagcagauaaaauuaauauagcuaaacucaagaaagaaauacuagaggcgaaagaacacccguacuuagauuucaaaucuuggcaaaaauucgaaagggagcuccggcuuguuaaaaaucaagauauaaucacauggaugauguguagagauuuaauggaagaaaauaaaguggaaggacuagauacaggaacacuauaucuaaaagauauaagaacagacguacaugaacaaggaucccugaaugugcucaaucgaguuaaaccaaugagacuaccugucguugucuaucgugcagacagucgaggccauguacauaaggaacaggcaccauuagcaacaguauacauugaagaacgggacacuaaacuauuaaaacaaggaaacuuuaagagcuuugucaaagauagacgguuaaacgggcuauuuucguucgucgacacaggggcacuagcaauggaacaauauccaauaucaaaacuaagaguagaguaugaauuagcaaaauaucaaaccgcgcguguaugugcauuugaacaaacccuagaauuagaagaaagucuauuaacaagauacccucacuuaccugauaaaaauuuuagaaaaaugcuagaaucauggagcgacccucuauuagauaaauggccagauuuacaugggaauguuagacuucuaauugcaguuagaaacgccuuuucccacaaucaauauccaauguaugaugaaacguuguucaguucaauaaggaaauacgacccuaguagcccagacgcaauagaagagaggaugggguuaaauauagcucauaggcuuucagaagaagugaaacaagcaaaagaaaugguagaaagaauaauacaggcauag

SEQ ID NO: 11557 - RNA, 3360 nt, Artificial Sequence
  Cas13b variant__Porphyromonas gingivalis__WP_061156470.1__Cas13b
augacagaacaaaacgaacgaccuuacaaugggacauauuauacgcuugaagauaaacacuucugggcagcuuucuuuaacuuagcgcgccauaaugcguauauuacacuaacacacauagauagacaacuugcauauucaaaagcagacaucacaaaugacgaagauauauuauuuuucaaaggccaauggaaaaauuuagauaaugaccuagaaagaaaagcaagacuucguagccucauauuaaaacacuuuucauuccuugaaggagcagcauauggaaagaaacuauuugaaaauaaaucaucagguaacaaaucaagcaaaaagaaagaauuaacgaagaaagaaaaagaagaguuacaagcaaaugccuuaucacuggauaacuuaaaaucaauucuauuugacuuucugcaaaagcucaaagauuuuagaaacuauuauucacacuaccgucacccagaaagcucagaacucccauuauuugauggaaauaugcuccaaagauuauacaauguuuuugacguuagcguacaacguguuaaacgugaucaugaacauaaugauaaaguagauccucauagacacuuuaaccauuuaguuagaaaaggaaagaaagaccguuguggaaauaacgacaauccauucuuuaaacaucauuuuguagacagagaaggaaaagucacagaagcgggucuccuauuuuucguuucacucuuccucgaaaagagagacgcaauuuggaugcagaagaaaauacgaggauuuaaaggaggaaccgaagcauaccaacaaaugacaaacgagguauuuuguaggaguagaaucucauuaccaaaacuaaaauuagaaagccucaggacggaugauuggauguuacuagacauguuaaacgagcuaguacgaugucccaaaucacuauacgaccgucuuagggaagaagauagagcccgauuuagagugccaguagacauauuaagcgacgaagacgauacagaugguacagaagaagauccuuuuaaaaacacauuaguccgacaucaagacagauuuccauauuuugcccuuagauacuucgaucuuaagaaaguauucaccucuuuaagauuccacauugacuuagguacuuaucacuucgccauauacaagaaaaauauaggugaacaaccggaagauagacacuuaacaaggaaccuauauggguucggacguauucaggauuucgcugaggaacauagaccagaagaauggaaacgguuaguaagagauuuagauuauuuugaaacaggagauaaaccauacauaacacaaacaacaccucauuaucauauugaaaaaggaaaaauaggauuaagauucguacccgaaggucaacaccucuggccaagcccagaggucggugcuaccagaacaggacgaaguaaauaugcccaagacaaaagauugacagccgaagcauuccucaguguucaugaacuaaugccgaugauguuuuacuacuuucuacuaagagagaaauauucagaagaaguaucggccgaaaaaguccaaggacggauaaaaagaguaauugaagauguauaugcuguauacgacgcauucgcaagaggagaaauagauacgcucgaucgacuugaugcauguuuagcagacaaaggcaucagacgaggacacuuaccaagacaaaugauugcaauauuaagccaagaacacaaagauauggaagaaaaaguucgaaagaaauuacaagaaaugauugcggauaccgaccauagacuagacauguuagacagacaaacagacagaaaaaucagaauaggacguaaaaaugcaggacuaccaaaaucggguguaauagcagauugguuaguaagagacaugaugagauuucaaccgguggcgaaagacacaaguggaaaaccauuaaauaauucgaaagcaaacucaaccgaauacagaauguuacaaagagcucuagccuuauucggaggagaaaaagaaagauuaacaccguacuucagacaaaugaacuuaacaggcgguaacaacccacauccauuccuacaugagacacggugggagucacauacaaacauacugagcuuuuauagaucauaucuuaaagcccguaaagccuuuuuacaaagcauaggacguagcgacagagaagaaaaccauagauuuuuacugcuaaaagaaccgaaaacugacagacaaacauuaguagcuggcuggaaauccgaauuucauuuaccuagaggaauauuuaccgaagcugucagggauugucuuauagaaaugggauaugacgaaguuggguccuauaaagagguagguuucauggcaaaagcuguaccacuauauuucgaacgagccuguaaagacagaguacaaccauuuuaugauuauccguuuaacgugggaaauagucugaaaccaaagaaaggaagguucuuaucaaaagaaaaacgagcagaggaaugggaaagcggaaaagaacgauuuagauuagcaaaauugaagaaagaaauauuagaagcaaaagagcauccauaucuagauuuuaaaucuuggcaaaaauucgaaagagaauuacgccuaguuaaaaaucaagauauuauaacauggaugaugugcagagacuuaauggaagagaauaaaguagaaggauuagauacagguacucuauauuuaaaagauauacgaacggaaguacaagaacaaggaucgcuaaacgugcugaauagaguaaaaccaaugcgacuucccguaguaguauauagagcugacaguagaggacacguacauaaagagcaagcaccgcuagcaacaguauauauugaagaacgagauacgaaacuucucaaacaagguaauuucaaaucuuuugucaaagacagaaggcuuaauggauuauucucauuuguagauacaggcggacucgccauggaacaauauccgauuaguaaacuuaggguagaauacgaauuagcaaaauaucaaacagcaaggguaugugcguuugagcaaacacuagaauuagaggaaaguuuacuuacaagauguccacaccucccagauaaaaauuuuaggaaaaugcuugaaucauggucagauccccuauuagauaaauggccagaucuacaacgugaagugugguuauugaucgcaguaagaaaugcauucagccauaaccaauaccccauguaugacgaagcuguauuuucaagcauaaggaaauaugacccauccucgccugaugcaauugaggaaagaauggggcuuaauauagcacauagauuaucagaagaaguaaaacaagcaaaagaaauggcagaaagaauuauacaagcauga

SEQ ID NO: 11558 - RNA, 3360 nt, Artificial Sequence
  Cas13b variant__Porphyromonas gingivalis__WP_013816155.1__Cas13b
augacagaacaaaaugaaaaaccguauaacggcacauauuauacuuuagaagauaaacauuucugggcggcauucuuuaaucuagcucgccacaaugcauauaucacuuuagcacacauagaccgucaauuagccuacucaaaagcggauauaacuaacgaugaagauauacuuuucuuuaaaggacaauggaaaaaucuagauaaugauuuagaaagaaaagccagacuacgaucauuaauauuaaagcacuuuucauuuuuagaaggagcagcauacgggaaaaaguuauuugaaucacagagcuccggaaacaaaucauccaaaaauaaagaguuaacuaagaaagaaaaagaagaacuacaagcaaacgcauuaucauuggauaaucuuaaaagcauauuauuugacuuuuuacaaaaacuaaaagauuuuagaaauuauuauucucacuaucgacauccugaaucaagugaauuaccacuauucgauggaaauauguuacaaagacuuuacaauguauuugauguaucgguccagcgaguaaaacgagaucacgaacauaacgauaaaguagauccgcauagacauuuuaaucaccuuguuagaaaaggaaagaaagacagguaugggaacaacgauaaccccuuuuucaaacaccauuuuguggauagagaaggaacggugacagaagccggauuauuauucuuuguaucgcuguuucuggagaaaagagaugcuauauggaugcaaaagaaaaucaggggauuuaaaggaggaacagaaacauaccaacaaaugacaaaugaaguauuuugucgcucaagaauaucacuaccgaaauugaaacuagaaucacugagaacugaugacuggaugcuguuagauauguuaaacgaauuaguaagauguccgaaaucauuauacgaccgauuaagagaagaagaucgagcaagguuucgaguucccguagauauacuaucagaugaagaagacacagauggugcagaagaagacccguuuaaaaacacacuuguccgucaucaagacagauucccauacuucgcauugagauacuuugaccuaaagaaaguuuuuacaucauuaagauuccaaauugaucuagggacauaccacuuugcuauauacaagaaaaauaucggcgaacaaccagaggaucgacauuuaacccgaaaucucuauggauuuggaaggauacaagauuuugcugaagaacacagaccagaagaauggaaaagacuuguaagagauuuagauuacuucgaaacaggugauaaaccuuauauaacucaaacuacaccccauuaucauauagaaaaaggaaaaauuggacugcguuuuguuccggaaggucaacaccuauggccaucaccagaaguaggagccacucgaacagggagaagcaaauacgcacaagauaaaagauuuacagcagaagcauuuuuaagcgcacaugaauuaaugccaaugauguucuacuauuucuuauugagagaaaaauacuccgaagaagcuagugccgaacgcguacaaggccgcaucaaaagaguaaucgaagacguuuacgcagucuaugaugcauucgcaagagaugaaauaaauacaagagacgaacuagacgcaugucuagccgauaaagggaucagacgaggacaucuaccaagacagaugauugggauacuaagucaagagcacaaagauauggaagagaaaauacguaagaaacuccaagaaaugauggcagacacagaucaucguuuagacauguuagauagacaaaccgauagaaaaauccgcaucggucgaaagaaugcuggguuaccaaaaucugguguaauugcagauugguugguaagagacaugaugagauuccaaccaguggccaaagauacaucagggaaaccguuaaacaauagcaaagccaauucaaccgaauacagaaugcuacagagagcacuagcacuauuuggaggugaaaaagaacgccuaacacccuauuuccgacaaaugaaccuuacgggagguaauaauccacauccuuuucugcacgagacucggugggagucacacacaaacauuuuaucauucuaccgaucauaccuuaaagcaagaaaagccuucuuacaaucgauaggaagaucggauagaguagaaaaucauagguuucuauuauuaaaagaaccaaaaacagaucgacagacccuaguggccggauggaaaggagaguuucaccucccgagaggaauuuucacagaagcgguaagagauugucuuauagaaauggggcucgaugaaguaggaucuuauaaagagguagguuucauggcaaaagcugucccauuauacuucgagcgugccugcaaagacuggguccaaccauucuauaauuaccccuucaaugucggaaauaguuuaaaaccaaagaaagguagauucuugucaaaagagaaaagagcugaagaaugggaaaguggaaaagaacgguuucgacuagcaaaacuaaagaaagaaauuuuagaagcaaaagaacacccuuauuuagauuuuaaaucauggcaaaaauucgaaagagaacucagauuaguuaaaaaccaagauauaauaacauggaugauaugcggggacuugauggaagaaaauaaaguagaagguuuggauacaggaacauuauauuugaaagauauaagaaccgacguccaagaacagggcucauuaaauguauuaaaccgugugaaacccaugagauuaccaguuguuguauauagggcagauagcagaggucacguccacaaagaacaagccccacuagcaacuguauauauugaagaaagagauacuaaauuacuuaaacaaggaaacuucaaauccuucguaaaagacaggagacuuaacgguuuauuuucauucguugauacaggagcucucgccauggaacaauauccaaucucaaaacuacggguugaauaugaauuagcaaaauaccagaccgcacguguaugugcauuugaacaaacucuagagcuagaagaaucacuguuaacaaggugcccacauuuacccgauaaaaauuuuagaaaaauguuagaaagcuggagcgacccacuauuagauaaauggccagacuuacacaggaaagugagacucuugauagcuguaaggaaugcauuuagucacaaucaauacccaauguacgaugaagcgguauuuucaucaauccgaaaauaugacccuuccuucccugaugccauagaagaaagaauggguuuaaauauagcgcauagacuuucggaagaagugaagcaagcgaaagaaacaguagagagaaucauacaagcguaa

SEQ ID NO: 11559 - RNA, 3528 nt, Artificial Sequence
  Cas13b variant__Porphyromonas gingivalis__WP_005874195.1__Cas13b
augacagaacaaaaugaaaaaccauauaauggcaccuacuauacccuagaagauaaacauuucugggcagcauuuuuuaaccuagcgagacacaaugcauacauaacucucgcgcauauagauagacaauuagcauauuccaaagcagauauaacaaaugaugaagauauauuguuuuucaaaggacaauggaaaaaucucgacaaugacuuggaaagaaaggcacguuuacgaucauuaauacucaaacauuuuucguucuuggaaggagcagcauaugguaaaaaacuauuugagagccaaagcaguggcaacaaaaguagcaaaaaaaaagaacuaacaaagaaagaaaaagaagaacuacaagcaaaugcauuaucccuugauaacuuaaaauccauacuguucgacuuuuuacaaaaacuaaaagacuuccguaauuauuacucacauuacagacauccggagagcucagagcuaccauuguucgauggcaauaugcuacaaagacuauacaacguguuugauguuucaguucagagagucaaaagagaucacgaacauaacgacaaaguagacccacauaggcacuucaaucaccuaguacguaaagguaaaaaagacaaauaugguaauaacgauaauccauucuuuaaacaucacuuuguugaccgugaagaaaaaguuacugaggcuggucuauuauuuuucgugucauuguuucuagaaaagagagaugcgauauggaugcaaaaaaaaauaagaggauuuaaaggcggaaccgaagcuuaucaacaaaugaccaaugaaguauucuguagaucaagaauauccuuaccgaaauuaaaacuagaaagccuacgaacugaugacuggaugcuacuugauaugcuaaaugaacuaguaagaugucccaaaucauuauacgaucgcuuaagagaagaagauagagcgagguuucgcguaccaguagacauacuaagugaugaagaugacacagaugggacggaagaagaucccuuuaaaaauacacuaguuagacaccaagaucguuucccauauuuugcguuaagauauuuugaccugaaaaaaguauuuacuaguuuaagauuccacauagaccuaggaacauaucauuuugccauauauaaaaaaaauauaggggaacaacccgaagacagacauuuaacccguaauuuauauggcuuuggaagaauacaagacuuugccgaagaacaucgaccugaagaauggaagagauugguuagggauuuagauuacuuugaaaccggugacaaacccuacaucacacaaaccacgccacauuaccauauagaaaaaggaaaaaucggauuacgauucguuccugaaggccaacuacucuggcccagcccugaagugggagccacgaggacuggaagguccaaauaugcacaagauaaaagguuuacagcagaagccuuucuaaguguucaugaacuaaugcccaugauguuuuauuauuuuuuauuaagagaaaaauauuccgaagaagcaucagccgaaaaaguacaaggaagaauaaaaagagugauagaagacgucuacgcagucuacgacgccuuugcgcgagaugaaauaaacacucgagaugaauuagaugccuguuuagcggacaaaggaauaagaagaggacacuuaccaagacagaugauagcuauacucagucaagaacacaaagauauggaggaaaaagucagaaaaaaacuucaagaaaugauagcagacaccgaucacagauuagacauguuagaucgacaaaccgaucguaagauaagaauaggacgcaaaaaugcaggacucccaaaaaguggaguaauagcagauugguuaguuagagacaugaugagauuucaaccaguagcaaaagacacaucgggaaagccacuaaauaauuccaaagcaaacaguacugaauauagaauguuacaaagagccuuagcuuuauuuggaggagaaaaagaaagauugacuccauauuuuagacaaaugaaucugacaggaggaaauaauccacacccguuccuacacgaaacacgcugggaaucucacacuaacauacuuaguuuuuaucgaucauauuuaaaggcuaggaaagcauuucuacagaguauaggaagaagugauagagaagaaaaucacagauuccuauuauugaaagaacccaagaccgacagacaaacccucguugccggauggaaaucagaauuucaucuaccgaggggaaucuuuacagaggcaguaagagauuguuuaaucgaaaugggauacgaugaagugggaaguuacaaagaaguuggcuucauggcaaaagccguaccacuuuauuuugaaagagcauguaaagauagaguccaaccauuuuacgacuacccuuucaauguaggaaacagucuaaaaccuaaaaaagguagauuuuuaaguaaagaaaaacgagcugaagaaugggaaagcggaaaagaacgauuucgagaucuagaagcauggucacacucagcagcacgaagaauagaagacgcauucguaggaauagaauaugcuucaugggaaaauaaaaagaagauugaacaauuauuacaagaccuaucauugugggaaacguuugaaaguaaauuaaaaguaaaagcugacaaaauaaauauagcuaaacuaaaaaaagaaaucuuagaagccaaagagcauccauaccaugacuuuaaaagcuggcaaaaauucgaaagagaacuacgguuagucaaaaaucaagauauaauaacguggaugauguguagagaucuuauggaagaaaauaaaguagaaggcuuagauacaggcacuuuauaucuaaaagacauaagaacagacguucaagaacaaggaaguuuaaauguucuaaaccauguaaagccaaugagacucccagugguaguuuauagagcagauucaagaggacauguacauaaagaagaggccccauuagcaacaguguacauugaagaaagagauacuaaacuuuuaaaacaggguaacuucaaaaguuucguuaaagauaggcgauuaaauggccuauucuccuuugucgauaccggugcuuuagcaauggaacaauacccgauaucaaaacuaagaguugaauaugaacuagccaaauaccaaacggcaagagugugugcauucgagcaaacuuuagaauuggaggaaagcuuauugacacguuacccacauuuaccagacgaaaguuuuagggaaauguuagaaaguuggagcgauccccuucuagauaaauggcccgauuuacagcgagaagugcgauuguuaauagcgguaagaaaugcauuuucucacaaccaauauccaauguacgaugaaacaaucuuuucuaguauacggaaauaugaccccucaucucuagacgcaauagaagagcgcaugggccucaauauagcacauagacuaagcgaagagguaaaauuagcaaaagaaaugguagaaaggauaauacaagcauaa

SEQ ID NO: 11560 - RNA, 3360 nt, Artificial Sequence
  Cas13b variant__Porphyromonas gulae__WP_039437199.1__Cas13b
augacagaacagucggaaagaccauauaaugguacuuauuauacacuagaagauaaacauuucugggcggccuuccuaaacuuagcuagacauaacgcauacauaacacuaacacauaucgacagacagcuagcauacagcaaagccgacauaacaaacgacgaagauauacuauucuuuaaaggacaauggaaaaaucuagacaaugaccuugaaagaaaaaguaggcuaagaagucuaauacuaaaacauuucucauuccuugaaggcgcagcuuauggaaagaaauucuucgaaucaaaaaguucggggaauaaaagcucgaaaaacaaagaauuaacaaagaaagaaaaagaggaacuccaagcaaacgcauugaguuuagacaacuuaaaaucuauucuguuugauuuucuacagaaauuaaaagacuuccgaaacuacuauagucauuauagacacagugguagcucugaauuaccccuuuuugacggaaacaugcuacaacgucuauauaauguauuugauguauccguacaaagggucaaacgugaucacgaacauaaugaugagguagauccucauuaucacuuuaaucaucuaguacgaaaaggaaagaaagacagauauggucauaaugauaacccaucauucaaacaccauuucguugacggugaagggaugguaaccgaagccgguuuacucuucuucgucagcuuauuccuggaaaaacgcgaugccauauggaugcagaagaaaauaagagguuucaaaggugggacggaaccauacgaacaaaugacuaacgaaguauuuuguagaucacguaucucguugccaaaauuaaaauuagaaucgcuaaggacagaugauuggaugcuauuggacauguuaaacgagcuaguaaggugucccaaaccguuauacgauagacucagagaaaaagaccgagcuuguuuccgaguaccagucgauaucuuaccagaugaagaugauacagacgggggcggcgaagauccauucaaaaauacucuaguaagacaucaagauagauucccuuacuucgcauuaagauacuuugaucuaaagaaagucuucacaucuuuaagauuucauauugacuuagguacauaccacuuugcaauuuacaagaaaaugauaggagaacaaccugaagauagacauuuaacacguaaccuuuauggguuuggccggauucaagauuucgcagaggaacacagaccagaagaauggaaaagauuaguacgagaucuagauuauuucgaaacaggagauaaaccauauauaagucagacaacaccacacuaucauauagaaaaagggaaaauuggccuacgauucguaccagaaggacaacaucuauggccaucaccggaaguuggaacaacuagaaccggaagaucgaaauacgcacaagauaaaagacuaacugcugaggcuuucuuaucaguccaugaauuaaugccaaugauguucuauuacuuucuacucagagaaaaauauucagaagaagugagugccgaaaaaguacaaggcagaauuaaacgaguuaucgaagacguuuacgccauauaugaugcuuucgcaagagaugaaauaaacacauuaaaagaacuagaugcaugccuagcagacaaaggaauaagaagaggacaucuaccaaaacaaaugaucgggauuuuaagccaagaaaggaaagauauggaagaaaaagucaggaagaaauuacaagagaugaucgcagauacugaucaccgucuagauaugcuugauaggcagaccgaucgaaaaaucagaauuggacgcaaaaaugcaggucuaccaaaauccggcguaauugcagacugguuaguuagagacaugaugagauuccaaccaguugccaaagauacuagcggcaaaccacuuaauaacucaaaagcaaacucaacagaauauagaauguuacaacgagccuuagcauuguucgguggggaaaaagaaagguugacaccauauuucagacaaaugaaucuaacgggaggcaauaacccccacccuuuucuccaugagacaagaugggaaucacauaccaacauauugucguucuacagauccuaucuaagagcuagaaaggcuuucuuagaacggauuggcagaucagaucgaguggaaaauuguccauuuuuacuccugaaagaaccuaaaacugauagacaaacacucguggcuggcuggaaaggagaguuccauuuaccaaggggaauauuuaccgaagcagugagagauugucuaauagaaauggguuaugacgaaguagggucauacagagaaguaggauucauggcgaaagccguuccguuauauuuugaacgagcaugugaagacagaguacaaccauucuaugacucaccguuuaaugucggaaacaguuuaaaaccaaagaaaggaagguuccuaucaaaagagaaaagggcagaagaaugggaaucuggaaaagaaagauuuagacuggccaaacugaagaaagaaauuuuagaagcucaagaacacccauaccaugacuuuaaaaguuggcaaaaauuugaaagagaacuaagauuagucaaaaaccaagauauuauaacauggaugaugugcagggaucuaauggaagaaaacaaaguagaaggacuugacacagguacacuauauuuaaaagacauaagaccaaauguacaagaacaaggaucauuaaacguacuaaacagaguaaaaccaaugcgauuaccaguaguaguuuaucgagcagacaguagaggucauguacauaaagaagaagcaccauuggcuacuguguauauagaagaaagagauacaaaacuacugaaacaagggaacuucaagagcuuuguaaaagacagacgacuaaacggacucuuuuccuucguggauacaggcgcucuagcaauggaacaauauccaauaagcaaauuaagggucgaauacgaacuagcaaaauaccaaaccgcaagaguaugcgcauuugaacaaacuuuagaacucgaagaaucauuacucaccagauauccucaccuuccugaugaaucauuucgagaaaugcuagaaucauggagcgauccauuguuaacaaaauggccugaacuacauggaaaaguaagacucuuaauagcaguacguaacgccuucucccauaaucaauauccaauguacgaugaagcaguauucuccucaauauggaaauaugacccuuccucaccagaugcaauagaagaaagaaugggccuaaauaucgcacacagauuaucagaagaagucaaacaagcaaaagaaacaaucgaacgaauaauccaagccuaa

SEQ ID NO: 11561 - RNA, 3360 nt, Artificial Sequence
  Cas13b variant__Porphyromonas gulae__WP_039419792.1__Cas13b
augacggaacaaucugaaagaccauauaaugguacauauuauacacuggaagacaaacauuucugggcagccuuccuaaacuuagcacgucauaaugcauauauaacgcuaacucacauagaccgacaacuagcauacucaaaagcagauauuacaaaugaucaagauguacuaucauuuaaagcauuauggaagaaucuagacaacgacuuagaaagaaaaagucgacugagauccuugauauuaaaacauuucucauucuuagaaggugcagcauauggcaagaaacuauuugaaucuaaaucuucuggaaacaaauccagcaaaaauaaggaauuaacuaagaaagaaaaagaagaauuacaagcuaaugcuuuaagccucgacaaucuaaaaucgauucucuuugacuuccuacaaaaauuaaaagauuuuaggaauuacuauucucacuauagacauagugguucaagugaauuaccacuguuugauggaaacauguuacaaaggcuuuauaaugucuucgacguaucaguacaaagaguaaaacgagaucacgaacacaacgauaaaguagacccacacagacacuuuaaucaucuaguuagaaaaggcaagaaagaccgauacggacauaacgacaacccguccuucaaacaccauuuuguagauggagaaggcauggugacugaagcaggccuuuuauucuuuguaucacuauuuuuggagaaaagagacgccauauggaugcaaaagaaaaucagaggauuuaaaggagggacagaaacguaucaacaaaugaccaacgaaguauucuguagaagccgaaucagcuuacccaaauuaaaauuagaaucacuuagaaccgacgauuggaugcuucuagacauguuaaaugaacuuguuagauguccuaagccacuauacgaucgauuacgagaaaaagaccgagcgagauuccgaguaccugucgauauacugccagacgaagacgauacagauggaggaggugaagacccuuucaaaaacacucuaguaagacaucaagauagauucccauauuuugcacuaagauauuucgauuuaaagaaaguuuucacaucacucagauuucauauagauuuaggaacauaucacuucgccauuuacaagaaaguaauaggagaacaacccgaagacaggcacuuaacacguaaccucuacggguuugguagaauacaagauuuugcagaagaacauagaccagaagaguggaaacgacucguccgagaucuagacuauuuugagacaggcgauaaaccauauauaagucaaacaacuccacauuaucacaucgaaaaagggaaaauuggucuacgauucgucccagaaggacaacauuuauggccuucccccgaaguaggaacaacuaggacaggacguucaaaauaugcccaagacaaaaggcuuacugcagaggcauuuuuauccguucacgaguuaaugccaaugauguucuauuauuuccuauuaagagaaaaauauuccgaggaaguaagugcagaaaaagugcaaggaagaauuaaaagaguaauagaagauguauacgcaauuuaugaugcauuugcacgagaugaaauaaauacacgcgaugaacuagacgcaugcuuagcagauaaaggaauacgacgaggacauuugccaaaacaaaugauuggaauauuaucacaagaacacaaaaauauggaggaaaagguacguaagaaacugcaagaaaugauagcagacacagaccauaggcuagacaugcuagauaggcaaaccgauagaaaaaucagaauaggucggaaaaaugcuggacuaccuaaaucagggguaauugcagacugguuaguaagagacaugaugagauuccagccuguugccaaagauacaaguggaaaaccauuaaacaacucgaaagcuaauucuacugaauacagaaugcugcaaagagcccuagcacuauucggaggugaaaaagaaagacuaacaccguacuuucgucaaaugaaucuaacaggcggaaacaacccacaucccuuccucgacgaaacuagaugggaaucacacacaaauauccugucauucuaccgaagcuaccucagagcaagaaaagccuuucuagagagaauaggaagaucugacagaguagaaaaccgaccauuucuucuccuaaaagaaccaaaaacggacagacaaacgcuuguagcaggcuggaaaucugaguuucaccuaccuagaggaauauucaccgaagcaguccgugacuguuuaauagaaauggguuaugaugaaguaggaucuuauaaagaaguaggauucauggcaaaagcuguucccuuauacuucgagcgagcaugcaaagauagaguacaaccuuuuuaugauucaccauuuaauguuggaaacucguuaaaaccaaagaaaggaagauucuuaaguaaagagaaaagagcagaagaaugggaaucuggaaaagaacgguuuagauuagcgaaacuuaagaaggaaauauuagaagcacaagaacauccauaccaugauuucaaaagcuggcaaaaauuugaacgugaauuaagauuggucaaaaaucaagacauuauaacauggaugaugugcagagaccuuauggaagaaaacaaaguugaaggauuagacacaggaacuuuauaucuaaaggacauuagaccaaacguccaagagcaagguucacuaaacguauuaaaucgaguaaaaccaaugagacuaccaguaguaguauauagagcugauucaagagggcacguacacaaagaagaagcuccauuagccacuguuuauauugaagaaagagacacaaaacuuuuaaaacaaggaaacuucaaaucguuuguaaaggaucgacgcuuaaacggacuguuuaguuuuguugauacagguggacuggccauggaacaauacccuauaucaaaauuaagaguugaauaugaacuagcaaaguaucaaacagcgcgaguaugugucuuugaacucacauuaagacuagaagaaucacuauuaagccgguacccacaucuaccagaugagaguuuuagagaaauguuagaaucauggagugauccauuauuagcaaaauggccugaauugcacgguaaaguccgauuguuaauugcaguaagaaaugcauucucucacaaccaauauccaauguaugacgaagcaguauuuucaucaaucagaaaauaugacccaucaucgccugaugcuauagaagaacgcaugggacucaacauagcucacagacuuagugaagaaguaaaacaagcuaaagaaacuguugagagaauaauacaagcauaa

SEQ ID NO: 11562 - RNA, 3528 nt, Artificial Sequence
  Cas13b variant__Porphyromonas gulae__WP_039431778.1__Cas13b
augacggaacaaucagaaaggccguauaacggcacauauuacacacuagaagacaaacauuuuugggcagcuuucuuaaacuuggcuagacauaacgcauauauaacucucacacauauagauagacaacuagcauauucaaaggcagauaucacaaaugaucaggauguacuaucauuuaaagcacuauggaaaaauuuugacaacgauuuggagcggaaaucaagguuaagaucacuuauauuaaaacacuucuccuuucuagaaggcgcagccuacggaaaaaaacuuuucgaaaguaaaucaaguggaaauaaaucauccaaaaauaaagaacugacaaaaaaagaaaaagaagaacuccaagcgaaugcauuaucacuagauaacuugaaaucaaucuuauuugauuuucuucaaaaacuuaaagacuuccgcaacuauuauucccauuauagacacagugaaucuuccgaacuaccacucuuugacggaaauaugcuccaaagauuauacaacgucuucgaugucucaguacagagaguaaaaagagaucaugaacauaacgacaaaguagacccacacaggcacuuuaaccaucuaguaagaaaagggaaaaaagauagauacggucauaaugacaauccaucauucaaacaucauuucguagacggugaagggauggucacagaagcaggucuauuauucuucguaaguuuauuucuagaaaaaagagacgcgaucuggaugcaaaaaaaaauacguggcuuuaaaggcggcacugaaacauaucagcaaaugacuaaugaaguauucugccgaucacguauaaguuuaccaaaacucaaauuagaaagucucagaacugaugauuggaugcuauuagacauguuaaaugaacuaguaagaugcccaaaaccccuauaugauagauuacgugaagaugauagagcuugcuuuagagucccagucgauauacuacccgacgaagaugacacggacggagggggcgaagacccauucaaaaauacauuaguacgacaucaagaucguuucccauauuuugcacuaagauauuucgauuugaaaaaagucuuuacuucguugagauuucacauagaucuaggaacauaucauuuugcaaucuacaaaaagaugauaggggaacagccugaagauagacauuuaacgcguaaccuauauggcuuugguagaauacaggauuucgcugaagaacauagacccgaagaguggaaaagacuagugagggaucucgauuacuuugaaacuggugauaaaccauauauaucacaaacaagcccgcacuaucacauugagaagggaaaaauaggacuacgcuuuaugccagaaggucaacaccuauggcccagcccugaagucggcacaacacgaacuggaagauccaaauacgcucaagacaaaagacuaacagcugaagccuuccuaagcguacaugaauuaaugccgaugauguucuauuacuuucuccugagagaaaaauacucagaggaaguaagugcagagaaaguacaaggaaggauaaaacguguaaucgaagauguauacgcaauauaugaugcuuucgccagagacgaaauaaacacacuaaaagaacucgaugcaugucuagcggauaaaggcauccggagaggacaccuuccaaaacagaugauugcgauucucucacaagaacacaaagauauggaagaaaaaaucaggaaaaaauuacaggaaaugauagcagacacggaccaccgauuagacaugcuagauaggcaaacagaccgaaaaauaagaauaggaagaaagaacgcaggcuuaccaaaauccgggguuauagcagacugguuaguccgcgauaugaugagguuucaaccaguagccaaagacacaaguggaaaaccauuaaauaacaguaaagccaauucaacggaauaccgcauguuacaaagagcauuagcuuuauuugggggggagaaaaaacgucuaacaccuuacuuuaggcaaaugaaucuuacaggaggaaauaauccucauccauucuuacacgaaacucgaugggaaagccacaccaauauauugucauuuuacagaucuuacuuaagagcgagaaaagcauuccuagaacgcauuggaaggagugaucgaauggaaaacagaccuuuuuuauuauuaaaagaaccaaagacggaccgacaaacacuaguugcgggcuggaaaucagaguuccaucuaccaagaggcaucuucacugaagccguaagagacugucucauagaaaugggauaugacgaaguaggaucauaucgugaagugggauucauggcaaaagccguaccauuauacuuugaaagggccugcgaagaucgaguucaaccauuuuaugacaguccuuucaauguagguaauucacuuaaaccaaaaaagggcagauuucuaagcaaagaagaacgagccgaagaaugggagcgagguaaggaaagauuuagagacuuagaagccuggagucacagugcagccagaagaaucgaagaugcauuugcagguauagaauaugcaucaccaggaaauaaaaaaaagauagaacaauuacucagagauuuaucauuaugggaagcuuucgaaucaaaauuaaaaguaagagcagacaaaauuaaucuagcaaaacuaaaaaaagaaauuuuagaggcacaagagcacccuuaccaugacuucaaaucauggcagaaauuugaaagagaacuaagacuagucaaaaaccaagauauuauaaccuggaugauguguagggaccuuauggaagaaaauaaaguagaagggcuggacacaggaacguuguaucuaaaagacauaagaccaaauguccaagaacaaggaagcuuaaacguuuuaaaccgugugaaaccuaugagauuaccagugguagucuacagagcagauucccgaggacauguacauaaagaagaagcgccacuugcgacagucuacaucgaagaaagagauacaaaauugcuaaaacaaggaaacuuuaagucauuuguuaaagacagaaggcucaauggacuuuucaguuuuguagacacagguggauuagccauggaacaauacccaauaucaaaauuaagagucgaauacgaauuagcaaaauaucaaacagcaaggguuugcguauuugaacugacgcugagauuagaagaaucacugcugacuagguacccacacuuaccugaugaaucauuuagaaagauguuagaaucaugguccgauccacuccuugcaaaauggccagaauugcacggaaaagucagauuauuaauagcuguaaggaaugcauuuucccauaaucaauacccaauguacgacgaagcaguuuuuagcucaauaagaaaauacgauccuaguaguccugaugccauugaagaacguaugggauugaacauagcacacagguugagugaggaaguaaaacaagcaaaagaaacaguagaacgaauaauucaaguauaa

SEQ ID NO: 11563 - RNA, 3528 nt, Artificial Sequence
  Cas13b variant__Porphyromonas gulae__WP_046201018.1__Cas13b
augaccgaacaaagcgaaagaccuuacaauggaaccuauuauacuuuagaggauaaacauuuuugggccgcauuuuugaaucuggcacgucauaaugcauauauaacguugacccacaucgaucgacaauuagcauauucaaaggccgauauaacaaacgaucaagacguauuaagcuucaaagcacuguggaaaaauuucgauaaugacuuagaacguaaaaguagacucagaagucuaauccuaaaacacuuuagcuuccuggaaggugccgcauauggcaaaaaauuauucgaaagcaaaagcaguggaaauaaaucaucaaaaaauaaggaauuaacgaaaaaagaaaaagaagaauuacaagcaaaugcucucucacuagacaaucuaaaaucaauucuauucgauuuucuacaaaaacugaaagacuucaggaacuauuacagucauuaucgacauucggaaucaucagagcuuccacuauuugauggaaauauguuacaaagacuauacaacguauucgauguauccguacaacguguaaaaagagaccaugaacauaaugauaaaguagacccucacagacauuucaaucaccuaguaagaaaaggcaagaaagacagauauggacacaaugauaaucccagcuuuaagcaucauuuuguagacagugagggcaugguaacagaagcaggcuuacuauuuuucguaagcuuauucuuagagaaaagagaugcaauuuggaugcaaaaaaaaauaaggggguucaagggaggaacagaaacauaccaacagaugaccaacgaaguauuuugccgaucgaggauuagcuuaccaaaauuaaaacuagaaucgcuacguacagacgauuggaugcuauuggauaugcuaaaugaacuaguccguuguccaaaaccgcuguacgauagacuacgagaaaaagaucgagcuagauuuagagucccgguagauauuuuaccugaugaagacgauacggacggagguggagaagacccuuuuaaaaacacauuaguaagacaucaagauagauucccauauuuugcuuuaagauauuucgaucucaaaaaaguauucacaucauuaagauuucauauagaccuaggaaccuaucauuuugcaauauauaaaaaaaugauaggcgaacaacccgaggauagacaucuaacgagaaaucuguauggauucggccgaauccaagacuucgcagaggaacauagacccgaagaauggaaaagguuaguuagagaucucgacuauuuugaaacuggagauaaaccauacauaagccaaaccaccccucauuaucacauagaaaaaggaaagauuggauuaagauuuaugccagaaggacaacaucuauggccaagcccggaggucggaacuacuaggacaggaaggaguaaauaugcucaagacaaaagauugacagcggaagccuuccuaucagugcaugaauuaaugccgaugauguucuauuacuuuuugcuaagagaaaaauauuccgaagaagugucugcagaaaaaguccaaggaaggaucaaacgaguuauagaagauguauaugccauauacgacgccuucgcacgagaugaaauaaacacacuaaaagaacuagacgcaugccuagcggacaaaggaauuagacgaggccaccuaccaaaacaaaugauugcuauccuaagucaagaacacaaagauauggaagaaaaaauacgcaaaaaauuacaagaaaugaucgcugauacugaucacaggcuagauaugcuagauagacaaacugauagaaaaauaagaauaggaagaaaaaacgcaggauugccaaaguccggaguaauagcugauugguugguuagagacaugaugagauuccaaccaguagcaaaggauaccagcgggaaaccauugaauaacucuaaagcaaauucaacagaauaucgaaugcuacagagagcccuagcuuuauuuggaggcgaaaaaaaacggcucacaccauauuuucggcaaaugaacuuaacaggaggaaauaauccacaccccuuccuacaugaaacaagaugggagucacauacuaacauauuaaguuuuuaucguuccuaccuaagagcaagaaaagcuuuccuagaaagaauagggagaucugaucguauggagaaccguccauuuuuauuacuaaaagaaccaaaaacugacaggcaaacuuuaguugcuggauggaaaagugaguuccaucugcccagaggaauauuuacugaagcaguccgagauugucuaauagagauggguuaugaugaaguaggaucauauagagaaguaggauucauggcgaaagcaguuccacuguauuucgaacgggcaugcgaagauaggguacagccauucuacgacagcccguuuaacguagggaauagcuugaaaccaaaaaaagguagauucuuaucgaaagaagaaagagcugaagaaugggaaagagggaaagaacguuucagggauuuagaggcguggucacacucugccgcgcgacggaucgaagacgccuuugcaggaauagaauacgcaucuccagguaauaaaaaaaaaauagaacaauuacuacgagaucuaagucucugggaagccuuugaaaguaaacuaaaaguaagagcugauaaaauaaaccuagcaaaauuaaaaaaagaaauucuagaggcgcaagaacacccuuaucaugauuucaagucauggcagaaguuugaaagagaauugcguuuaguuaaaaaccaagauauaauuaccuggaugaugugcagggaucuuauggaagaaaacaaaguugaaggacuagauacagggacacuguacuuaaaagauauaagaccaaacgugcaagaacaaggaagucuaaauguauuaaaucgaguaaagccgaugagauugccggugguaguauauagagcggauagucgcggacauguacauaaagaagaagcuccucuagcaacaguauauaucgaagaaagagacaccaaauuacugaaacaaggaaacuuuaaaucguuuguaaaagacagaaggcuaaauggguuauuuaguuuuguugauaccggaggccuggccauggaacaguacccaauaucaaaauuaagaguugaauacgaacucgccaaauaucagacagcacgaguguguguauucgaauuaacacuaagauuagaagaaucacuuuuaacacgauacccccaucuacccgaugaaaguuucagaaaaaugcucgaguccuggucagacccacucuuagccaaguggcccgaacuacauggcaaaguaagacuucuaauagccguaaggaaugcauuuucacacaaucaguauccaauguaugaugaggccgucuuuucauccauacgcaaauaugacccaucaucaccagaugcaauagaagaaagaaugggauuaaauauagcucaccgauuaagcgaagaggugaaacaagcaaaagagacaguagaaagaauuauacagguauaa

SEQ ID NO: 11564 - RNA, 3525 nt, Artificial Sequence
  Cas13b variant__Porphyromonas gulae__WP_039442171.1__Cas13b
augacugaacaaucagagagaccauauaauggcaccuacuacacauuggaagacaaacacuucugggcugcuuucuuaaacuuagccagacauaacgccuacauaacacuuacucacauugacagacagcuagccuauagcaaagcggacauuacaaaugaccaagacguacuaucauuuaaagcauuauggaaaaaccuagacaacgauuuagaaagaaagagcagguuacguucucucauacuaaaacacuuuucuuucuuagagggcgcagccuauggaaagaaauuguucgaaagcaaaucaagcggcaauaaaaguucuaaaaauaaagaacucaccaagaaagaaaaagaggaacuacaagcuaaugcauuaucccuugauaaucuaaaaagcauacuuuuugacuuuuuacaaaaacuaaaagauuucagaaacuauuauagccauuaucgucacagcgguucaucagaacuucccuuauuugauggcaauaugcuucaaagacuuuauaauguauuugauguaagcguacaaagaguaaaacgagaccaugaacauaaugauaaaguagacccccauuaccauuucaaucacuuaguaagaaaaggaaagaaagaccgauauggccacaacgauaacccuagcuuuaaacaucacuucguugauucggaaggaaugguuacagaagcaggucuauuauucuucguaucacucuucuuagaaaaacgagaugcaauuuggaugcaaaagaaaauaagaggauucaaaggcgguacaggaccauaugaacaaaugacaaacgaaguauuuuguagaucaagaauaucauuacccaaauuaaaacucgaaucacuaagaaccgaugacuggauguuacucgauaugcuaaacgaacuggugagguguccuaaaccacuuuaugauagauugcgagaaaaagacagagcaugcuuucgaguaccagucgauauuuuacccgaugaagaugauacagauggagguggagaagacccuuuuaaaaauacgcuaguccgacaccaagaccgauuccccuauuucgcccuacguuauuucgauuugaaaaagguauuuacgagucucagauuucauaucgaucuagggacuuaucauuuugcaauuuacaagaaaaugaucggugaacaaccagaagaucgacacuugacccgaaauuuauacggauucggucgaauccaagacuuugcggaagaacaccgaccagaagaauggaaaagauuaguaagagaccuagauuaccuugaaacaggugacaaaccauauauaucacaaacaaccccgcacuaccacaucgaaaaaggaaaaauuggacuaagauuuguaccagagggacaacaucuauggccaucccccgaaguuggaacuacuagaacaggaagaucaaaaugugcucaagacaaaagacucacagcugaggcauuuuuaaguguacaugaauuaaugccaaugauguuuuauuacuuccuucuaagagaaaaauauagugaagaaguaagugcugaaaaaguacaaggaagaauuaaacgaguaaucgaagauguauaugcgauauacgaugccuuugcacgugaugaaauaaauacucuaaaagagcuugauacaugucuagccgacaaaggaauaagaagaggucaccuaccuaaacaaaugauaacuauauuaucccaagaacguaaagacaugaaagagaaaauaagaaagaaacugcaagaaaugauagcggacacugaccacagacuagauaugcucgaccgacaaacagaccgaaaaauuagaauaggucgcaaaaaugcaggauuacccaaaagcggaguaauagcagacuggcuaguuagagacaugaugagguuccaaccaguagcuaaagacgcaucagggaaaccauuaaauaauaguaaagccaacagcaccgaauaccgcauguuacaacgagcucucgcuuuauucggaggagaaaaagaaagacuaacaccauauuuccgacaaaugaauuuaacagggggaaacaauccacacccguuucugcaugaaacaagaugggaaucucauacaaauauacuaucuuucuacaggucuuauuuacgcgcaagaaaagcauuuuuagaacgaauugguagaagcgauagagucgaaaacuguccauuccuauuauugaaagaaccaaaaacugacagacaaacucuuguagcgggauggaaagacgaguuccaucucccuagaggcauuuuuacugaagcaguaagagacugccuaauugaaaugggcuaugaugaaguaggaucauauagggaagucggauuuauggcaaaggcggucccuuuguauuuugaaagagcaugcgaagacagaguucaaccauucuaugacagcccuuuuaacguaggaaauucacuaaaaccaaagaaagggagauuucuuucaaaagaagaucgagccgaagaaugggaaagaggaauggaaagauuucgugaucuagaagcauggagucauuccgcagcacggaggaucaaagacgcauucgcagggauugaauacgcaucaccaggaaacaaaaagaaaauagaacaacuacuaagggacuuaucacuaugggaggcauuugaaucaaaauuaaaaguaagagccgacaaaauuaaccuagcuaaauuaaagaaagaaaucuuggaagcucaagaacacccuuaucaugacuucaaaucauggcaaaaauuugaaagagaauuacgacuuguuaaaaaucaagacauaauaacauggaugaugugccgagaccuaauggaagagaacaaagucgaaggucuagacacaggcacucuuuaucuaaaagacauaagaccaaacguacaagaacaagggucauugaacguacuaaauagaguaaaaccaaugagauuaccaguuguaguauaucgagcagauucccgagggcaugugcauaaagaagccccuuuagcgacgguauacauugaagaaagaaacacuaaacuacugaaacaagguaauuuuaaaaguuuuguaaaagauagaagacuaaaugguuuauuuuccuuuguugauacagguggacuagcaauggagcaauacccaaucaguaaguugcgaguugaauaugaacuagcaaaguaucaaacagcacgagucugcguauuugaauuaacacuaagauuagaagaaucauuauuaaguagauauccccauuugccagacgaaaguuuuagagaaaugcucgaaaguuggagugauccucuacuagcaaaauggcccgaacuacacggaaaaguccgcuugcuaauagcaguaagaaaugcauuuagccauaaucaauaccccauguaugaugaagccguauuuucuagcauaagaaaauaugacccaucauccccagacgcuauagaggaaagaaugggacuaaacauugcucauagacuaucagaagaggucaaacaagcaaaggaaacgguagaaagaauaauccaagcauaa

SEQ ID NO: 11565 - RNA, 3360 nt, Artificial Sequence
  Cas13b variant__Porphyromonas gulae__WP_039426176.1__Cas13b
augacagaacaaagugaaagaccauacaacggaacuuacuauacacuugaagacaaacacuucugggcggcuuuucuuaaccuagcacgccacaaugcauauauuacuuuaacacauauagacaggcaacuagcauauuccaaggcagauaucacuaaugaccaagacguacuaucauucaaagcacuauggaaaaauuucgauaaugaucuagaaagaaaaucacgucuaagaucacuuauacuuaaacauuucucguuccuagaaggcgcugcauauggaaaaaaauuauuugaaucgaaaaguagcgggaacaaaucaucaaaaaauaaggaauuaacaaaaaaagaaaaagaagaacuccaagcuaacgcccuauccuuagauaauuuaaagaguauacuauuugacuuuuuacaaaaguuaaaggacuucagaaacuacuauucacacuaccgacauaguggaagcagcgaauuaccucuauucgauggcaauaugcuacaaagauuguacaauguuuuugacguuaguguucaaagaguuaaaagagaucaugaacauaaugauaaaguugacccucauuaccauuucaaucaccuaguacguaaaggaaaaaaagaucgauacggacacaaugacaauccuagcuuuaaacaucauuuugucgauucugaaggaaugguuacggaagcaggccuauuguuuuuugugucacuuuucuuagaaaaaagagaugcuaucuggaugcagaaaaagauaagaggauucaaaggcggaacaggaccguacgagcaaaugacgaaugagguauucuguaggagccgaauuucucuuccaaaacuuaaauuagaaucccuccgaacggacgacuggauguuacuagacauguuaaacgaacuugucagauguccaaagccgcucuacgaccgacucagagaaaaagacagagcaugcuucagagucccaguugacauacuaccagaugaagaugacacugacggagguggagaagacccauuuaaaaacacgcuuguucgacaucaggauagguuuccuuacuuugcauuaagauauuucgacuuaaaaaaaguuuuuaccucacuaagauuucauauugaccuaggaacauaccacuuugcaauauauaaaaaaaugauuggggaacaaccagaagaucgacacuuaacgagaaaccuuuacgguuuugguagaauacaagauuuugccgaggaacauagaccugaagaguggaaaagacuuguaagagaccuagauuauuucgaaacaggcgauaaaccauauauuucacagacuaccccacauuaucauauagaaaaagguaaaauuggauugagauuuaugccugagggucaacaucuguggccaagcccagaaguaggaacuacaagaacgggacgaucaaaauacgcacaagacaaaagauugacggcagaagcauuucuaagcguccacgaguuaaugccaaugauguuuuauuauuuuuugcuaagggaaaaguacagugaagaagugagcgcagaaaaaguucaaggcagaauaaaaagaguaauaaaagacgucuaugcaauauacgaugcauucgcaagggaugaaaucaauacacucaaagaauuagacgcauguagugcagauaaagguauacgaaggggccaucuaccaaaacaaaugauuggaauacuaagucaagagcacaaaaauauggaagaaaaaguuaggaaaaaacuacaagagaugauagccgacacagaccaucgcuuagauaugcuagauagacagacagaccgaaaaauaagaauaggaagaaaaaaugccggacuaccuaaaucaggaguuauagcagacugguuagucagagauaugaugcguuuucaaccaguagcuaaagauacaagcgggaaaccacucaauaauagcaaagcaaauagcacugaauaccgaauguuacaaagagcucuugcauuauuuggaggcgaaaaagaaagauuaacaccauacuuccgacaaaugaauuuaacaggaggaaauaacccacauccuuuuuuagaugaaacaagaugggaaagccacaccaauauauuaucauuuuaccgaagcuauuuaagagccagaaaagccuuucuagagcgcauuggaagaagcgauagagucgaaaauagacccuucuuauuacuuaaagaaccuaaaaacgacaggcagacacuaguagcaggauggaaaucggaauuccaccuaccuaggggaaucuucacggaagcagucagagacuguuuaauagaaaugggguaugacgaagucgguucauauaaagaagucggauuuauggcuaaagccguacccuuauauuucgaaagagcauguaaagauagaguacaacccuuuuaugacucgccuuuuaacguaggaaauucauuaaaaccaaaaaaaggaagauuuuuaucuaaagagaaacgagcugaagaaugggaaucaggaaaagaaagauucagacuggcaaaauuaaaaaaagaaauacucgaagcgaaagaacacccauaccacgauuuuaaauccuggcaaaaauuugaacgugagcucagauuaguuaaaaaucaagacauaauaacauggaugauguguagagauuuaauggaagaaaauaaaguagaaggacuugauaccggaacauuguaucucaaagauauacggaccgaugugcaugaacaggguucauuaaacguacuaaauagaguaaaaccuaugagacucccgguuguagucuaccgagccgauaguagaggucacguacacaaagaacaagccccucuggcaacugucuacauagaagagcgagauacuaaacuuuuaaaacaagguaauuuuaaaucauuuguuaaagauagaagacuaaacggccuuuucaguuucgucgacaccggaggucucgccauggaacaauauccaauaucaaaacugcgcguagaauacgaacuagccaaauaucaaacagccagggugugugcauucgagcaaacccucgaacuagaagaaucguuacuaacgcgauauccucauuuaccagaugaaaauuuccgagaaaugcuagaaucuuggagugauccgcuuuuaggaaaauggccugaucuacauggcaaaguaagauuauuaauugcugugagaaaugcauuuucgcauaaccaguacccuauguacgaugaagcaguuuuuuccagcauaagaaaauaugauccuucaagcccugacgcaaucgaagaaagaaugggauuaaacauugcacauagauuaagugaagaaguuaaacaggcaaaagaaacaguagaaagaauuauacaagccuaa

SEQ ID NO: 11566 - RNA, 3528 nt, Artificial Sequence
  Cas13b variant__Porphyromonas gulae__WP_039418912.1__Cas13b
augacagaacagucagaacguccauauaauggaacauacuacacuuuagaagauaaacacuucugggcagcauuuuuaaaccuagcaagacauaaugccuacauaacguuaacgcacauugauagacaauuagcuuauagcaaagccgacauaacuaacgaucaagacgucuugagcuucaaagcacuuuggaaaaaccuagauaacgaucucgaaaggaaaagcagacuaaggucauuaauuuuaaaacauuucuccuuccuagagggagcugcauauggaaagaaacuauucgaaucgaaaagcaguggaaauaaaucuuccaaaaauaaagaacuuacaaagaaagaaaaagaagaacuucaagcaaaugcuuuaucguuagacaacuuaaaaucuauacucuuugacuucuuacagaaacuaaaagacuucagaaacuauuacucacacuauaggcacaguggaucaucugaauuaccccuauuugaugguaauauguuacaacgacuauacaacguauuugacgucucaguacaacggguaaaaagagaccacgaacauaacgauaaagucgauccucauagacacuuuaaucaccuaguaagaaaaggaaagaaagacagauauggacauaaugauaacccaaguuuuaaacaucacuucguugauuccgaaggaaugguuacagaagcaggacuauuauuuuucgugucccuguuccucgaaaaacgagacgcaauuuggaugcaaaagaaaauuagagguuucaaaggagguacagaaacauaucagcaaaugaccaaugaaguauuuuguagauccagaaucuccuuaccuaaauuaaaacuggaaagccucagaauggaugauuggauguuauuagauauguuaaaugagcuaguucgauguccaaaaccucuauacgauagguuaagagaagacgaucgugcauguuuucguguuccuguugauauauuaccagaugaagaugauacugacggugggggagaagacccauucaaaaauacuuuaguucgucaucaagaucgcuuucccuauuuugcgcuacguuauuucgauuuaaagaaaguuuuuacaucacuaagguuucauaucgaucuuggaacguaccauuuugcaauauauaagaaaaugauaggugaacagccagaagauaggcauuuaacaagaaacuuauacggauucgggagaauacaggauuuugcagaggaacaucgcccggaagaauggaaacgauugguaagagaccuagauuacuucgaaacaggagauaaaccauauauaucacaaacaucuccacacuaucauauagaaaaaggaaaaaucggacuacgauucaugccagaaggacaacacuuauggccaagcccagaaguuggaacaacgcgaacggguaggaguaaauacgcucaagauaaaaggcucacggcagaggccuuuuuaucgguccacgaauuaaugccgaugauguucuacuacuuuuuacuacgagaaaaauauucggaagaaguuagcgcugaaaaaguccaagguagaauuaaaagggucauagaagauguauaugcaauauaugaugcauucgcuagagacgaaauaaauacauuaaaagaacucgacgccugucuugccgacaaaggcauccgaagaggacauuuaccaaaacaaaugauagcaauucuaucacaggaacauaaaaauauggaagaaaaaguacgcaagaaauuacaggaaaugauugcagauacagaucaucgacuagacauguuagauaggcaaacagaucguaaaauaaggauuggucguaaaaaugcggguuuacccaaaagugguguaauagcagauugguuagucagagacaugaugagauuucaaccaguugccaaagaugcaagcggaaaaccauuaaacaacucaaaagcaaauucaacagaauauagaaugcuucaacgcgcacuagcacuauucgguggugaaaaagaaagguuaacaccauauuuucgccaaaugaacuugacaggaggaaacaacccacaucccuuccuccaugauacaagaugggaaagucacaccaauauucucucauuuuauagaagcuauuugagagcaagaaaagcauucuuagaacgaauuggcagaagcgauagaauggaaaacagaccauuucucuuacugaaagaaccuaaaaccgauagacaaacauuaguagcuggguggaaaucagaauuucacuuacccagaggcauauuuacugaagcgguaagagacugccuaauagaaaugggcuaugacgaagucggaaguuauagagaaguuggcuucauggcgaaagcaguaccacuuuauuucgaaagagcuugugaagauagaguacaaccuuucuaugacucaccuuucaauguaggcaacucuuuaaaaccaaagaaaggcagauuucucucgaaagaagaaagagcagaagaaugggaacgaggaaaagaaagauuuagagacuuagaagccuggagucauagugccgcucgaagaaucgaagaugcauucgcuggaauagaauacgcaucuccgggaaauaaaaagaaaaucgaacaauuacuaagagaucugagccuuugggaagcauuugaaucgaaauuaaaaguaagagccgauaaaauaaaucuagcaaaacuaaagaaagaaauucuagaagcccaagagcacccauaucacgacuucaaaucuuggcaaaaauucgagagagaacugcgacuuguuaaaaaccaagauaucauaaccuggaugauguguagggacuuaauggaggaaaauaaaguugaaggacuagacacuggaacauuauauuuaaaagauauuagaacaaauguccaagaacaaggcaguuuaaauguacucaaucacguuaaaccgaugagacuaccaguugugguauauagagcagacucacggggacauguacauaaagaagaagccccuuuagcuacaguauauaucgaagaaagagacaccaaauuauuaaaacaaggaaauuuuaaaucauucguaaaagaccgaagacuaaauggacuauuuagcuucguagacacaggaggacuugcaauggaacaguauccuauuagcaaauuacgaguagaauaugaacuagccaaauaccagacagccagaguaugugcuuuugagcaaacuuuagaacucgaggagagcuuacuaacuagauacccacauuugccagauaaaaauuucagaaaaaugcuagaaucauggagcgauccacucuuagccaaauggccagaacuacauggcaaagucagacuuuuaauagcuguuagaaaugcauucagucacaaucaauacccaauguacgacgaagccguauucagcucaauuagaaaauacgacccaucaagcccagaugccauagaagaacggaugggacuaaacauagcacauagauuaagugaagaagucaaacaagcaaaagaaacgguagaaagaaucauacaggcauaa

SEQ ID NO: 11567 - RNA, 3528 nt, Artificial Sequence
  Cas13b variant__Porphyromonas gulae__WP_039434803.1__Cas13b
augaccgaacaaagugaaagacccuacaacggaaccuacuauacacuagaagauaaacauuucugggccgccuuuuuaaaccuugcuaggcacaacgcauauauaacacuuacacacauugacagacaguuggcauauuccaaagcugauauuacaaaugaucaagauguacuaucauuuaaagcucuuuggaaaaacuuugauaaugaccuagaaagaaaauccagguuaagaagccuaauauuaaaacauuucucauuuuuagaaggggcagcguaugguaagaaacuauuugaaaguaaaucaagcggaaacaaaucaaguaaaaacaaagaacuaacaaagaaagaaaaagaagaauuacaagcaaaugcuuuaucuuuagacaauuuaaaaagcauacuauuugauuucuuacaaaaacuuaaagauuuucgaaauuauuacagccacuaucgucauucaggaagcagcgaauuaccacuuuucgacgggaacauguuacaaagguuauacaauguuuucgaugucaguguccaacgaguaaaaauugaucacgaacacaacgacgaaguagacccacauuaccauuuuaaucauuuaguccgaaaaggaaagaaagacagguauggacauaacgauaauccaucauuuaaacaccauuuuguugauggagaaggcauggugacagaagcugguuuauuauuuuucguaucauuauucuuagaaaaacgcgaugccauauggaugcaaaagaaaauuagaggguucaaaggagguacugaaaccuaccaacaaaugacaaaugagguauuuuguagaaguagaauaagucuacccaaauuaaaauuggaaucucucaggauggaugauuggaugcuguuggauauguugaaugaacucguuagauguccaaaaccccucuacgaccgccuccgagaagaugaccgugcaugcuuucgaguacccguggacauacuaccugacgaagaugacacugauggagguggagaggauccauucaaaaauacuuuaguaagacaucaagauagguucccauauuucgcccuaagauauuuugaucugaaaaagguuuuuaccucauugagauuucauaucgauuuagggacauaccauuuugcuaucuacaagaaaaugauaggagagcaacccgaggacagacaccucacaagaaacuuauauggcuucggcaggauucaagauuucgccgaggagcauagaccagaagaauggaaaagauuaguucgagaucuagauuauuuugaaacaggagauaaaccauauauaagucaaacuucaccgcauuaucauauagaaaaaggcaaaauaggauugagauuuaugccugaaggacaacaucuauggccaagucccgagguugguaccaccagaacagguagaaguaaauacgcucaagauaaacgauugacagcggaggcguuucuaucaguccaugaacuuaugcccaugauguuuuauuacuucuuacuacgagagaaauauucagaagaagucucagcagaaagaguacaaggcagaauaaaacgaguaauugaagauguuuaugcgguuuaugacgccuuugcgagagacgaaauuaacacucgcgaugaacuagaugcgugucucgcugacaaagggauucgcagaggacacuugccuagacaaaugauagcaauauuaucacaagaacacaaagacauggaggagaaaauucgaaagaaauugcaagaaaugauggccgauacugaccaccgacuagacauguuagauagacaaacugauagaaaaauaagaaucggaaggaaaaacgcuggucuacccaaaucaggaguaaucgcagacugguuaguuagagauaugaugagauuucagccaguagcaaaagacgcaucugguaaaccacuaaacaauaguaaagcaaauucaacagaauacagaauguugcaaagggcacuugcacucuuuggaggcgaaaaagaaagacugacaccauacuuccgacaaaugaaccuaaccggagguaacaauccacauccuuuccuccacgaaacccgcugggaaucacauaccaacauucuaucuuucuaucgaucguaccuuagagcaagaaaagccuuuuuggaaaggauaggucguucugauaggguugaaaacagaccauuucuauuauuaaaagaaccaaaaacagacagacaaacucuagucgcuggcuggaaaggagaauuucaccuuccuagagguauauucacagaagcuguuagggauugucuaaucgaaaugggacaugaugaaguugcaucguauaaagaaguuggauucauggcuaaagcaguaccucuuuacuucgaacgagcaugugaagauaggguucaaccauuuuaugauaguccauuuaacguagguaacagcuuaaaaccuaagaaaggcagauuccuaaguaaagaagaaagggcagaagaaugggaacguggaaaagaaagauucagagaccuagaagcauggucuuacuccgcggcaagacgaauagaagaugcuuuugcuggcauagaauacgcaucaccaggaaacaaaaagaaaauagaacaacuacuacgcgaucugaguuuaugggaagcguucgaaagcaaacuaaaagugagggccgaucgaaucaaucuagcaaaacucaagaaagaaauauuagaagcacaagaacauccuuaucaugauuuuaaauccuggcaaaaauuugaacgugaauuacgauuagucaaaaaucaagacauuauuacauggaugaugugcagagaccuaauggaagaaaauaaaguagaaggccuagauacaggaacacuauacuuaaaagacauaagaccaaaugugcaagaacaagggagccuaaauguucuaaaucgcgucaaaccuaugagacuucccguaguuguauauagagcagacagucgcggacacguucauaaagaagaagcuccccuagcgacgguauauauagaagaaagagauacaaaacuauuaaaacaaggaaauuuuaaaucauuugucaaagaccguagauuaaauggcuuauuuagcuucgucgauacagguggguuagcgauggaacaauauccaauaucuaaacuuagaguagaauaugaacucgccaaauaucaaacugccagaguaugcguuuuugaauuaacauuaaggcuagaagaaagucucuuaacaagauauccucaucuuccugacgagagcuucagagaaauguuagaaucuuggucugacccucucuuagcaaaauggccugaauugcauggcaaaguaagacucuugauugcuguaagaaacgcguuuucacacaaucaauacccuauguaugacgaagcaguauucucaucaauaagaaaauaugauccaaguucgccugaugcuauagaagaacgaaugggguuaaauauagcacaccguuuaagcgaagaaguaaaacaagcaaaagaaacaguggaacggauaauccaagcauaa

SEQ ID NO: 11568 - RNA, 3528 nt, Artificial Sequence
  Cas13b variant__Porphyromonas sp.__WP_039428968.1__Cas13b
augacagaacaaucagaaagaccuuauaauggaacguauuauacuuuagaagauaaacacuucugggccgcauuccucaaucuugcacgucacaaugcauauauuacacuuacucacauagauagacaacuagcguacucaaaagcugauauuacuaaugaccaagacgucuugaguuuuaaagccuuauggaaaaauuuugacaaugaccuugagcgcaagucaagauuacgaagucuaaucuugaaacacuuuucauuuuuagaaggugcagcuuacggaaagaaauuauuugaaucuaaaagcucuggaaauaaaaguaguaaaaacaaagagcucacuaagaaagaaaaagaagaacuucaagcaaaugcauuaucauuagauaaucuuaagucgauucuauuugacuuucuacaaaaacuaaaggauuucagaaauuacuacucgcacuauagacauucagagucauccgaacuacccuuauuugauggaaauaugcuucaacgucuuuacaacguuuucgaugucucaguacaaagaguaaaaagggaccaugaacauaaugacaaaguggauccccauagacacuuuaaucaucucguaagaaaaggcaagaaagauagguauggccauaacgacaacccuagcuucaaacaucacuuuguagauucagaaggaaugguaacagaagcaggacucuuauucuuuguaaguuuauuucuugagaaaagggaugcuaucuggaugcaaaagaaaauacggggauucaaaggagguacggaaacguaucaacaaaugacaaaugaaguauucugccgaagccggauuucauuaccaaaacuaaaacucgaaucucugagaacagaugacuggauguugcuagacauguuaaaugagcuaguaagguguccaaaacccuuauaugauagauuacgcgaagaugauagagcaugcuuucgcguaccagucgacauucuaccagaugaagaugacacugauggcgguggagaagacccuuuuaaaaacacauuaguaagacaucaagacagauuuccuuauuuugcauugagauacuucgauuuaaagaaagucuucacaaguuugcgauuccauaucgaucucgguacauaucacuucgcuauauauaagaaaaugauaggggaacaaccagaggauagacacuuaacaagaaaccuauaugguuucggacgaauacaagacuucgcggaagaacauaggccagaagaauggaaaagauugguaagagaucuugacuacuuugaaacaggagauaaaccuuauauaagccaaacaacaccacacuaccacauagaaaaaggaaaaauaggacuaagauucgucccagaaggacaacauuuauggccaaguccagaagucgguacuaccagaacuggucggagcaaauacgcccaagauaaaagauuaacagcugaggcuuuucuauccguacacgaauuaaugccaaugauguuuuauuacuuucuccuaagagaaaaauauucagaagaaguuagcgcagaaaaaguucaaggaaggauaaaaagagucauagaagaugucuacgcaaucuaugaugcauuugcaagagaugaaauuaauacacuuaaagaacuagacgcauguuuagcagauaaaggaauaagacgaggacaucuuccaaaacagaugaucggaauuuuaagucaagaaagaaaagauauggaagagaaaguaaggaagaaacuacaagaaaugauagcugacacagaccauaggcucgacauguuagauaggcaaaccgacagaaaaauaagaauaggaaggaaaaacgccggauuaccuaaaagcggaguaauagcagacugguuaguaagagacaugaugcgguuucaaccaguagccaaagauacaucaggaaaacccuuaaacaauaguaaagcaaauucaacugaauauagaaugcuacaacgugcacuagcacuauuuggcggagagaaagaacgacuuacuccauauuucagacagaugaaccuuacagggggaaacaacccucacccauucuugcaugaaacaaggugggaaucacacacaaacaucuuaaguuucuauagaagcuacuuacgcgcuagaaaagcguuucucgaacgaauaggaagaagcgaucgaguugaaaacugcccguuucuacuucugaaagagccaaaaacggaccgacaaacccuagucgcuggauggaaaggugaauuucauuuaccaaggggaauauucacagaagcaguuagagacugccucauagaaaugggcuacgaugaagucgggaguuauagagaaguaggguuuauggcaaaagcgguaccacuauacuuugaacgagcaugugaagaucguguucaacccuucuaugacucaccuuucaauguugguaacagucuaaaacccaagaaaggacgguuuuuaagcaaagaagauagagcagaagaaugggaaagaggaaaagaaagauuucgagaucuagaagcauggagucacucagccgcaagaagaauuaaagaugcuuuugcagguaucgaguaugcuaguccuggaaacaaaaagaaaaucgagcaauuauuaagggaccucaguuuaugggaagccuuugaaaguaaacuuaaagucagagcagacaaaauaaacuuagcaaaauuaaagaaagaaauauuagaagcucaagaacacccuuaccaugacuucaaaucuuggcaaaaauuugaaagagaacuacgcuuggucaaaaaccaagauaucaucacauggaugaugugcagagaucuaauggaagaaaauaaaguagaaggauuagauacaggaacucucuauuuaaaagauauacgaccgaauguccaggagcaagguagcuuaaauguacuaaaccgcgugaaaccuaugagauugccgguugugguuuaucgugcugacuccagaggucacguucacaaagaagaagcaccacuugcuaccguauacauagaggaaagagauacaaaacuacugaaacaaggaaacuuuaagagcuuuguaaaagacaggagacucaacggguuauuuucauuuguagacacaggagguuuagcaauggaacaauauccuauuagcaaauuaagaguagaguacgaguuagcuaaauaccaaacagcuagaguaugcguauuugaauuaacucuaagacuagaagaaagucuauuaucaagauacccacaucuuccagacgaaaguuucagagaaauguuagaaucauggagcgacccauuacuagcaaaauggcccgaacuacauggaaaagugagauuacuaaucgcaguaagaaaugcguucucucauaaucaauauccaauguacgaugaagccguguuuucaucuauacggaaauacgauccaucuucaccagacgcaauagaagaaagaaugggauuaaacauagcacaucgacucagcgaggaaguaaaacaagcaaaagaaacaguagaacgaauaauacaggcuuag

SEQ ID NO: 11569 - RNA, 3375 nt, Artificial Sequence
  Cas13b variant__Prevotella aurantiaca__WP_025000926.1__Cas13b
auggaagacgauaagaaaacaacagggucaauaaguuacgagcuaaaagacaaacauuucugggcagccuuucuaaaccuagcccgacauaauguauacauaacaaucaaccauaucaauaaauuacuagaaauacgagaaauagacaaugacgaaaaaguacucgauauaaaaacacuguggcaaaaaggaaacaaagauuuaaaccaaaaagcuagauuaagagaauuaaugacgaaacacuucccuuuucuagaaacagcaauuuauaccaaaaacaaagaagacaagaaagaagucaaacaagaaaaacaagcagaagcacaaucauuagaaucccuaaaagauugccuauuuuuauuucuagauaaacuucaagaagcaagaaauuauuacagccacuacaaauauuccgaguucucuaaagaaccagaguucgaagaagggcugcuagagaaaauguacaauauauucgguaacaacauacaguuaguuauuaacgauuaccaacacaacaaagauauaaauccagacgaagacuuuaaacaccuagaucgaaaaggccaauucaaauacuccuuugccgacaacgaaggaaacauaacagaaucgggacuacuauuuuucguaucauuguuccuagagaagaaagacgcaaucuggaugcaacagaaacucaauggauucaaagacaaucuagaaaacaaaaagaaaaugacacacgaaguauucuguagauccagaauauuaaugccaaaacuaagauuagaaucaacacaaacacaagacuggauauuacuagacaugcugaacgaauugauacgaugcccgaaaucauuauaugagagauuacaaggagacgacagagagaaauuuaaaguaccauucgauccugcagacgaagacuauaaugcagaacaagaacccuuuaaaaauacuuuaauaagacaucaagacagauucccuuauuucguacuacgcuacuucgauuacaacgaaauauucaaaaaccuacguuuccaaauugaccuuggaacguaucauuuuagcaucuacaagaaauuaauaggaggacaaaaagaagauagacaucucacacacaaacuauacgguuucgaaagaauacaagaauuugcaaaacaaaacagaccagacgaauggaaagccaucguaaaagaucuagauacauacgaaacaucaaauaaaagauauaucucggaaacuacaccacacuaucacuuagagaaccagaaaauuggcauccguuucagaaauggaaacaaagagauauggcccucuuuaaaaaccaaugaugaaaacaaugagaaaaguaaauacaaauuagauaaacaauaccaggcugaggccuuccuaucaguacaugaacugcuccccaugauguucuacuaccuacuucugaagaaagaaaaaccaaauaacgaugaaauuaaugccucaauaguugaagguuucauaaaacgagaaauacguaacauauuuaaacuguacgacgcauuugcaaacggagaaauaaacaauauagacgaucucgaaaaauauugugccgacaaagguauacccaaacgacaccuacccaaacaaaugguagcaauacuauacgacgaacacaaagauaugguaaaagaagcaaaaagaaaacaaaaagaaauggugaaagauacgaagaaacuccuagcaacccuagaaaaacaaacacaaaaagaaaaagaagacgauggaagaaacguaaaacuccucaaaagcggagaaauagcacgauggcuaguuaaugauaugaugcgauuccaacccguccagaaagacaaugaaggaaaaccacugaacaacaguaaagcaaacucaaccgaauaucaaauguugcaacgaagccuagcacuauacaacaacgaagaaaaaccaacccgcuauuuuagacaagucaaucuaaucgaaucaaacaauccacauccuuuccucaaauggacaaaaugggaagaauguaauaauauacuaacauucuauuacucauaucuaaccaagaaaaucgaguuccugaacaaacuuaaaccugaagauuggaagaaaaaccaauacuucuugaaacugaaagaaccaaaaaccaacagagaaacuuuagugcaaggauggaaaaacggcuucaauuuacccaggggaauauuuaccgaaccaauaagagaaugguuuaaaagacaucaaaauaauuccaaagaauacgaaaaaguagaagcacuagacagaguaggauuaguaaccaaaguaaucccauuguuuuucaaagaagaguacuucaaagauaaagaggaaaauuucaaagaagauacucaaaaagaaauaaacgauuguguacaacccuucuauaacuuuccauauaauguuggcaauauacauaaaccuaaagaaaaagacuuuuuacaccgcgaagaacgaauagaacuuugggacaaaaagaaagauaaauuuaaaggauacaaagagaaaauaaaaagcaagaaacuaaccgaaaaagacaaagaagaguuccgcucuuacuuagaauuucaaagcuggaacaaauucgaacgagaacuaaggcuaguaagaaaucaagacauuguaaccuggcuucucugcaaagagcuaauagacaaacuaaaaaucgaugaacucaauauagaagaacucaagaaauuaagacugaacaauauagacaccgacacagcuaagaaagagaaaaacaauauauuaaauagagucaugcccauggaacuuccaguuaccguuuaugaaaucgacgacagccacaaaaucguuaaagauaaaccacuucacacaaucuauauaaaagaggcagaaacaaaacugcuaaaacaaggaaacuuuaaagcccuuguaaaagauagaagacuaaacggacuauucucauucguaaaaaccaacucagaagccgaauccaaaagaaaccccauaucuaaauugagagucgaauacgaacuaggugaauaucaggaggcacgcauagaaauaauccaagauaugcuagcauuagaagaaaaacuaauaaauaaauauaaagacuuacccacaaacaaauuuagcgaaauguuaaauucaugguuagaagggaaagacgaagcagacaaagcaagguuccagaacgacguugacuuuuuaauagcaguacgaaaugcauucucccauaaccaauaccccaugcauaauaaaauugaauuugcaaauauaaaaccguucucuuuauauacugcaaacaacucagaggaaaaaggacuagggauugcaaaucaguuaaaagauaaaacaaaagaaacaacugauaaaaucaagaaaauagaaaaaccaaucgaaacaaaagaauaa

SEQ ID NO: 11570 - RNA, 3384 nt, Artificial Sequence
  Cas13b variant__Prevotella buccae__EFU31981.1__Cas13b
augcaaaaacaagacaaauuauucguagacagaaaaaaaaacgcgauuuucgcauuuccaaaauacauaaccauaauggaaaauaaagaaaaaccagaacccauuuacuacgaauuaaccgauaaacacuucugggcugccuuucuaaaucuagccagacacaauguuuacaccaccauaaaccacauaaacagaagauuagaaauagcagaauuaaaagaugacgguuacaugaugggcauaaaagguucauggaaugagcaagcuaaaaaauuggacaaaaaaguacgucuaagagaucuaauaaugaaacacuuuccauuucuggaagcagcagcauacgaaaugacuaauucuaaaagccccaacaacaaagaacaaagagaaaaggagcaaagcgaagcccuuucauuaaacaacuuaaaaaauguccuauucaucuuuuuagaaaaacuacaaguauuacgaaacuacuacagucacuacaaauauagugaagaaucacccaaaccaauuuucgaaacaucguuacucaaaaauauguauaaagucuucgaugccaacguuagacuuguuaaacgagacuauaugcaccacgaaaauauugauaugcaaagagacuuuacccaucucaaucgcaaaaaacaaguaggaagaaccaaaaacaucauugacucaccaaauuuccauuaccacuuugcugacaaagaaggaaauaugacaauagcaggacuacuuuucuucguaucucuauuucuagauaaaaaagacgcgaucuggaugcaaaaaaaauuaaaaggauuuaaagauggacgaaaccuaagagaacaaaugacaaacgagguguucugcagaucacgaauuagucuaccuaagcugaaauuagaaaauguacaaaccaaagacuggaugcaauuagauauguuaaacgaguuaguuagauguccaaaaagucuauaugaaagauuacgugaaaaagaucgugaaucauuuaaaguaccuuucgauaucuucuccgaugauuauaacgcagaagaagaacccuucaaaaauacucucguacgacaucaagacagauuucccuacuucguacucagauacuucgauuuaaaugaaauuuucgaacaacugagauuucaaauagaccucggaacauaucauuucucuaucuacaacaagagaauaggagacgaagaugaagugagacaucugacucaucauuuauacggcuucgcacgcauucaagauuucgcaccucaaaaucaaccagaagaauggcggaaacuaguaaaggauuuagaucauuucgaaacgucucaagaaccuuauauaucaaaaaccgcaccacacuaccaucuugaaaacgaaaaaauaggaauaaaauucugcagcgcccacaauaacuuauuucccuccuuacagacggacaagacuuguaacgguagaucuaaauucaauuuagguacgcaguuuaccgcagaagcauuuuuaucaguccaugaacuccuaccaaugauguuuuauuaucuccuacuuacaaaagauuacucacgcaaagaaagugcagacaaaguagaagggaucauaagaaaagaaauaagcaacaucuacgcaauauacgacgcauuugccaacaacgaaauaaacuccaucgcagaccuaacaagaagacuucaaaacaccaauauacuccaaggacaccuuccaaaacaaaugauauccauauuaaaaggacgccaaaaagacauggguaaagaagcugaacgaaaaauaggagaaaugauugacgauacacaaagaagacuagaccuuuuauguaaacaaacaaaccagaaaauacgcauaggaaaacggaacgcaggacuucuaaaaagcggcaaaauagcugacugguuagugaacgacaugaugagauuccaacccguacaaaaagaccaaaauaauauacccauuaauaauagcaaagcaaauagcacugaguaccguaugcuacaaagagcacuugcccuauucggaucagaaaacuuucgacuuaaagcauacuuuaaccaaaugaacuuaguuggaaacgacaacccacacccauuccucgccgaaacccaaugggaacaccaaacuaacauauugucauuuuaccguaauuacuuagaagcucgcaaaaaauaccucaaaggacucaaaccacaaaauuggaagcaauaccaacacuuccucauacuaaaaguacaaaaaacgaaccgaaacacacuggucaccggcuggaaaaacucauucaaccuaccaagagguaucuucacacaacccauaagagaaugguuugaaaaacacaacaacuccaaaagaauauaugaucaaauccucucuuucgauagagucggcuuuguagcaaaggccauuccccuguauuucgcagaagaauacaaagauaacgugcaaccauucuacgacuaucccuuuaacauaggcaauagauuaaaaccaaaaaaaagacaguuccuagauaaaaaagaaagaguagaauuauggcaaaaaaacaaagaacuauucaaaaauuaccccuccgaaaagaagaaaacagaccuagccuaccuagauuuucuaucuuggaaaaaauuugaacgugaauuaagacuaauaaaaaaccaagacaucguaacauggcuaauguuuaaagaauuauucaauauggcuacaguagaaggucuaaaaauaggagaaauccaucuaagagacauagacacuaacacggcaaacgaggaaucaaacaacauccuuaauagaauaaugccuaugaaacuaccaguaaaaacauaugagacagacaacaaaggaaacauacuuaaagaacgcccccuugcaacauuuuacauugaagaaacagaaacaaaaguacucaaacaagguaacuuuaaagcacuaguaaaggacagacguuuaaacggacucuucaguuucgccgaaacaacagauuuaaaccuugaagaacacccaauaagcaaacuuucaguugacuuagaacuaauaaaauaccaaacuaccagaaucaguauuuucgaaaugacacuaggccuagagaaaaaacuaauagacaaauacucaacacuuccaacagacaguuucagaaauauguuagaacgcuggcuacaaugcaaagcuaacagaccugaauuaaaaaacuauguaaauuccuuaauagcagugcgaaacgccuuuucccauaaccaauacccaauguacgacgcaacucuauuugcugaaguuaaaaaguuuacauuauucccuucaguagauacgaaaaaaauagaacucaauauagcuccacaacuccuagaaauaguaggcaaagcaaucaaagaaauagaaaaaucagaaaacaaaaauuaa

SEQ ID NO: 11571 - RNA, 3384 nt, Artificial Sequence
  Cas13b variant__Prevotella buccae__WP_004343581.1__Cas13b
augcagaaacaagacaaacucuuuguugaccgcaaaaaaaaugccauauucgccuucccaaaauacauaaccauaauggaaaaucaagaaaaaccagaacccauauacuaugaacuaacagauaagcacuuuugggcagccuucuuaaacuuagcaagacauaacguauacacaacaauuaaccauauaaaucgcagauuagaaauugcugaauuaaaagacgacggauacaugauggacauuaaaggaagcuggaacgaacaagcuaaaaaauuagauaaaaaaguccgucucagagauuuaauuaugaaacacuucccguuccucgaagccgcagcuuacgaaauaacaaauucuaaaucuccaaauaacaaagaacagcgcgaaaaagaacaauccgaagcauuaagccugaacaaucuuaaaaacguucucuucauauuccucgagaaauugcaaguucucaggaacuacuauucccauuacaaauacucggaagaaucaccuaaacccauauucgaaacaucauuacugaaaaacauguauaaaguauuugaugcaaauguuagacuuguaaaacgagauuauaugcaucacgaaaauaucgauaugcaaagagacuucacacaccuaaaccgaaaaaaacaagucggaagaaccaaaaacauaauagacuccccaaauuuucauuaccacuucgcagauaaagagggaaauaugacaauugcaggacuauuauucuucgucucuuuauuccucgacaaaaaagacgcuauauggaugcagaagaaacuaaaaggcuucaaagacggaagaaacuuaagagaacaaaugacuaaugaaguauucugccgaucaagaaucucuuuaccaaaacuaaaacuggaaaauguccaaacaaaagauuggaugcaacucgauaugcuuaaugaguuagugagaugcccuaaaagucuauaugagcgccuuagagagaaagaccgcgaaucauucaaaguaccuuucgauaucuucuccgacgacuacgaugcugaagaagaaccuuucaaaaacacccucgugagacaccaagaccgguucccauacuuugucuuaagauauuuugaccugaacgaaauuuucgaacaacucagauuucaaauugaccuaggaacauaucauuuuucaauauacaacaaaagaaucggagaugaagacgaaguucgacacuuaacacaccauuuauauggauuugcacgaauccaagacuuugcccaacaaaaccaaccagaagucuggcggaaguuaguaaaagaucuagauuacuucgaagcaucacaagaaccauacaucccaaaaaccgccccacacuaccaccuagaaaacgaaaagauugggaucaaauucugcucaacccacaacaaccucuucccuucccuaaagaccgaaaaaacuugcaacggaagaucaaaauuuaauuuaggaacacaauuuacagccgaagcuuuucucagcguacacgagcuacugccuaugauguucuacuaccuccuucuaacuaaagauuacagcagaaaagaauccgcagacaaagucgaagguauaauaagaaaagaaaucucaaacaucuacgccauauaugaugccuuugcaaauggagaaauaaacucgauagcugaccuaacgugcagauuacaaaaaacaaauauauuacaaggccaucuccccaaacagaugauuucaauauuagaaggcagacaaaaggacauggaaaaagaggcagaaagaaaaauaggagaaaugauagaugacacacaaagaagacuagaccuguuaugcaaacaaacuaaucaaaaaauccguauaggaaaacggaacgcaggucuucucaaaaguggcaaaaucgccgacugguuaguaaacgauaugaugagauuucaaccaguucaaaaagaccagaauaauaucccuauaaacaauaguaaagcgaauuccacagaguacagaaugcuacagagggcuuuagcacuuuuuggaucagaaaacuucagacuaaaagcauacuucaaccaaaugaaccuaguggguaacgauaacccacacccauuccuagcugagacacaaugggaacaccaaacaaacauacuaaguuuuuacagaaacuaccuagaagccagaaagaaauacuuaaaaggacucaaaccacaaaacuggaaacaguaucagcauuuccucauacucaaaguucaaaaaacaaacagaaacacacucgugacuggauggaaaaacucauucaacuuaccacgcgggaucuuuacacaaccuauaagggagugguucgaaaaacauaacaacagcaaaagaauauaugaccaaauacuaucuuuugaccgcguaggauucguagcaaaagcuaucccacuuuacuuugcugaagaauacaaagauaauguacaaccauucuacgacuauccauuuaauauaggaaacaaacuaaaaccacagaaaggacaauuccuugacaaaaaagagagggucgaauuauggcaaaaaaauaaagaauuauucaagaacuauccaagcgagaaaaaaaaaacagaccuagcauaucuagauuucuuaucguggaaaaaauucgaacgagaacuccgcuuaauaaaaaaccaagauauagugacauggcucauguucaaagaacuauuuaauauggcaaccguagagggauuaaaaaucggagaaauucaccugagagauauugauacuaacacagcaaacgaagaaagcaacaauauacucaacagaaucaugccuaugaaacugccaguaaaaacauacgagacagacaauaaaggaaauauauuaaaagaaagaccguuagcaacauucuacauagaagaaacagaaacaaaagugcucaagcaaggaaacuucaaaguauuagccaaagacaggagacuuaacggauuacuaagcuucgcagaaacaacagauauagacuuagaaaaaaacccaaucacaaaacuguccgucgaccaugaacugauuaaauaucaaacuaccagaauauccauauuugaaaugacccuaggacuagaaaaaaaauuaauaaauaaauaucccacccuaccaacugacucguuucgaaacaugcucgaaagaugguuacaauguaaagcaaacagaccggaauuaaagaacuauguaaauucucuaauagcaguaagaaacgcauucagucacaaccaauacccaauguacgaugcaacauuauucgcugaaguaaaaaaauuuacccuuuucccaucugucgauacuaaaaagauagaacuuaacauagcaccacaacuacuagaaauaguuggaaaagccauaaaagaaauagaaaaaagcgaaaacaaaaacuaa

SEQ ID NO: 11572 - RNA, 3402 nt, Artificial Sequence
  Cas13b variant__Prevotella falsenii__WP_036884929.1__Cas13b
augaaaaacgacaacaacuccacuaagucuacggacuauacacucggagacaaacauuucugggcugcauuccuaaacuuggcaagacacaauguuuauaucacaguaaaucauauaaacaaaguacuugaauuaaaaaauaaaaaagaucaagaaauaauaaucgacaaugaccaggauauucuagcaauaaaaacacuauggggcaaaguugacacugacauaaacaaaaaagacagauuacgcgaacuaauuaugaaacauuucccauuucuggaggcugcaacauaccaacagagcagcacaaacaauacaaaacagaaagaggaagaacaagcaaaagcccaaucauucgaaagucuuaaagauugccucuuccuauuucucgaaaaauuaagagaagccagaaauuacuauucccacuacaaacauucaaaaucacuagaagaaccaaagcuagaagaaaaacuauuagaaaacauguacaauauauucgacacuaacguucaacuaguuauuaaagauuacgagcauaauaaagacauaaauccagaagaagacuuuaagcaccuuggaagagcggaaggagaauucaacuacuacuuuaccagaaacaagaaaggaaauauuacugaaucagggcuucuguuuuuuguaucauuauucuuagaaaaaaaagacgccaucugggcacaaacaaagauaaaaggauucaaggauaaccgugaaaauaagcagaaaaugacacaugaagucuucuguagaucucgaaugcuacuaccgaaacuacgacuagaaucaacacaaacccaagacuggauucuccucgacauguuaaacgaguugauacgaugcccuaaaagucuauacaaacgauuacaaggagaaaaacgagaaaaauuuagaguaccauuugauccagcggaugaagauuacgaugcagaacaagaaccauuuaaaaacacacuaguaagacaucaagaccgauuuccuuauuucgcacuaagauacuuugacuauaacgaaauauuuacgaaccuacgauuccaaaucgacuuaggcacauaccauuucucaauauauaaaaagcaaauaggggacaagaaagaagaucgucaccuaacacacaaacuuuacggauuugaaaggauacaagaauuugccaaagagaacagaccagaugaauggaaagcucuuguaaaagaucucgacacuuucgaagaaagcaacgagcccuacauuucugagacaacaccacacuaccaccuagaaaaucaaaaaauugguauaagaaauaaaaauaaaaaaaaaaaaaaaacaauauggccaagccuagaaacaaaaacaacaguaaaugaaagaucaaaauacaaccugggaaaaucauuuaaagcagaagcauuccucagcguacacgaacuccuuccgaugauguuuuacuauuuacugcuaaauaaagaagaaccaaacaacggcaaaauaaacgccucaaaaguagaagguauaauagaaaaaaaaauacgagacauauacaagcuauacggggcuuucgcaaaugaagagaucaacaaugaagaagaauuaaaagaauacugugagggaaaagacauagcaauccgacaccuacccaaacaaaugauagcaauuuuaaaaaacgaauacaaagauauggccaaaaaagcugaagauaaacaaaaaaaaaugauuaaggacacaaaaaaaagacuagcagcauuggacaaacaaguaaaaggagaaguggaagauggaggacgcaacauaaaaccucuuaaaucaggcagaauagcuucauggcuuguaaacgauaugaugagauuccaaccuguacaaagagaucgagacggcuacccgcuaaacaauagcaaagccaacaguacagaauaccaacuacuccaaagaacacuagcauuauucggaucagaaagagaaagacuagcgccuuauuucagacaaaugaacuuaauuggaaaggacaauccccauccauuucuaaaagauacuaaauggaaagaacauaacaauauacuuuccuuuuacagaaguuaucuagaagcuaaaaaaaacuuuuuaggaucgcuaaaacccgaagacuggaaaaaaaaucaguauuucuuaaaauuaaaagaaccuaaaacaaaucgagaaaccuuaguacaaggcuggaaaaacggauucaaccuaccaagaggaauuuucacagaacccauucgcgaaugguucauccgacaccaaaacgagucagaagaauauaaaaaaguaaaagacuucgaccgaauugguuuaguagcaaaaguaauaccguuauucuuuaaagaagauuaccaaaaggaaaucgaagauuacguccagcccuucuauggauauccguuuaacguaggaaacauacauaacucacaagaaggaacauuccuaaauaaaaaagaacgagaagaacuauggaaaggaaauaaaaccaaauucaaagacuauaaaaccaaagaaaaaaacaaagaaaaaacaaauaaagauaaauuuaaaaagaaaacggacgaagaaaaagaagaauuccgaucauaccuagacuuucaaucauggaaaaaauucgaaagagaacuacgacuaguaagaaaucaagacauagugacauggcuacugugcauggaauuaauugauaaauuaaaaauagacgaguuaaacaucgaggaauuacaaaaauuaagacucaaagacauagauaccgauacagcaaaaaaagaaaaaaauaacauauuaaauagaauaaugccuauggaauuaccuguaaccguauacgaaaccgacgauagcaacaacauaauaaaagacaaaccccuacauacgauuuauaucaaggaagcagaaacaaaacugcugaagcaaggcaauuuuaaagcucuuguaaaagauagacgacuuaauggauuauuuuccuucguggaaaccucaucugaagcagaauuaaaaucaaaaccaauaucaaaaagucucgucgaguacgaacuuggcgaauaccaaagagccagaguagagauaauaaaagacaugcuacgcuuagaagaaacacucauaggaaaugacgaaaaacuucccaccaacaaauucagacaaaugcuagauaaauggcuagaacauaaaaaagaaacggacgacacagaccuaaaaaacgauguaaaacuguuaaccgaaguccgcaaugcauucucccacaaucaauacccaaugcgagauagaaucgcguuugcgaauauaaaaccuuucaguuuaucaagugcuaacacgagcaaugaagaaggucuuggaauugcaaaaaaacuuaaagacaaaacaaaagaaacaaucgauagaaucaucgaaauagaagaacaaacugcaacaaaaagauaa

SEQ ID NO: 11573 - RNA, 3402 nt, Artificial Sequence
  Cas13b variant__Prevotella intermedia__BAU18623.1__Cas13b
auggaagacgauaaaaaaacgacugacucaaucucauacgaacuaaaagacaaacacuuuugggcugccuuccuaaauuuggcccgacauaacgucuacauuacaguaaaucauaucaacaaaguacucgaacuaaaaaacaagaaagaccaagacauaauuauagauaacgaccaagauauacucgcaaucaaaacacauugggaaaaaguaaacggugaccugaacaaaacggagcgauuacgagagcugaugacgaaacacuucccauuucuagaaacagcuauauauagcaaaaacaaagaagacaaagaagagguaaaacaggaaaaacaagcaaaagcacaaagcuuugacucuuuaaaacauugucucuuccuauuccuagaaaaauuacaggaaacuagaaauuacuacucacacuacaaauacagcgaaagcacaaaagaaccaaugcuagaaaaagaauuauuaaaaaaaauguauaacaucuuugacgacaacauacaacugguuauaaaggauuaccaacacaauaaagacaucaacccagacgaagacuucaaacacuuagaucgcacagaagaagacuucaauuauuacuuuaccagaaauaaaaaagguaacauaacagaaagcggucuccuuuucuucguaucauuauuccuagaaaaaaaagaugcaaucuggaugcaacaaaaacuucgaggauuuaaagauaacagggaaucaaagaaaaagaugacccacgaaguauucugcagaucuagaaugcuacuucccaaauuacgacuagaguccacccaaacacaagacuggauacuacuugauaugcugaacgaguugaucagaugcccuaaaucacuauaugaaagacuucaaggagaagauagagaaaaauuuaaagucccauuugauccagcagaugaggacuacgacgcggaacaagaaccguucaaaaauacacucgucagacaucaagacagauuuccuuauuuugcacucagauauuucgacuacaacgaaauauuuaccaaucucagguuucaaauagaucuaggaacuuuccauuuuucaauauacaaaaagcuaaucggagggcaaaaagaagacaggcaccucacucauaaacuuuacggguuugaaagaauucaagaauuugcaaaacagaauagaccagacgaauggaaagcaauaguaaaagaucuagacacauacgaaacaagcaacgaaagauauauaucagaaaccacaccucacuaccacuuggaaaaccaaaaaauaggaauacgauucaggaacgacaacgacgaaauauggccaagccucaaaacaaacggcgaaaacaacgaaaaaucuaaguacaaauuagauaaacaauaccaagccgaagcauuccuauccguacacgaauugcucccaaugauguuuuauuaccugcuacuaaaaaaagaagaaccaaauaaugacaaaaaaaacgcauccauaguggaagguuucauaaaacgcgaaauucgagacauguacaaauuauacgacgcauucgcuaauggagaaauaaauaacauagaugaccucgaaaaguacugugaagacaaaggcauuccuaaacgacaccuaccaaaacaaaugguugcaauacuauacgacgaacauaaagauaugguaaaagaagcaaaaagaaaacaaagaaaaauggucaaagauacugaaaaacuauuagcugcacuagaaaaacaaacccaagagaaaaccgaagacggaggucgaaauaucagacuccuaaaaucgggagaaauagcaagaugguuaguuaacgauaugaugagauuccaaccgguacaaaaagauaacgaaggaaauccacuuaacaacuccaaagcaaauuccacagaauaccaaaugcuacaaagaucccuagcacuauacaacaaagaagaaaaaccaacucgcuacuuccgccaaguuaaucucaucaacucaucaaacccccacccauuccuaaaauggacaaaaugggaagaauguaacaauauuuuaucguucuauagaagcuaccucacgaaaaaaauugaauuucucaauaaauugaaaccagaagacugggaaaaaaaccaguauuuuuuaaaacuaaaagagcccaaaaccaaccgagaaacacuaguccaaggauggaaaaauggauuuaacuugcccaggggaaucuucacugaaccaauacgagaaugguuuaaacgucaucaaaacgacagcaaagaguaugaaaaagucgaggcccuagacagagugggacuaguaacaaaaguuauaccacuauuuuucaaaaaagaagauucaaaagauaaagaagaagacuuaaaaaaagacgcacaaaaagaaauuaauaacuguguccaacccuucuacaguuucccguauaauguaggaaauauacauaaaccggaugaaaaagauuuucuccacagggaagagcgaauagaguuaugggacaaaaaaaaagauaaauucaagggauacaaagcaaaaguuaaaucuaaaaaguuaacagauaaagaaaaagaagaauacagaucauaucuugaauuccaaucguggaacaaauuugaacgggaauuaagacuaguaagaaaccaggauaucguaacuugguuauuaugcacagaacuaauagacaagcuuaaaguggaaggacuuaacgucgaagaguuaaaaaaauuaagacucaaagacauagacaccgauacagcaaaacaagaaaaaaacaacauucuuaaccgcguuaugcccaugcaacuaccagucacaguauaugaaauagacgauucacauaacauuguaaaagaccgaccauuacacacaguauacaucgaagaaacaaaaacaaaacuacuaaaacaaggaaacuucaaagcgcuaguuaaagaucgccgucuaaaugguuuauucuccuuugucgauacaagcucagaagccgaacuaaaaagcaauccaauaucaaaaucauuagucgaguacgaacuaggagaauaucaaaacgcaagaauagaaacaauaaaagacaugcuacuucuagaagagacauuaaucgaaaaguacaaaaaucuaccaaccgacaacuucuccgauaugcugaauggaugguuagagggaaaagaugaggcagacaaagcacgauuccaaaacgacguaaaacuccuugucgccguccgaaacgcguucagccacaaccaauauccaaugcgaaaccgaaucgcauucgcgaacaucaacccguuuuccuuaucuucugcugauacaucagaagagaagaaauuagauauugcuaaucaacuaaaagacaaaacccauaaaauuauaaaaagaaucauagaaaucgaaaaaccaauugaaacaaaagaauaa

SEQ ID NO: 11574 - RNA, 3405 nt, Artificial Sequence
  Cas13b variant__Prevotella intermedia__AFJ07523.1__Cas13b
augaaaauggaagaugacaaaaaaacgaaagaaagcacuaauaugcucgacaauaaacauuuuugggcagcauucuuaaaccuagcaagacauaauguauacauaacaguaaaccauauaaacaaagucuuagaacuaaaaaacaagaaagaucaagacaucauaauagacaacgaucaagacauauuagcaaucaaaacucacugggaaaaaguuaauggagaucuaaauaaaacagaaagauuaagagaacuaaugacaaaacauuuccccuuccuagaaacggcaauauacacaaaaaacaaagaagacaaagaagaaguaaaacaagaaaaacaagccaaagcacaaaguuucgacucacuuaaacauugccuuuuucuauucuuagaaaaacuacaggaagcuagaaacuacuacucgcacuacaaauacagugaaagcacaaaagaaccaaugcuagaaaaagaacuauuaaaaaagauguauaacauauuugacgacaacauacaacucguaauaaaagacuaccagcauaacaaagacauaaauccagacgaagauuucaagcacuuggauagaacagaagaggaguucaacuacuauuucacaacaaauaaaaaaggaaacauuacagcaucaggucuccucuuuuuugugucuuuguuccuggaaaaaaaagacgccauauggaugcaacaaaaacuaagaggauuuaaagauaaccgagaaaguaaaaaaaaaaugacucacgaaguauuuuguagaucaagaauguuauuaccuaaacugagacuagaaagcacacagacucaagacuggauacuauuagacauguuaaacgaauuaauaagauguccaaaaucucuuuacgaaaggcuacaaggagaauaucgaaaaaaauuuaacguaccuuuugacuccgcagacgaagauuacgaugcagaacaagagccauucaaaaacacucuaguuagacaccaggaccgcuucccuuauuuugcccugagauauuuugacuacaacgaaauauucacaaaucugcgauuccaaauagaccuaggcaccuaucauuucagcaucuacaaaaaauuaauaggaggacaaaaagaagauagacaucuaacccauaaguuauacgguuucgaaagaauacaagaauucgcuaaacaaaacagaacggaugaauggaaagcaaucguaaaagacuucgauacauaugaaacauccgaagaaccauauauaagcgaaaccgccccacacuaccaccuggaaaaccaaaagauaggaauacgauuccgaaacgacaacgacgaaauauggccaagccuaaaaacaaacggcgagaacaaugaaaaaagaaaauacaaacucgacaaacaauaccaagcagaagcauuccuauccguacacgaacuccuaccaaugauguucuacuauuuacuucugaaaaaagaagaaccaaauaaugacaaaaagaaugcaucaauugucgaaggguucaucaaaagagaaauccgagauauauauaaacuuuaugaugcauuugcaaacggagaaauuaacaacauagacgaccuggaaaaauacugcgaagacaaggggauuccaaaacgucacuuaccaaaacaaaugguagcuauacuauacgacgaacacaaagauauggcagaggaagccaaacgaaaacaaaaagaaaugguaaaagacacgaaaaaacuauuagcaacacuagaaaaacaaacacaaggugaaauagaagacggaggacgcaacaucagacuauuaaagagcggagagauagcaagauggcuaguaaaugauaugaugcgauuccaaccaguacaaaaagacaaugaaggcaaccccuuaaacaacucuaaagcuaacucaacagaauaccaaaugcuacaacgcucacuagcccuauauaauaaagaggaaaaacccacucguuauuucagacaaguaaaccuuaucaauaguucuaauccucauccuuuuuuaaaauggacaaaaugggaagaaugcaacaauauauuaagcuucuaccgaucauacuuaacgaagaagauugaauuccuaaauaaauuaaaaccugaggacugggagaagaaccaauacuuccuuaaacugaaagaaccaaaaaccaauagagaaacuuuaguacagggauggaaaaacggcuucaacuuaccuagaggaauauucaccgaacccauaagagaaugguuuaaacgacaucaaaacgacucugaagaauacgagaaaguggaaacauuagacagaguaggccuuguaaccaaaguuauaccucuauucuucaaaaaagaagacucuaaagauaaagaggaauaucuuaaaaaagaugcacagaaagaaaucaacaacuguguacaaccuuuuuacggauuuccauacaauguagguaauauacauaagcccgaugagaaagacuuucuuccaucagaagaaagaaaaaaacuguggggagacaaaaaguacaaauuuaaaggauauaaagcuaaagucaaaucuaagaaauuaacugauaaagaaaaagaagaauaccgcucauauuuagaauuccaaucauggaacaaauucgaacgugaacuucgauuaguaagaaaucaagacaucguaacguggcuacuaugcacagaauuaauagauaagcuaaaaguagagggcuuaaacguugaagaauugaaaaaacuaagacucaaagacauugacacagacacagccaaacaagaaaaaaacaacauacugaacaggguaaugccaaugcaacuacccguuacagucuaugaaauugacgauucccacaacaucgucaaagacagaccccuacacacaguuuacauugaagagacaaaaacaaaacuacuaaaacaaggcaauuucaaagcauuaguuaaagauaggagacuuaacggacuauuuucauuuguugauaccagcuccgaaacagaacuaaagucuaacccgauaagcaaaucacuaguagaauacgaacugggugaauaccaaaaugcuaggauugaaacaauuaaagauaugcuauuauuagaagaaacacugauagaaaaauauaaaacacuaccaacugauaacuuuucagauauguuaaacggauggcuugaaggcaaagacgaagcagauaaggcacgcuuccaaaaugaugucaaacuauuaguugcaguaagaaacgcuuuuagccauaaccaauaucccaugagaaauagaauugcauuugcaaacauaaauccauuuagccuaagcucggcagauaccagcgaagaaaaaaaauuagauaucgcuaaccaacuaaaagacaagacucauaagauaauaaagagaauaauagaaauagaaaaaccaauagagacaaaagaauga

SEQ ID NO: 11575 - RNA, 3399 nt, Artificial Sequence
  Cas13b variant__Prevotella intermedia__WP_014708441.1__Cas13b
auggaagaugacaagaaaacaaaagaaucaacaaauaugcuggacaacaaacauuuuugggcggccuuucuaaaucuagcaagacacaacguuuacauuacaguaaaucauaucaauaaaguacuugaacugaaaaauaagaaagaccaagauauaauaauagacaacgaccaagacauccuagcaauaaaaacacauugggaaaaaguaaacggugaucuaaauaaaacagaaagacucagagaacuaaugaccaaacauuucccguucuuagaaacagcaauauacaccaaaaacaaagaagauaaggaagaaguuaaacaagaaaaacaagccaaagcccaaucauuugacucacuaaaacauugccuauuucuguuucuagaaaaacuacaagaagcacgaaauuacuacucucacuacaaguauagcgaaaguacaaaagaacccaugcuagaaaaagaacucuuaaagaaaauguauaacauuuuugaugauaacauacaacucguuauaaaagacuaccaacauaauaaagauauaaauccugacgaggauuucaaacaccuggauagaacagaagaagaauuuaauuauuacuucacaacaaauaagaaaggcaauauaacagccagcggacuucuauucuuugucagucuguuccuagaaaagaaagacgcaauauggaugcaacaaaaacuccgaggguuuaaagauaauagagaaucuaaaaagaaaaugacacacgaaguauucugucgaagccgaaugcuccuaccaaaauuacggcuagaauccacacaaacacaagauuggauccuacuagacaugcuaaaugaacuaauaagaugcccgaaaucucuauacgaaagacuacaaggagaguaccgaaagaaauuuaauguuccauuugacagugcugaugaggacuacgaugcggaacaagaacccuucaaaaauacauuaguacgacaucaagauagauuucccuacuuugcccuuagauauuuugacuauaaugaaaucuuuaccaaucuucgauuccaaauugacuuaggcacauaccacuuuaguauauacaagaaacuaauuggcggucaaaaagaagacagacaccuaacccacaaacuauacggauucgaaagaauacaagaauuugcuaaacagaaccggacagaugaauggaaagcaauagucaaagauuucgacaccuacgaaacaucagaagaaccauacauuagcgaaacggccccacacuaucaucucgaaaaccagaaaauaggaauaagauuuagaaacgacaaugacgaaauauggccaucccuaaaaacaaacggagagaacaacgaaaaacgaaaauacaaacucgacaaacaauaucaagcagaggccuuccuaucaguacaugaauuacuaccuaugauguucuauuaccuccuucuuaagaaagaagaaccaaacaacgauaagaaaaaugcaucuauagucgaaggauucauaaaaagagaaauuagagauauuuacaaauuauacgacgcauuugcgaacggugagauaaacaauauugaugaccuagaaaaauacugugaggacaaagguauaccaaaaagacacuuaccaaaacaaaugguagcuauacuauacgacgaacauaaagauauggcagaagaagcaaaaagaaaacaaaaagaaaugguaaaggauacaaagaaacuccuagcaacauuagaaaaacaaacucaaggggaaauagaagacggagggcgaaacauccgccuucuaaaaucuggagagauugcuagauggcuugucaaugacaugaugcgauuucaacccguacaaaaagauaacgaaggaaauccauuaaauaacucaaaggcuaacucaaccgaauaccaaaugcuccaaagaagucuagcauuauauaacaaagaagaaaagccgacacgauauuuccgacaagugaacuuaaucaacucgucaaauccacacccuuuucuaaaguggacaaaaugggaagaaugcaacaacauacucagcuuuuacagaucauacuuaacuaagaaaauagaguucuuaaacaaacuaaagcccgaagacugggagaaaaaucaauauuuccuaaaacuaaaagaaccaaaaacaaauagggaaacgcuuguacaaggauggaaaaaugguuucaauuuaccaagaggaauauuuaccgaacccauaagagaaugguuuaaaagacaccaaaacgacuccgaagaauaugaaaaaguagaaacucuagacagagucggacuuguaacaaaagucauaccauuauuuuucaagaaagaagacucaaaagacaaagaagaauaccuaaagaaagaugcacaaaaagaaauaaauaacugcguacaacccuucuacggguuuccauauaauguaggaaacauacauaaaccagacgaaaaagacuuucucccaucugaagaaagaaagaaacuauggggugacaagaaauacaaauucaaaggcuauaaagccaaaguaaaaaguaagaaacuaacggacaaagaaaaagaggaauacagaaguuaccuagaauuucaaucuuggaacaaauuugagcgagaauuaagauuagucagaaaucaagauaucgugaccugguuacuauguacagaacuaaucgauaaauuaaaaguagaaggcuuaaauguagaagaacuaaagaaacuuagacuuaaagacauagacaccgacacagcaaaacaagagaaaaacaacauucuaaacagagucaugccaaugcaacuaccagucacuguuuacgaaauagacgacagccacaacauaguaaaagaucgaccacuacauacaguuuacauugaagaaaccaaaacaaaacuacuaaaacaaggaaauuuuaaagcccuaguaaaagaccgacgauuaaacggucucuucagcuuuguagacacuuccagcgaaaccgaacuaaaaucaaacccaaucagcaaaucccucguagaauacgaacuaggagaauaccaaaaugcacgcauagaaacaauaaaagacaugcuacuauuagaagaaacuuuaaucgaaaaauacaaaacuuugccaacagacaacuuuagcgauaugcucaauggcugguuagaaggaaaagacgaagcagauaaagcaagauuucaaaacgacgugaaacuauuaguggcagugcguaacgccuuuagucauaaucaauacccaaugaggaacaggauugccuucgcaaacauaaacccauucagccuaagcagugcagacacuucugaggagaaaaagcuggauauagcaaaccaacuaaaagacaaaacacauaaaauuauaaaaagaauaauagaaauagaaaaaccuaucgaaaccaaagaauag

SEQ ID NO: 11576 - RNA, 3381 nt, Artificial Sequence
  Cas13b variant__Prevotella intermedia__WP_036860899.1__Cas13b
auggaagacgacaagaaaacaacugacagcauacgauacgaauuaaaagacaaacauuuuugggcagcauucuuaaaccuagcaaggcacaauguauacaucacaguaaaccacauaaacaaaauccuagaagaaggggaaauaaauagagacggauaugaaacaacccucaaaaauacauggaacgaaauaaaagacauaaacaagaaagaucgccuaagcaaacuaauaauaaaacauuuuccauuucuagaagcagcaacauaccggcuuaacccaacagauaccacaaaacaaaaagaagaaaaacaagccgaagcacagagcuuagaauccuuaagaaaauccuucuucgucuucauuuauaaacuaagagacuugagaaaucauuacagccacuacaaacacucaaaaucauuagaaaggccaaaauucgaagaaggacuucuagagaaaauguacaauaucuuuaacgcaucgaucaggcucgugaaagaagauuaucaauacaacaaagacauaaacccggacgaagauuuuaaacauuuagauagaacagaagaagaguucaacuauuacuuuacaaaagacaaugaaggcaauauuaccgaaucaggucuccuuuucuucguaaguuuauuucuagaaaagaaagacgcaauauggaugcaacaaaaauuacgaggauucaaagacaacagggaaaacaaaaagaaaaugacaaacgaagucuuuugcaggucgagaaugcuucuaccaaaacugagguuacaaucaacccaaacccaagauuggauucuacuagacauguuaaacgaacuaauaaggugcccaaaaucuuuauacgaaagauuaagagaagaagaucgagaaaaauucagaguuccuauagaaauugccgaugaagauuaugaugccgaacaagaaccauucaaaaauacccuagucagacaucaagauagauuuccauacuucgcacuaagauauuuugauuacaacgaaauauucacgaacuuaagauuccaaauagacuuaggaacauaccacuucucuauauauaagaaacaaauuggcgauuacaaagaaucucaccaccucacacauaaacuuuacggauuugaacgaauccaagaauuuacuaaacagaacaggccagaugaauggcgaaaauuuguaaaaacauuuaacucauuugaaaccucgaaagaaccauacauuccagaaacaaccccgcauuaucaucuagaaaaccagaaaauaggaauaagauuccguaacgauaacgacaaaauauggccaucucuuaaaaccaacagcgaaaagaacgaaaaaucaaaauacaaacuagacaaauccuuccaagcagaggcuuuucucucuguacaugaacuauugccaaugauguucuacuacuuguuacuaaaaacagaaaauaccgacaaugauaaugaaauugaaacuaagaagaaagaaaacaaaaacgacaaacaagaaaaacacaaaauugaagaaauuauagaaaacaaaauuacagaaauauacgcauuauaugauacauuugcaaacggugaaauaaaaagcauagaugaacuagaagaauauugcaaaggaaaagauaucgaaauaggacaucugccgaaacaaaugauugcuauacuaaaagaugaacacaaaguaauggcuacagaagcagaaagaaaacaagaagaaaugcugguagacguacagaaaagccuagaaucauuagacaaucaaaucaaugaagaaaucgaaaacgucgaacguaaaaauucaucccucaaaaguggaaaaauagcaaguugguuaguuaacgauaugaugagauuucagccaguacaaaaagacaacgaaggaaaaccacucaauaauucaaaagcaaacagcacagaauaccaauuacuacaacgaacacuagcauucuucgguuccgaacacgaaagacucgccccauacuucaaacaaaccaaacuaauagaaucgucaaauccccacccauuccuaaaagacacggaaugggaaaaaugcaacaauauacucagcuucuacagaucauaccuagaagcgaagaaaaacuuccucgaaucacucaaaccggaagacugggaaaagaaucaauacuucuuaaaauuaaaggaacccaaaacuaaaccaaaaacauuaguacaaggauggaaaaacggauuuaaucuaccucgaggaauauuuacagaacccauccgaaaaugguuuaugaaacauagagaaaacaucaccgucgcagaacucaaacgaguaggacucgucgcaaaagugauaccacuauucuucucagaagaauacaaagacagcguacaaccauuuuauaacuaccacuucaacgugggaaacauaaauaaaccugacgagaaaaacuuccuaaauugcgaagaaagaagagaacuacuaagaaagaagaaagacgaguucaagaaaaugacagacaaagaaaaagaagaaaacccuucauauuuagaguucaaaagcuggaacaaauucgaacgagaacuacgccuaguacgaaaccaagauaucgucacauggcuccuuuguauggaacuauucaacaagaagaaaauuaaagaacuaaacguagagaaaauauaccugaaaaauaucaacacaaacacaacaaagaaagagaaaaacacagaagaaaagaauggcgaagagaaaaacauaaaagagaaaaacaauauacuaaacagaauaaugccaaugagacuacccauuaaaguguacggacgagaaaauuucuccaaaaauaaaaagaagaaaaucagaagaaacacauucuucaccguauacauagaagaaaaaggaacaaaacuacuaaaacaaggaaacuuuaaagcccucgaaagagaucggagacuaggcggacuauuuaguuucgucaaaacaccaucuaaagcagaauccaaaucaaacacaauaucaaaacuucgagucgaauacgaacuaggagaauaucagaaagcaagaauugaaauaauaaaagacauguuagcccuagagaaaacacuaauugauaaauauaauucgcuagacacagauaacuucaacaaaaugcuaacagacuggcuagaacuaaaaggagaaccagauaaagcaucguuucaaaaugaugucgaccuacugauagccguaagaaacgcauucucgcauaaccaauauccuaugagaaauagaauugcguuugcaaauauaaacccauucucccuaucauccgcgaacaccagcgaagaaaaaggccugggcaucgcaaaucaguuaaaagacaaaacacauaaaacaaucgagaaaauuaucgaaaucgaaaaacccauagaaacaaaagaauga

SEQ ID NO: 11577 - RNA, 3363 nt, Artificial Sequence
  Cas13b variant__Prevotella intermedia__WP_061868553.1__Cas13b
auggaagacgacaaaaaaacaacagacucuauaagauaugaacuaaaagacaaacauuucugggcagcauuucucaaccuggcaagacauaacguauacauaacaguuaaccauaucaacaaaauacuagaggaagaugaaauaaaccgcgacggauacgaaaauacccuugaaaacucauggaacgagauaaaagacauuaauaaaaaagaucgacucagcaaauuaauaauaaaacauuuccccuucuuagaagcgacgacauaccgucaaaacccuacagauacgaccaaacaaaaagaagaaaaacaagcagaagcacaaagucuagagucacugaaaaaaucauucuucgucuuuaucuacaagcuaagagaucuccguaaccauuauucacauuacaaacacaguaaaagcuuagaaaggccaaaauucgaagaagaccuacaaaacaaaauguauaacauauuugauguaagcauacaauuuguaaaagaagacuauaaacacaacacagacauaaaccccaaaaaagauuucaaacaccuagauagaaaaagaaaaggaaaauuucacuauucguucgcagacaacgaaggcaauauaaccgaaagcggauuauuauuuuuuguaucauuauuucuugaaaaaaaagaugccauauggguucaaaaaaaacucgaaggauucaaaugcagcaauaaaagcuaccagaaaaugacaaacgaaguauucugccgcucaagaauguuacucccaaaguuacgccuggaaucuacccaaacucaagauuggauccuacucgacaugcuaaacgaauuaauaagauguccgaaaaguuuauaugaaagauuacaagggguaaaccgaaaaaaauucuacguaucauuugauccggcagacgaagauuaugacgcugagcaagaaccauuuaagaacacccuaguucgacaccaagacagauuccccuacuuugcacuaagguauuucgacuacaacgagguuuucgcaaaccuaagauuccaaaucgaccuaggaacauaucauuuuucaauuuauaaaaaauuaauaggaggacaaaaagaagaucgacaccugacacauaaacuauacggauuugaaagaauacaagaauucgacaaacaaaaccgaccagacgaauggaaagcaauagucaaagacuccgauacguucaaaaaaaaagaagaaaaagaagaagaaaagccauacauaagcgaaacaacaccacauuaccaucucgaaaacaaaaaaauagguaucgccuuuaagaaccacaauauauggccaagcacacaaacagaauuaacaaauaauaaacgaaaaaaauacaacuuaggaaccucaauaaaagcugaggcauuccuauccguacacgaguuacuccccaugauguucuauuacuuacuucuaaaaacagaaaauacaaagaacgauaacaaaguuggaggaaaaaaagaaacaaagaaacaaggcaaacacaagauagaagcgauaauagagucaaaaauaaaggacauauaugcucucuacgaugcguucgccaacggggaaaucaacucagaagaugaauuaaaagaauaucuaaaaggcaaagacauaaaaauaguccaccucccaaaacaaaugauagcaaucuuaaaaaacgaacauaaagauauggcagaaaaagccgaagcaaaacaagaaaaaaugaaacuugcaaccgaaaacagauuaaaaacacuagauaaacaacuaaagggaaaaauucaaaacggaaaaagauauaacuccgcucccaaaaguggagaaauagcgagcugguuaguuaacgacaugaugagauuucaaccgguccaaaaagaugaaaacggagaaucacuaaacaauuccaaagcaaacaguacugaauaccagcuccuacaacgaacacuagcauucuucggcagcgaacaugaaagauuagcccccuacuucaaacaaacuaaauuaauagaaucauccaacccacacccauuccucaaugacacagaaugggaaaaauguucaaacauauuaucauuuuacagaaguuaccuaaaggcacguaaaaacuucuuagagucacucaagccugaagauugggaaaaaaaccaauauuuccuaaugcuaaaagaaccaaaaacaaaucgagaaacacuaguacaaggauggaaaaaugguuucaaccucccacggggauucuucacagaaccaauacgaaaaugguucauggaacacuggaaaucaauuaaaguagaugaccuaaaacggguaggacuggucgcaaaaguaacaccauuguuuuuuucagaaaaauacaaagacucuguacaaccauucuacaauuacccauucaauguaggggacguuaauaaaccaaaagaagaggauuucuuacacagagaagaaagaauagaacuaugggauaaaaaaaaggauaaauucaaaggauauaaagcaaaaaaaaaauucaaagaaaugacggacaaagaaaaggaagaacauagaaguuaucuugaauuccaaucauggaauaaauucgaaagagaacuaaggcuuguuaggaaccaagauauaguaacauggcuuuuguguacugaauuaauagacaaauuaaagauagaugaguuaaacauaaaagaacuaaaaaaauuaagacuuaaagauaucaacacggacacagcuaaaaaagaaaaaaauaauauacuuaaccgagucaugccaauggaacucccugugaccguauauaaagucaauaaaggaggauacauaauaaaaaauaaaccacuucauacaauauauauuaaagaagcagaaacaaaacugcuaaaacaaggcaacuuuaaggcacuagucaaagaucgaagauuaaaugggcuuuucagcuucgucaaaacccccucugaagcagaauccgaauccaaccccauaagcaaauuaagagucgaauaugagcugggaaaauaccaaaacgcucgauuagacauaaucgaggacaugcuugcacuggagaaaaaacuaauagacaaauauaacucccuugacacugauaacuuucauaacaugcuuaccggauggcucgaacuaaaaggcgaagcaaaaaaagcccgauuucaaaaugacgucaaacuacuaaccgccguaagaaacgccuuuucacacaaccaguacccuauguacgaugaaaaccuauucgguaauaucgaaagguuuucacucagcucuaguaacauuauugagagcaaaggcuuagauauagccgcaaaacugaaagaagaagucucgaaagcagccaaaaaaauacaaaacgaagaggacaacaagaaagaaaaagaaacuuaa

SEQ ID NO: 11578 - RNA, 3378 nt, Artificial Sequence
  Cas13b variant__Prevotella intermedia__KJJ86756.1__Cas13b
augaaaauggaagacgacaaaaaaaccacagaauccacgaauauguuagacaacaaacacuuuugggccgcuuuccuaaaucucgcccgccacaacguauauauuacggucaaccauauaaacaaaguccuagaauugaaaaauaaaaaagaucaagacaucauuauagacaaugaccaagacauacuagcaauuaaaacacacugggaaaaaguaaacggcgaccucaacaaaacagaacgauuacgagaauuaaugacaaaacacuuuccauuucucgaaacagccaucuacacuaagaacaaagaagacaaagaagaagucaaacaagaaaaacaagcagaagcacaaagcuuagaaagccuaaaagacugucuauuccuauuucuagaaaaauuacaagaagcucgaaacuacuacucgcauuacaaauauucagagagcacaaaagaaccaauguuagaagaaggacuauuagaaaagauguauaacauauucgacgauaauauacaacuuguaauaaaagacuaucaacauaacaaagauaucaauccugacgaagauuuuaaacaccuagacagaaagggacaauuuaaauauucuuucgcagacaaugagggaaauauaacagaaaguggccuucuuuuuuucgugucacucuuccuugagaaaaaggaugccauuuggaugcaacaaaaacucaccggcuucaaggacaacagagaaucaaaaaaaaaaaugacacaugaaguauuuugcagacgcagaaugcuccucccuaaacugcgauuagaaucgacacaaacucaagacuggauacuauuagacaugcuaaacgaauuaauacggugcccuaaaucgcucuacgaacgacuacaaggcgaauaccgaaaaaaauuuaacgugccauuugacagcgcggacgaagauuaugacgcugaacaagaacccuuuaaaaauacauuaguuagacaccaggaucgauuccccuacuucgcccuaagauacuucgauuacaaugagauuuucaccaaccugagauuccaaaucgaucuaggaaccuaccacuuuagcauauacaaaaaacucauaggaggucaaaaggaagacagacauuugacacacaaacucuauggauuugagagaauacaagaguucgcuaaacagaacagacccgacgaauggaaagcccugguaaaagacuuagacaccuacgaaacaagcaaugaacgauacauaucagaaacuacaccucacuaucaccuagaaaaucaaaaaauaggaauacgauuucgaaaugguaacaaagaaaucuggcccagucuaaaaacaaauggcgagaacaacgaaaaaucaaaauauaaauuagacaaaccauaccaagcugaagcauuuuuaagcguacacgaauuacuaccaaugauguucuacuaucuacuacuaaaaaaagaagaaccaaacaaugacaaaaagaaugcuuccauaguagaaggauuuauaaaacgagaaauccgagacauguacaaauuauacgaugccuucgccaauggagaaauuaacaauauuggagaucucgaaaaauauugcgaagauaaaggcauacccaaacgccacuuacccaaacaaaugguggcaauuuuauacgacgaaccuaaagacauggucaaagaggccaaaagaaagcaaaaagaaaugguaaaggacacuaaaaaauuauuagcuacacuagaaaagcaaacacaagaggaaauagaagacggaggcagaaauauacgacuccuaaaaucuggcgaaauugcacgauggcucguaaacgacaugaugcgauuccaaccuguacaaaaagacaaugaaggaaacccccuaaauaauagcaaagcaaauagcacagaguaccaaaugcuacaaagaucacuugcauuauauaacaaagaagaaaaaccaaccagguauuucagacaggucaaucuaauuaacucauccaauccacaucccuuccuuaaauggaccaaaugggaagaaugcaacaacauauuaagcuucuacagaaauuaccucaccaaaaaaauagaauuccuaaacaaauuaaaacccgaagauugggaaaaaaaccaauacuuucuaaaacuaaaagaaccuaaaacuaaucgagaaacacuuguccagggcuggaaaaacgguuucaaucuaccuagaggcauuuuuacagaacccauaagagaaugguucaaaagacaucaaaaugacucaaaagaauacgaaaaaguugaagcacuaaaacgcguaggucucguaacuaaaguuauaccacuauuuuuuaaggaagaauauuucaaagaagacgcacaaaaggaaauuaacaauuguguacaacccuuuuauagcuucccauauaacguaggaaauauccauaaaccagacgaaaaggacuucuugccaucagaagaacgaaaaaaauuauggggagacaaaaaagacaaauuuaaaggauacaaagcuaaaguaaagaguaaaaaauuaacagauaaagaaaaagaagaauaccgcucauaccucgaauuccaguccuggaauaaauucgaaagggagcuaagguuaguacguaaucaagacauaguuacauggcuacucugcacagaauuaaucgacaaaaugaaaguagaagguuugaauguugaagaauuacaaaaacuacgacuaaaagacauagacacggauacagccaaacaagaaaaaaauaacauacuaaauagaauaaugccuaugcaacucccaguaaccgucuacgagauagacgacucccacaauauugucaaagacagaccacuucauaccguauacauagaagaaacaaaaaccaaacuacuaaaacaaggaaauuucaaagcacuggucaaagaccgucgauuaaacggacucuucucguuuguagacacaagcagcaaagcagaacuaaaagauaaaccaauauccaagucaguagucgaauacgagcugggugaauaccaaaaugcaagaauagaaaccauaaaagacauguuauuguuagagaaaacccuaauaaaaaaauacgaaaaacuacccacagauaauuuuagugauauguuaaauggauggcuugaagguaaagacgaauccgacaaagcgcgcuuucaaaacgaugugaaauuacuagucgcaguucgcaacgccuuuucucauaaccaauauccuaugagaaauagaauagccuuugccaauauaaaccccuuuagccuaagcucagcagacauaagcgaagaaaaaaaacuagauauugccaaccaauuaaaagauaaaacucauaaaaucauaaaaaaaauaauagaaauagaaaaaccaauagaaaccaaagaauag

SEQ ID NO: 11579 - RNA, 3378 nt, Artificial Sequence
  Cas13b variant__Prevotella pallens__EGQ18444.1__Cas13b
augaaggaagaagaaaagggcaaaaccccaguuguuuccaccuacaacaaagacgauaaacauuucugggcagcauuccuaaaucuagcacgucacaacguauauaucacaguuaaucacauaaauaaaauacuuggagaaggugaaauuaauagggaugguuaugaaaauacucucgaaaaauccuggaacgaaauuaaagacaucaacaaaaaagacagauuaucaaaguuaaucauaaaacacuucccuuuccucgaaguaaccacauaccaaagaaacucagccgauacaaccaaacaaaaagaagaaaaacaagccgaagcacaaucacucgaaucccuaaaaaaaagcuucuucguauuuauauacaaauuaagagauuuaaggaaccauuauucacauuauaaacacucaaaaucccuugaacgaccaaaauuugaagaagaucuucaagaaaaaauguacaauauauucgaugccucaauccaauugguaaaggaagacuauaaacacaacaccgacauaaaaaccgaagaagacuucaaacaccuagaucguaaaggacaauucaaauacucuuucgcagacaacgaaggaaacauaacagaaagcggcuugcucuucuuugugucauuauuccucgaaaaaaaagacgcaauauggguucaaaaaaaacuagaaggauucaaaugcuccaaugaaucguaccaaaaaaugacaaacgagguauuuugcagaagcagaaugcuauuaccaaaacucagacuucaaucgacacaaacacaggacuggauccuauuagacauguugaacgaacuuauaagguguccaaaaucucuauacgaacgccuacgagaagaagacagaaaaaaauucagaguaccaauagaaauagcagaugaagacuaugacgccgaacaagaaccauucaaaaacgcacuuguaagacaccaggaccgauuccccuauuucgcauuacgauauuuugauuacaacgagaucuucacaaaccuaagauuccaaauagauuuagggacauaucauuuuaguaucuauaaaaagcaaaucggggacuacaaagaaucacaccaccuaacccauaaauuguauggauuugaacgcauacaagaauuuacaaaacaaaacagacccgaugaauggcgaaaauuuguaaaaacauuuaacucauucgaaacaaguaaagaaccauacaucccagaaacaacaccacacuaucaccuagaaaaccaaaaaauaggcauaagauuuagaaacgauaaugauaaaaucuggccauccuuaaaaacaaacagcgaaaagaacgaaaaaagcaaauauaaacucgauaaaaguuuccaagccgaagcguuuuuaucuguacacgaacuguuaccaaugauguucuacuaucuccuauuaaaaacugaaaacacugacaaugauaaugaaauagaaacaaaaaagaaagaaaacaaaaaugacaaacaagaaaaacauaaaaucgaagaaauaauagaaaauaaaauaacagaaauauaugcacuuuacgaugccuucgcaaacggaaaaauaaacaguauagacaaacuagaagaauauugcaaaggaaaagacauugaaauuggacauuugccuaaacaaaugaucgccauacuaaaguccgaacauaaagacauggccacagaagcuaaaagaaaacaagaggaaaugcuugcagacguacaaaaaagcuuagaaagccucgacaaccaaaucaaugaagaaauagaaaacguagaaagaaaaaacucaucucuaaaaucaggugaaauugcaucaugguuaguaaaugacaugaugagauuccaaccaguacaaaaagauaaugaaggaaaccccuuaaacaacaguaaagcaaauucaacagaauaccaaaugcuacaaagaagcuuagcacuguauaauaaagaagaaaaaccaacaagauacuuccgccaggucaacuuaauagaaucaagcaacccacaccccuucuugaacaacaccgaaugggaaaagugcaacaacauucucucauucuauagaaguuacuuagaagcuaaaaaaaauuuccuggaauccuuaaaacccgaagacugggaaaaaaaccaauacuuccucauguuaaaggaaccaaaaacgaacugcgaaacucucguucaagguuggaaaaacggauucaaccuccccagaggaauauuuacagaaccuauacgcaaaugguuuauggagcaccgaaagaacauaaccguagccgaacuaaaaagaguaggccuaguagcuaaaguaauaccacuuuucuucucagaagaauauaaagacaguguucaaccauuuuacaacuauuuauuuaauguagggaacauaaacaaaccagacgaaaaaaauuuccucaauugugaagaaagaagagaacuccuucgaaaaaaaaaagacgaauucaagaaaaugacagauaaagaaaaagaagaaaauccgaguuauuuagaauuucagucauggaauaaauucgaacgagaauuaagauugguacgcaaccaggauaucguaacuugguuauugugcauggaacuauucaacaaaaaaaaaauaaaagaacucaacguagagaaaauauaccuaaaaaacauaaacacaaacacaacaaaaaaagaaaaaaacacagaggagaagaacggagaggaaaaaaucauaaaagaaaaaaauaacauccuaaacagaauaaugcccaugcggcuaccuauaaaaguuuauggaagagaaaauuucagcaaaaacaaaaaaaaaaaaauaagaaggaacacauucuuuacaguuuauauugaagaaaaaggaacaaagcuacuaaagcaaggaaacuucaaagcauuagaaagagacagacgacuaggcggacuguucuccuuuguaaaaacacauagcaaagcggaaucaaaauccaacacuauaucaaaaucaagaguugaguacgaauuaggagaguaccaaaaagcucgaauugaaaucauuaaagauaugcuugcauuagaagaaacacuaauagacaaauauaacucauuagacacagauaacuuucacaacaugcuaacuggcuggcuaaaacuaaaggacgaaccagacaaagcaaguuuccagaacgacguagauuuacuaauugcuguucgaaacgccuucucgcauaaccaauaccccaugagaaauagaauagcauucgcaaacauaaacccguucagcuuaucaucggcaaauacuucagaagaaaaagggcuaggaauagcaaaccaauuaaaagauaaaacacacaaaacaauugaaaaaaucauagaaauagaaaaaccgaucgaaacaaaagaauaa

SEQ ID NO: 11580 - RNA, 3453 nt, Artificial Sequence
  Cas13b variant__Prevotella saccharolytica__EKY00089.1__Cas13b
augauggaaaaagaaaacguacaaggaucucauauauacuaugaaccaacagacaaauguuucugggcagcauucuacaauuuagcacgccauaacgccuaucucacaaucgcacacauaaacuccuucgucaauuccaaaaaaggcauaaauaacgaugacaaaguauuggauaucauagaugauuggucaaaauucgacaaugaucuacuaaugggugcuaggcuaaacaaacucauacuuaaacacuucccauucuuaaaagcgccauuauaccaacuagcaaagagaaaaacuagaaaacaacagggaaaagaacaacaagauuaugaaaaaaaaggggacgaggaccccgaaguaauccaagaagcaaucgcaaaugcauucaaaauggcuaacguacguaaaacccuccacgcauuucugaagcaacuagaagacuuaagaaaucauuuuucacacuacaauuauaacuccccugcaaaaaagauggaaguuaaguuugacgauggauucuguaacaaacuauauuacguauuugaugcagcacuacaaauggucaaagacgacaacagaaugaacccagaaauaaacaugcaaacugacuuugaacaucuaguucgauuaggaagaaauagaaaaauaccaaauaccuuuaaauauaauuucacuaacucagauggaaccaucaauaauaacggauugcuauucuucgucucacuuuuccuagaaaaaagagacgcaaucuggaugcaaaaaaaaaucaaaggauucaaagguggaacugaaaacuacaugcgaaugacaaacgaaguauucugccgaaaucgcaugguuaucccuaaauuacgauuagaaacugauuacgacaaccaccaacuuauguucgauaugcuaaacgaauuagucagguguccacucucacuauacaaacguuuaaaacaagaagaccaagauaaauuuagaguaccaauagaauuucuugacgaagacaaugaagcagauaaucccuaccaagaaaacgccaacuccgacgaaaauccaacagaagaaacugacccucuaaaaaacacccuuguccgucaccaacaccgcuucccauauuucguccuuagauacuucgaccucaacgaaguauucaaacaauuaagauuucaaauaaacuuaggaugcuaucauuucucaauauacgauaaaacuauaggagaacgcacagaaaaacggcaccuaacucgcacucuauucggcuucgauagauuacaaaacuucucaguaaaacuacaaccagaacacuggaagaauaugguaaaacauuuagacaccgaagaauccucggauaagccauaucuaagugacgcaaugccacacuaccaaauagaaaaugaaaaaauuggcauacauuucuuaaaaacagauaccgaaaaaaaagaaacaguauggccaucacuagaaguagaggaaguaaguuccaacagaaacaaauauaaaagugaaaaaaaucuaaccgcagacgcauucuuaaguacccaugaacuacuacccaugauguuuuacuaucaauuacuaucuagcgaagaaaaaacuagagcagcagcaggagacaaaguacaaggaguacuacaaucuuacagaaaaaaaaucuuugauauauacgaugacuuugcgaacggcaccauaaauucaaugcagaaauuagacgaacgacucgcaaaagauaaccuccuucgcggaaauaugccacaacagauguuggcaauacucgagcaccaagaaccugacauggaacaaaaagcuaaagaaaaacuagacagacugauaacagaaacuaaaaaaagaaucggcaaauuagaagaccaauucaaacaaaaaguacgaauuggaaaaagaagagccgaucuaccaaaaguagguuccauagccgauuggcuaguaaaugacaugaugagauuccaaccagcaaaaagaaaugcagauaauaccggcguaccagacucaaaagcuaacuccacugaauauagacuccuacaagaagcucucgcuuucuauucagcauacaaagacagacuagaaccauauuucagacaaguuaaccuuaucggaggaacaaauccacacccauuccuucauagaguagacuggaaaaaaugcaaucaucuccuaucauucuaucacgauuaucuagaagcaaaagaacaauaccugucacaucuaucuccagcagacuggcaaaaacaucaacauuuucuacuacuaaaagucagaaaagauauacaaaacgaaaaaaaagauuggaaaaaaucucuuguagcaggauggaaaaacggauucaacuuaccaagaggcuuauucacugaaucaauuaaaaccugguucucaacagaugcagauaaaguccaaauaacagauacaaaacucuucgaaaaucggguaggcuugauagcaaaacuaaucccucuauacuacgacaaagucuauaaugacaaaccacaaccauucuaccaauauccauuuaacauaaaugaccgauauaaaccagaagacaccagaaaaagguucaccgcagcaucaucaaagcuauggaaugaaaaaaagaugcuauacaaaaacgcccaaccagacuccucagauaaaaucgaauauccacaauaucucgacuuccuaucuuggaaaaaauuagaaagagaauuaagaaugcuccgaaaucaagauaugauggugugguuaauguguaaagaucuguucgcacaaugcacaguagaaggagucgaauuugcagaucuaaaauugucucaacucgagguagacguaaacguacaagauaaucuaaauguucugaauaauguaagcucuaugauccuaccuuugucgguauauccguccgacgcucaaggaaauguauuacgaaacucuaaaccacuucacaccguauacguacaggaaaacaacacaaaauuacuuaaacaaggaaacuuuaaaucccuauuaaaagacagacgacuuaacggacuuuucucauucauagcagcagagggagaagaccuacaacaacauccacucacuaaaaacagauuagaauacgagcuaucaauauaccaaacaaugcgcauuuccguauucgaacaaacucuccaacuugaaaaagcaauauuaaccaggaacaaaacccuaugcgggaauaauuuuaacaaccuauuaaacucuuggucggagcauagaaccgauaaaaaaacacuacaaccagacauagauuuuuuaauagcagucagaaaugcauucucccacaaucaauauccuaugucuaccaacacugucaugcaaggaauagaaaaauucaauauccagacccccaaacuagaagaaaaagauggccucggcaucgccucacaauuagcaaaaaaaacaaaagacgcugcuucacgacuacaaaauauaaucaauggagggacaaauuaa

SEQ ID NO: 11581 - RNA, 3969 nt, Artificial Sequence
  Cas13b variant__Prevotella sp.__WP_036929175.1__Cas13b
augucaaaagaauguaagaaacaaagacaagaaaagaaacgaagacugcagaaagccaacuucucaaucucauuaacuggaaaacauguuuuuggugcauauuuuaauauggcuagaacuaacuucgucaaaacaauuaauuacauuuuaccuauagcaggggucagaggaaauuauucugaaaaccaaauaaauaaaaugcuucaugcacucuuucuuauacaagcaggucgaaaugaagaauuaacuacagaacaaaaacaaugggaaaagaaacucagauugaauccugaacagcagacuaaauuucaaaaacuguuauucaaacacuuccccguacuugguccaaugauggcagacgucgcagaccauaaagcauaccuaaacaaaaagaaaaguacaguucaaacagaagacgaaaccuuugcgaugcuuaaaggaguaucauuagcugauugucuagauaucauauguuuaauggcugauacacuaaccgaguguagaaacuuuuacacccauaaagaccccuauaauaaaccgucacaauuagcagaccaauaccuacaucaagaaaugauagcgaagaaacucgauaaagugguaguggccucacgcagaaucuuaaaagaccgagaaggcuuaagcguuaaugaagucgaauuucugacuggaauugaccaccuacaucaagaaguacuuaaagaugaguucgggaacgcuaaagugaaagauggaaaaguaaugaaaacguuuguugaauaugaugauuuuuauuuuaaaauaucugggaaacgccugguuaacgguuacacuguaacuacaaaagacgauaaaccaguaaacguaaauaccaugcuaccagcccuuagugacuuuggucuacuuuacuucuguguacucuuccuuaguaaacccuacgcuaaacuuuucauugaugaggucagacuauucgaauauucaccuuuugaugacaaagaaaacaugauuaugucagaaaugcuaaguauauacagaaucaggaccccaagauuacauaaaaucgacucucacgauagcaaagccacgcuugcuauggauauauuuggagaauuacgaagaugcccaauggaacuauauaaccuguuagauaaaaaugccgggcaaccuuucuuucaugacgaagugaaacacccaaauucacauacaccugauguaucuaaaaggcuccgauacgacgauagauuuccaacacucgcacuaagauauauugacgaaacagaauuauucaaaaggauccgauuccagcuacaauuagguucguuucgauauaaauucuacgauaaagagaauugcaucgauggucgggugaggguacgaagaauacaaaaagagaucaaugguuauggcagaaugcaagaaguugccgacaaacgaauggacaaauggggcgauuuaauccaaaaacgagaagaaagaucugucaaacuagaacacgaagaauuauacauaaaccuagaucaauuccuugaagacacugccgacucaacacccuacguuacagauaggagacccgccuacaauauccacgcaaaccgaaucgguuuauauugggaagauagucaaaacccaaaacaauacaaaguuuucgacgaaaauggaauguacauaccagaauuaguaguaacugaagacaagaaagcaccuauaaaaaugccagcuccaagaugugcuuuauccgucuaugaccuacccgcaauguuauucuaugaauacuuaagagaacagcaagacaacgaauuuccuagcgcagaacaaguaauaauugaauaugaagaugauuacagaaaauucuucaaagcagucgcagaaggcaaauuaaaaccauucaaaagaccaaaagaguuccgagacuuuuuaaagaaagaauauccaaaacuuagaauggccgacaucccaaagaaacuacaauuauucuuauguucacacggacugugcuacaauaacaaacccgaaacaguuuacgaacgacucgaccguuuaacgcugcaacaccuagaagaaagagaacuacauauacagaauagguuagagcacuaucaaaaagacagagauaugauaggcaauaaagauaaucaauauggaaagaaaucauuuagcgacguccgucacggagcacuagcacgcuauuuagcacaaucaaugauggaauggcaacccacaaaacuaaaagacaaagaaaaaggacacgacaaauuaacgggccuaaacuauaacguauuaaccgccuaccuugccaccuacggucauccccaagucccagaggaaggauucacaccccguacuuuagagcaaguguuaaucaacgcacaccuaaucggcgguuccaacccccacccuuuuaucaauaaaguucuugcuuuaggcaacagaaacauagaagaacucuaccuucauuauuuagaagaagaauuaaaacacauuagaucaagaauccaaucacuuucaucaaauccaucagauaaagcacuaagugcauuaccauuuauccaccacgacagaaugcgauaucaugaaagaacauccgaggaaaugauggcacucgcugcuagauauacaaccauucaacuaccagauggccuuuucacgccauacauacuagaaauuuuacagaaacacuauacagaaaauucagacuuacaaaacgcguuaucccaagauguaccaguuaaauuaaacccgacuugcaaugcugcauauuugauaacacuguuuuaucaaacagugcuaaaagacaaugcacaaccauucuaucuuuccgacaaaacauacacgcgaaauaaagauggagagaaagcagaauccuucagcuuuaaaagagccuacgaauuauucucaguauuaaacaauaacaagaaagacaccuucccuuucgaaaugauaccccuauuccuaacaucugaugaaauucaagagagacuuucagcaaaacuccuagauggagauggcaaucccguaccagagguaggcgaaaaaggcaaaccagcaacagauagccaaggaaacacaauauggaaaagaagaauuuacucagaaguagaugacuaugcagaaaaacuaacagauagagacaugaaaaucaguuucaaaggugaaugggaaaaauugccacgauggaaacaagauaaaaucauaaaaagacgugacgaaacgagaagacaaaugcgagacgaacuacuacaaagaaugccacguuacauucgagauauaaaagacaacgagaggacuuuaagacgauauaaaacacaggacaugguguuauuccuacucgccgagaaaauguucacuaauauaauaucagaacaaagcuccgaauuuaacuggaaacagaugagauugagcaaaguauguaaugaagccuuucuuagacaaacacuuacauuucgcgucccagucacuguaggagaaacuacaauauacguagaacaagaaaacaugagccuuaaaaacuacggcgaguucuaccgauuccuaacagaugaccgccuuaugucuuuauuaaauaauauugucgaaacacuaaaacccaacgaaaauggugaccuugucauacgucacacugaccuaaugagcgaacucgcugcuuaugaccaauaccgaagcacuauauucauguuaauacaaagcauagaaaacuuaauaauaacgaacaaugcuguucuagacgacccagacgcagacggcuucuggguaagagaagaucuaccaaaacguaauaacuuugcaagccuucuagaauuaauuaaucaauuaaauaauguagaacugacagaugacgaaagaaaacuucuaguagcuauucgcaacgccuucucucacaauagcuauaacauagauuucucgcuaaucaaagauguuaaacaucuaccggaaguagcaaaagguauauuacaacaccuccaaucaaugcuuggcgucgaaauaacaaaauaa

SEQ ID NO: 11582 - RNA, 3384 nt, Artificial Sequence
  Cas13b variant__Prevotella sp.__WP_007412163.1__Cas13b
augcaaaagcaagacaaauuauuuguagacaggaaaaaaaacgccauauuugcauuuccaaaauauauaacuauuauggaaaaccaagaaaaaccagagccaaucuauuacgaacuaacagauaaacauuucugggccgcuuucuuaaacuuagcccgucacaaugucuacacaacgauuaaccacauaaaccgaagauuagaaauagcagaguuaaaagacgacggauacaugaugggaauaaaaggauccuggaacgaacaagcaaaaaaacucgacaaaaaaguccgauuaagagacuugauaaugaaacacuuuccauuucuugaagcagcagcuuacgaaauaacgaauucaaagucaccaaauaacaaggaacagagagaaaaagaacaaucagaagccuuaucccuaaauaaucuaaaaaauguuuuauucauauuucuagagaaauuacaaguccuuagaaauuacuauucacacuacaaauauucagaagaaucaccuaaaccaaucuucgaaacauccuuacuaaaaaauauguauaaaguauuugacgcaaauguaagauugguuaagcgagauuacaugcaccacgagaacaucgacaugcaacgagacuucacacaucugaaucguaaaaaacaaguaggcagaacaaaaaacauaauugauucaccuaacuuccauuaucauuuugcagauaaagaaggcaauaugaccauagccggacuacuauucuucgucucccuuuuucuagacaaaaaagacgcaauauggaugcagaagaaacuaaagggauucaaagacgguagaaacuuaagagaacaaaugacaaaugaagucuucugccgaucccgaaucucgcuaccuaaauuaaaacuggaaaacguacaaacuaaagacuggaugcaauuagacauguuaaacgaacuugucagaugccccaaaucucucuacgaaagacuuagagaaaaagaccgagaaucauucaaaguaccguucgacauauuuagcgaugacuaugacgccgaagaagaaccuuucaaaaauacgcuaguacgacaucaagaccgauucccauacuucguacuaagauacuuugaucucaacgaaaucuucgaacaacugcgauuccaaaucgaccuaggaacauaccacuucucuauauauaacaaaagaauaggugacgaagacgaaguccgacaccucacucaucauuuauacgguuuugcaagaauucaggauuucgcaccucaaaaccaaccagaagaauggcgaaagcuaguuaaagacuuagaccacuuugaaacaagccaagaaccauauauuagcaaaaccgcaccacauuaucaccuagaaaaugaaaaaaucggcauuaaguuuuguuccacacacaacaauuuauucccaagccuuaaaagagaaaaaacuugcaacggcagaucgaaauuuaaccugggaacacaauuuacagcugaagcuuuccuauccguacaugaacuccuaccaaugauguuuuauuaccuacuuuugacaaaagauuauuccagaaaagaauccgcugauaaagucgaagguauaauaagaaaagaaauaucuaauauauaugcaauauaugacgcauucgcaaacaacgaaaucaauagcaucgcugaucugacgugcagacuacaaaaaacuaacauacuacaaggacaucuaccuaaacagaugauauccauuuuggagggaagacaaaaagacauggaaaaagaagcugaaagaaaaauuggugaaaugauagacgauacacaacgacgauuagacuuacuaugcaaacaaacuaaccaaaagauacguauagguaaacguaacgcuggacuuuuaaaguccggaaaaauagcagacuggcucguauccgacaugaugagauuccaaccaguacaaaaagacaccaacaaugcacccauaaauaauuccaaagcaaauucaacagaauacagaaugcugcaacaugcacucgcccuauucggauccgaaagcucaaggcuaaaagcauacuuccgacaaaugaaccuagucggaaacgcuaacccucacccauuccucgcagaaacccaaugggaacaccaaaccaacauacuaaguuucuacagaaacuaucuagaagcaagaaaaaaauacuugaaaggccuaaaaccucaaaacuggaagcaauaucaacacuuuuuaauccugaaaguacaaaaaaccaauagaaauacccuuguaacaggauggaaaaacagcuuuaaucuucccagagguauuuucacacaacccauacgcgaaugguucgaaaaacacaauaacuccaaacgaaucuacgaccaaauauuaucauuugaccgagucgguuucguagccaaagccaucccucuguacuucgcagaagaauacaaagacaacguacagccauuuuaugauuacccauuuaacauagguaacaaauuaaaaccacaaaaaggacaauuucuagauaaaaaagaacgagucgaacuuuggcaaaaaaauaaagaauuguuuaaaaauuaucccucagaaaaaaacaaaaccgauuuggcauaccuagacuuccuuagcuggaaaaaauucgaaagagaacuccgacuaaucaaaaaucaagauauagucacaugguuaauguucaaagaacuauuuaaaacaacaaccguagaaggucuaaaaauaggggaaauacaucuccgcgauaucgauacaaacaccgcaaacgaagaaagcaacaacauacuaaaucgaaucaugccaaugaaauuaccaguuaagaccuaugagacagauaauaaaggaaacaucuugaaagaacgaccauuagcaaccuucuauauagaagaaacugaaacaaaaguauuaaaacaaggaaacuucaagguuuuagccaaagacagaagacucaacggccuacuuucuuucgcagaaacuacugauauugacuuagaaaaaaacccaauaacuaaacucucagucgacuacgaacuuauaaaauaccaaacaaccagaaucucgauauucgaaaugacgcuaggccucgaaaaaaaauuaauagacaaauacucaacacuuccuacugauuccuuccgaaauauguuagaaagaugguuacaaugcaaagcaaaucgcccagagcuaaaaaauuacguaaacucucuaauagcuguacgaaacgcuuuuucacacaaucaauacccaauguacgaugccacuuuauucgcagaagugaaaaaauucacucuauuuccaagcguagacacaaagaaaaucgaacuaaacaucgccccacaacuauuagaaauaguagguaaagccauaaaagaaauagaaaaauccgaaaauaaaaacuga

SEQ ID NO: 11583 - RNA, 3273 nt, Artificial Sequence
  Cas13b variant__Prevotella sp.__WP_044072147.1__Cas13b
augaauauucccgcauuaguagaaaaccaaaagaaauauuuuggaacguacuccguaauggccaugcuaaaugcacagacaguacucgaucacauccaaaaaguugccgacauagaaggagaacaaaaugaaaacaaugaaaaucugugguuucacccaguaaugagccaucucuacaacgcuaaaaacggauaugauaaacaaccagagaaaaccauguucauaauagaacguuuacaaucauauuuuccauucuuaaaaauuauggcagaaaaccaacgagaauacucaaaugggaaauacaaacaaaaccgagucgaagucaauucgaaugacauauuugaaguacuaaaaagagcauuuggaguacuaaaaauguauagagaucaggccucacauuauaaaacuuaugaugaaaaacuaauugacggaugcgaguucuuaacaaguacugaacaaccucugagcggaaugauuaacaauuauuacacaguagcauuacgaaacaugaaugaaagguauggauauaaaacagaagacuuagcauuuauccaagacaaaagauuuaaauuuguuaaagacgcguacgguaaaaagaaaagucaaguaaauaccggauucuuucuaucacuacaagauuacaacggagacacccaaaagaaacuccacuuguccggaguaggaauagcacuucuaauaugcuuauucuuagacaaacaauacauuaacauuuuucuaagccgacuaccaauauuuaguagcuauaacgcccaaucagaagaaagacgaauaauuauacgaucauucggcaucaacaguauaaaacaacccaaagaccgaauccauucagagaaaagcaauaaaagcguagcaauggauauguugaacgaaauuaaaagauguccaaaugaacuauuugaaacacuaagugcagaaaaacaaagucgauuuagaaucauaucaaaugaccacaaugaagucuuaaugaaaagaucaagcgaccgauuuguaccacuguuacuccaauauauugacuacggcaaacuauucgaucauauccgauuccacgucaacauggggaaacuaagauaccuccuaaaagcagacaaaacauguauugacggacaaacaagaguaagaguaauagaacaaccacuuaauggauucggaagacuagaagaaguagaaacaaugaggaaacaagaaaauggcacguucggaaauucaggaauuagaauacgcgacuucgaaaauaugaaacgagaugacgcaaauccagcaaacuaccccuauaucguagacacauauacccauuacauacuagaaaacaacaaaguugaaauguucauaagcgaugaagaaacgccagcgccacuacuaccaguaauagaagaugauagauacguagucaaaaccauccccucaugccgaaugaguaccuuagaaauaccagcaauggcauuucacauguuucucuucggaagcaagaaaacagaaaaacucauuguggacgugcauaacagauacaaaagacuauucaaagcaaugcagaaagaagaaguaaccgcggaaaauauagcaaguuuuggaauugccgaaagcgaccuaccgcagaaaauaaucgaucuaauaaguggaaaugcccaugguaaagacgucgaugccuucauaagguuaacaguagacgacaugcuagccgauaccgaaaggagaauaaaaagauucaaagacgacagaaaaaguauacguucggcagacaauaaaaugggaaaaagaggauuuaaacaaauauccacuggaaaacucgcagacuuuuuggcaaaagauaucguauuauuucaaccaucaguaaaugacggggagaauaaaaucacuggauuaaauuauagaauaaugcaaucagcaaucgcagucuacaauaguggagacgacuacgaagcuaaacaacaauucaaacucauguucgaaaaagccagauuaauaggcaaaggaacaacugaaccucacccuuuucuuuacaaaguauucguucgaucaauaccagcaaaugccguagacuucuaugaacgauacuuaauagaacgaaaauucuaccugauaggacucucaaacgaaaucaagaaaggaaaccgagucgauguaccauucauaagaagggaucaaaauaaauggaaaaccccugcaaugaaaacacuaggaagaauauaugacgaagaccucccaguagaacuaccgcgucaaauguuugacaacgaaaucaaaucacacuuaaaaucccuaccacaaauggaaggaauagauuuuaauaaugcgaacguaacguauuuaaucgccgaauauaugaaaaggguacuaaaugaugacuuccaaaccuucuaccaauggaaaagaaacuaccgauacauggacaugcuuagaggagaauacgaccgaaaaggcucccuacaaucauguuucaccagcguugaggaacgagaaggacuauggaaagaaagagcaagcagaacggaaagauacagaaaauuagcaucaaauaaaauuagaucuaauagacaaaugagaaaugcaaguagcgaagagaucgaaaccauccuugauaaacgauuaagcaacucgagaaacgaauaccagaaauccgaaaaaguaauacgcagauacagaguacaagacgcccuccuauuucuauuagccaagaaaacgcuuacugaacuggcugauuucgacggcgaacgauucaaacuaaaagaaauaaugccugacgccgaaaaaggcauucugucagagauaaugccaaugaguuuuacuuucgaaaaagggggaaagaaauauacaaucacauccgaaggaaugaaacugaaaaacuauggagauuucuuuguccuagcuuccgauaaaagaauaggaaaccuauuagaauuagucggaucagauacaguaaguaaagaagauauuauggaggaguuuaagaaauaugaccaauguagaccagaaauaaguucaaucgucuuuaaccucgaaaaaugggcauucgacacuuauccugaacuaagcgcacgaguugauagggaagaaaaaguagacuuuaaaagcauauuaaaaauuuuacuuaauaauaaaaauaucaacaaagaacaaucagauauacuaagaaaaauaagaaacgcauucgaccauaauaacuacccugacaaagguguaguagaaauacgcgcacuuccagaaauugcaaugucaauuaagaaagcauucggagaauaugcaauaaugaaauaa

SEQ ID NO: 11584 - RNA, 3273 nt, Artificial Sequence
  Cas13b variant__Prevotella sp.__WP_042518169.1__Cas13b
augaacauaccagcacuagucgaaaaccaaaaaaaauacuuugguacuuacaguguaauggcaaugcuaaaugcucaaacaguauuagaucacauacagaaagucgcagauaucgaaggugaacaaaacgaaaauaacgagaacuuaugguuucauccaguaaugucacaucuauauaaugccaaaaauggcuaugacaaacaaccugagaaaaccauguuuauaaucgaacgacuccaauccuacuucccauuccuaaaaauuauggcagaaaaucaaagagaguauaguaacgggaaauacaaacaaaauaggguagaaguaaacucuaaugauauauuugaaguccuaaaacgcgcuuucgggguuuuaaaaauguacagagacuuaacuaaccauuauaaaacauaugaagaaaaacuaauugaugguugugaauucuuaacuuccaccgaacaaccacuaucgggaaugauaaguaaauacuauaccgucgcccuacgaaacacaaaagagagauauggcuacaaaacagaagaccuagcuuuuauacaagacaauaucaaaaaaauaacaaaagacgccuauggaaaaagaaaaucacaagugaauacagguuucuuccuaucauuacaagauuauaauggagauacacaaaaaaaauuacauuuaaguggagucggaauagcuuuauuaauaugccuauuucuagauaaacaauauaucaacauuuuccugagucgccuaccuaucuucucgucauauaaugcccaaucagaagaaagaagaaucauaaucagaaguuucggaauuaauagcauaaaauuaccaaaagacagaauccacucggaaaaaagcaacaaaucaguagcuauggauauguuaaaugaagucaaaagaugcccagaugaauuauuuacaacuuuaucagcagaaaaacagucaagguuuaggauaauaucugacgaucauaacgaaguacuaaugaaaagaagcacagacagauuuguaccguuacuacuccaauacaucgacuacggaaaauuauucgaccauaucagauuccauguuaauaugggaaaacuaagauaucuacucaaagcugauaaaacauguauagauggacaaacaagaguaagagugauugaacaaccacuaaauggauucggccgauuagaagaagcggaaacaaugagaaagcaagaaaacggaacauucggaaacaguggaauacgaauaagggacuucgaaaauguuaaaagagaugaugcaaaccccgcaaauuauccauauaucguagacacauacacacacuacauccucgaaaauaacaagguagagauguucauaucagauaaaggaucaagugcaccccuguuaccacuaauagaagaugauagauacguagucaaaacuauacccucaugcagaauguccaccuuggagauaccagcaauggcauuucacauguucuuauuugguucgaaaaaaaccgaaaaauuaauaguggacguccauaaucgauauaaacgucuauuucaagcaaugcaaaaagaagagguaacagccgaaaauauagcaucuuucggaauagcagaaagcgaccucccucaaaagauacuugacuuaauauccgguaaugcucacggaaaagacguagacgcauuuauuagauuaacaguagaugacaugcucacagauacagaaagaagaauaaaacgauuuaaagaugacaggaaaucaauacgaucugcagauaacaaaaugggcaaacguggauucaaacagauuagcacugggaaauuagcagacuuccucgccaaagauauaguacuauuccagccaaguguuaacgauggagaaaauaaaaucacaggacuuaauuaucgaauaaugcaaagcgcaauagccguauacgacaguggagacgauuaugaagccaaacaacaauucaaauuaauguucgaaaaagccagauuaauagguaaagggacaacugaaccacauccauuucuauauaaaguauucgcaagaucgauaccagcaaaugcaguagauuuuuacgagagauauuugauugaaagaaaauucuaccuaacugguuuauguaacgaaauaaaacgaggaaacaggguagauguaccuuucauuaggagagaccagaacaaauggaagacacccgcaaugaagacacuaggacgaauauacagugaggaccucccaguagagcuaccuagacaaauguuugauaacgaaauaaaaagucaucucaaaaguuuaccgcaaauggaagguauagacuucaacaaugcaaacguaacauaccuaaucgcggaauauaugaaaagaguacuuaaugaugauuuucaaaccuuuuaucaauggaaaagaaauuaccauuacauggauauguuaaaaggggaauacgaccggaaagguagccuucaacauuguuucacaucuguagaagaaagagaagggcuauggaaagaaagagcuucuagaacagaaagauaucgcaaacucgccuccaacaaaauucguucaaacagacaaaugagaaacgcauccucagaagaaauagagacaauccuugacaaacgacuaaguaauugcagaaacgaauaucaaaaaagcgaaaaaguuaucagacgauauagaguccaggacgcacuauuauuuuuacuagccaaaaaaacacucacagaacuagcagauuucgauggagaacgauucaaauugaaagaaaucaugccagacgccgaaaaaggcauccuaagcgaaauaaugccaaugucauucacauucgaaaagggagggaaaaaauacacaauaacuagcgaagguaugaaacuaaaaaacuauggagauuucuucguacuagcaucagauaaaagaauaggaaacuuauuagaauuagugggcagcgauauaguaagcaaagaagacauaauggaagaauucaacaaauaugaccaauguagaccagagaucagcuccauaguauucaaccucgaaaaaugggccuuugauaccuacccagaacuaagugcacgaguggaccgagaggaaaagguggauuuuaaaaguaucuuaaaaauauuacugaauaacaaaaauaucaauaaagaacaaagugacauacuaagaaaaauaaggaacgcauucgaccacaauaacuacccggacaaagguauaguagaaauaaaagcacuaccggaaaucgcuaugucaaucaaaaaagccuuuggggaauaugcaauaaugaaauaa

SEQ ID NO: 11585 - RNA, 3273 nt, Artificial Sequence
  Cas13b variant__Prevotella sp.__WP_044074780.1__Cas13b
augaacauaccugccuuaguugaaaaccaaaagaaauacuucggcacguacucagucauggccauguuaaaugcccaaacaguuuuagaucacauccaaaaaguagcggauauagaaggagaacaaaacgaaaauaacgaaaaccuaugguuccauccuguaaugucacaccuauacaacgcgaaaaacggguaugacaaacaaccggagaaaacaauguucauaaucgaacgauuacaaucauacuucccauuucuaaaaauaauggcagaaaaccagagagaauacucaaaugguaaauacaaacaaaacagaguagaagugaacaguaacgacauauuugaaguauuaaaaagggcauucggcguauuaaaaauguauagagaccuaacaaaucauuacaaaacauaugaagaaaaacugauagacggcugugaauuucuaacaucuacagaacaaccauuuucuggaaugauuagcaaauauuacacgguagccuuacgaaauacuaaagaaagauauggauauaaagcagaagaccuggcauuuauucaagauaacagauacaaauucacgaaagaugcuuaugggaaaagaaaaagucaagucaacacaggauccuuucugagccuacaagauuauaauggagauacaacuaagaaacuacaccuaucaggcgucggaauagcccuccuaauaugccucuuucucgacaaacaauauauaaauuuauuucuuagucguuuaccuaucuuuucuucauauaaugcgcaaucagaagaaagacggauaaucaucagaucauucggaauaaauagcaucaaacagcccaaagaucgaauacacagcgaaaaaucaaacaaaucagucgcuauggacaugcuaaacgaagucaaaagaugccccgaugaacuauuuacaacacuaagugcagaaaaacaaaguagauuucggauuauaucagaugaucauaacgaaguacuaaugaaaagaucaucagacagguucgucccacuacuacugcaauacauagauuacggcaaauuauucgaucacauaagauuccauguaaacaugggaaaauuacgauauuuacuaaaagcagauaaaaccugcauugauggacaaacaagaguaagaguuauagagcaaccacucaacggauucggacgucuugaagaagucgagacuaugagaaaacaagagaacgggacauucgguaacucagguauacguaucagagauuucgaaaacaugaaaagagaugacgcaaauccagcaaauuauccauacauaguagaaacauacacccacuacauacucgaaaauaacaaaguagagauguucauaucagacgaagaaaauccaacaccgcuguuaccuguaauagaggacgauagguaugucguaaaaacaauaccaaguugucgaaugaguacuuuagagauuccagcuauggcauuccacauguucuuauucggaucagagaaaacagaaaaacuaauaaucgacguacacgauagauauaaaagacucuuucaggcgaugcaaaaagaagaaguaacagccgaaaauauagcuucauucggcauagcagaaucagaucucccucagaaaauaauggaccuaauuucuggcaaugcacauggaaaagacgucgaugcuuuuauccgauuaacaguagacgacaugcuaaccgauacagaaagaagaauaaaaagauucaaagacgaccggaaaucaauacgaucggcugauaauaaaaugggcaagagaggauucaaacaaauauccacaggaaaauuagcagacuuuuuagcaaaggacauaguauuauuccaaccuagcgugaaugauggugaaaauaaaaucacaggcuuaaauuacagaaucaugcaaagugcgauagcuguauacgacaguggagacgacuaugaagcgaaacaacaauucaaauuaauguuugaaaaagccagacucauaggaaaaggaacaacugaaccacauccuuuccucuauaaagucuucguaagaucaauaccagccaaugcaguagauuuuuacgaaagauaccuaaucgaacgcaaauucuacuugauaggacuauccaacgaaauuaagaaaggcaauagaguagacguaccauucauuagacgugaccaaaauaaauggaaaacaccagcuaugaaaacuuuagguagaaucuauucugaagacuuaccgguagagcuuccaagacaaauguucgauaacgaaaucaaaagucaccuaaaaucacugccucaaauggaaggcauagauuuuaauaacgcaaauguaacuuaucuaauugccgaauauaugaaacgaguauuaaacgacgauuuucaaaccuuuuaucaauggaaacgaaauuacagauacauggacaugcuaagaggagaauaugauagaaaaggaagucugcaacacugcuuuaccucuaucgaagaaagagaaggacuauggaaagaacgagcaucacgaaccgaaagauacagaaaacuugcguccaauaaaaucagauccaaccgacaaaugcguaaugcgagcagcgaagaaauagaaaccaucuuagacaaacgucuaucaaacugcagaaacgaauaccaaaaaucggagaaaauaaucaggcgauauagaguucaagaugcacuccuuuuucuguuagcaaagaaaacgcucacagaacucgcagauuuugacggcgaacgauucaaacuaaaagaaauaaugccugacgccgaaaaaggaaucuuaagugaaauuaugcccaugaguuucacuuuugaaaaaggaggaaaaauuuauacaauaacaaguggagggaugaaacucaaaaauuacggagauuucuucgucuuagcaagcgauaaaagaauaggaaacuuacuugagcuagucgggagcaacacggucucaaaagaagauauaauggaagaguucaagaaauaugaccaaugcagaccggaaauuucauccauagucuucaacuuggaaaaaugggcauucgauacauauccagaauuaccagcccgagucgauagaaaagaaaaagucgacuucuggucaauacuagacguacuaucgaacaacaaagacauaaacaacgaacaaaguuauauccuaagaaaaauaagaaaugcuuuugaccacaauaauuauccagauaaaggaauaguagaaauaaaagcgcucccagaaauagcuaugaguauaaagaaagccuuuggagaauaugcaauaaugaaauaa

SEQ ID NO: 11586 - RNA, 3438 nt, Artificial Sequence
  Cas13b variant__Psychroflexus torquis__WP_015024765.1__Cas13b
auggaaaguauaauuggacucggacuauccuucaacccauacaaaacagcugauaaacauuacuuuggaucauucuuaaaccucguagaaaacaaccugaacgcgguuuucgcugaguucaaagaacgaaucucauacaaagcaaaagaugaaaacauaucaagucuaauagaaaaacacuucauagacaacaugucaauaguagacuacgaaaagaaaauuuccauacuaaauggcuacuuaccaaucauagacuuccuagaugacgaacuagaaaacaauuuaaauacccgaguuaaaaacuuuaagaaaaauuuuauuauacuagcagaagcgauagaaaaacuucgagacuacuacacucacuucuaccacgaucccauaacauuugaagacaacaaagagcccuuacuagaacuauuagacgaaguacuacugaaaacaauacuagacguaaagaagaaauaccucaaaacagauaaaacaaaagagauccuaaaagacaguuuaagagaagaaauggaccuucuagugauacgaaaaaccgacgaacuaagagaaaagaagaaaacaaacccaaaaauacaacacaccgacuccagccaaauuaaaaauuccaucuucaaugacgcauuucaaggacuacucuaugaagacaaaggcaacaacaagaaaacccaaguuagccaucgagccaaaacaagauuaaauccaaaagauauccacaaacaagaggagagagacuuugaaauacccuuaucaacauccggacucguauucuuaaugagccuauucuuaucuaagaaagaaauagaagacuucaaaucaaacauaaaaggcuucaaaggaaaaguaguuaaagacgaaaaccacaacucauuaaaauauauggccacucauagagucuacucuauacucgccuuuaaaggacuaaaauaccgcauaaaaacggauacauuuuccaaagaaacccugaugaugcaaaugauagaugaacuaaguaaaguaccagacugcguauaccaaaaucucucugaaacuaaacaaaaagacuuuauagaagauuggaaugaauauuucaaagacaacgaagaaaacacagaaaaccucgaaaauucuagaguaguccauccuguuauaaggaaacgcuaugaagacaaauucaacuauuucgcaauacgauuucuagacgaguucgccaauuucaaaacauuaaaauuucaaguauuuaugggauauuacauacaugaccaaagaacaaaaacaaucggcaccacaaauaucacuacagaacgaacagucaaagagaaaauaaacgucuuuggaaaauuaucuaaaauggauaaccuaaagaaacacuuuuucagccaacuuuccgaugaugaaaauacugauugggaauuuuuccccaauccuucguacaacuuucuaacccaagcagacaacaguccagcuaacaacauuccaaucuaccuagaacuuaaaaaccaacagaucaucaaagaaaaagaugccauuaaagcagaaguaaaccaaacacaaaaucguaauccaaauaaaccaucuaagagagaccuauuaaauaaaauacucaaaacauacgaagauuuucaccaaggagacccaacagcaauacucucacucaacgaaauacccgcacuacuacauuuguuuuuggucaaaccuaacaauaaaacaggacagcaaauagaaaacaucauaagaaucaaaaucgaaaaacaauuuaaagcaauuaaccaccccaguaaaaauaauaaaggaauaccaaagucacucuucgcugacaccaauguacguguaaaugcaauaaaacuaaagaaagaccuagaagcagaauuagauaugcuaaauaagaaacauaucgcuuuuaaagaaaaccagaaagcaagcucaaacuacgacaaacucuuaaaagaacaccaauucacacccaaaaacaaaagaccagaacugagaaaauauguauuuuacaaaagcgaaaaaggugaagaagcaacuuggcuagcuaacgauauaaaacgauuuaugcccaaggacuucaaaacuaaauggaaaggcugccagcacagcgaacuccaaagaaaacuagcauucuacgaucgccacacaaaacaagauauaaaagaacuauuaagugguugugaguucgaccauucccuucuagauauuaacgcauacuuucaaaaagacaauuucgaagacuucuucucaaaauacuuagaaaauagaaucgaaacauuagaagguguucucaagaaauuacacgauuucaaaaacgaaccaacuccacucaaaggagucuucaaaaauugcuucaaauuccuaaaaagacaaaacuacgucacugaaucaccugaaauaaucaagaaaagaauacuugcaaaaccaacauuuuuaccuagagggguuuucgacgaaagacccaccaugaagaaagguaaaaauccccucaaagauaaaaaugaauuugcagaaugguuugucgaauaucuagaaaacaaagauuaucagaaauucuacaacgcagaagaauauagaaugcgcgacgcagacuucaagaaaaacgccgucauaaagaaacaaaaacugaaagacuucuacacccuacagaugguaaacuaucucuuaaaagaaguauuuggaaaagaugaaaugaaccuacaacucagugaauuauuucaaacaagacaagaaagacuaaaacuacaaggaauagcaaagaaacagaugaauaaagaaacaggugacaguagcgaaaauacaagaaaccaaaccuacauauggaacaaagacguuccuguaucauuuuucaacggaaaaguaacaauugauaaaguaaaacucaaaaauauaggaaaauacaagagguacgaaagagacgaacgaguaaaaacauucauuggguaugaagucgacgaaaaauggaugauguacuuaccccauaauuggaaagaccguuacagcgucaaaccuaucaacguaauagauuuacagauacaagaauaugaagaaauuagaucccaugaacuccuaaaggaaauucaaaaccuugaacaauacauauacgaccacacaaccgauaaaaacauccuuuuacaagaugggaauccaaacuucaaaauguacguucucaacgguuuacucauaggaauaaaacaagucaauauucccgauuucauaguacugaaacaaaacacaaacuucgacaaaauugacuuuacaggaauugccagcugcucagaacuagaaaagaaaacuauuauccugauagcaauaagaaacaaauuugcucacaaucaauuaccaaacaaaaugauuuaugaucuggcuaacgaauuucugaaaauagagaaaaacgaaacuuaugcaaacuacuaccuaaaaguccuaaagaaaaugaucucugaucuagcauga

SEQ ID NO: 11587 - RNA, 2847 nt, Artificial Sequence
  Cas13b variant__Riemerella anatipestifer__WP_049354263.1__Cas13b
auguucuuuucuuuucacaacgcucaacguguaaucuuuaaacaucuauacaaagccuuugacgcuucucugagaaugguuaaagaagauuacaaagcacacuucacaguuaaccuaaccagagauuucgcccaccuuaaccgcaaagguaaaaacaaacaagauaacccugacuucaacagauauagauuugaaaaagacggauucuuuacggaaucaggacuauuauucuucacaaaccuauuucuagacaaacgggacgccuacuggauguuaaagaaaguuuccgguuuuaaagccucacacaaacaaagagagaaaaugacaacugaaguauuuugcagaucaagaauacuucuuccaaaauuacgucuagaaucaagauaugaucauaaccaaaugcuacuugacauguuaagcgaacucucacguugcccgaaacucuuauacgaaaaacucucagaagaaaacaagaaacauuuucaggucgaagcagacggauucuuagaugagauagaagaagaacaaaauccauucaaagacacacuuauacgucaucaagacagauuuccauacuucgcacuaagauaccuagaccucaacgaaucauuuaaaagcauaagauuccaaguugauuuaggcacauaucauuauugcauauaugauaagaaaauaggagacgagcaagaaaaacgacaccucaccagaacacuacuauccuucggcagacuccaagacuucacagaaauuaacagaccucaagaauggaaagcccucaccaaagacuuagacuauaaagagacaaguaaccaacccuucauuagcaaaacuaccccgcacuaucacauaaccgacaacaaaaucgguuuuagacuaggcacuucuaaagaacuuuauccaucacuagaaauaaaagacggcgcaaacagaaucgcaaaauacccuuauaacucuggcuuuguugcacacgcauucauaucaguccaugagcuacuaccucuuauguucuaucaacaucucacuggcaaaucagaagaucuucuaaaagaaacugucagacacauacaacgcauauauaaagauuucgaagaagaacgaauaaacacaauagaagacuuagagaaagcaaaccaaggccgcuuaccacuaggcgccuucccaaaacaaaugcuaggauugcuacaaaacaaacaaccagacuuauccgaaaaagcaaaaauaaaaauugaaaaauuaaucgcugaaacaaaauuauuaucacacagauuaaacacaaaauuaaaaagcagccccaaacuaggcaaacgcagagaaaaacuuauaaaaacaggaguacucgccgacuggcuaguaaaagacuucaugcgauuucagccuguugcuuacgaugcucagaaucaacccauaaaauccucaaaagccaauuccaccgaguucugguuuaucagacgagcauuagcgcuauacggaggcgagaaaaacagauuagaaggauacuucaaacaaacaaacuuaaucgguaacaccaacccgcaucccuuuuuaaacaaauucaauuggaaagcaugccgaaaccucguagacuucuaccaacaauaccuagaacaacgagaaaaauuuuuggaagcaauuaaaaaccaaccuugggaaccuuaucaauacugcuuacuacuaaaaauacccaaagaaaauagaaagaaccuagugaaaggaugggaacaaggaggcauaucacuucccagaggauuauucacagaagcaauccgagaaacuuuguccgaagaccuaaugcuaucaaaaccaaucagaaaagaaauuaagaaacauggaaggguaggcuucauaagucgcgcuauuacauuauauuucaaagaaaaauaucaagauaaacaccaaaguuuuuauaaucuaucauauaaacuagaagcuaaagcaccccuucucaaaagagaagaacauuaugaauacuggcaacaaaacaaaccccaauccccaaccgaaucccaaagacucgaacuccacacuuccgaccgauggaaagauuaucuacuauauaaaagauggcaacaccucgaaaagaaacuucgacuuuacagaaaucaagacguaaugcuguggcucaugacacucgaacucaccaaaaaucacuuuaaagaauuaaauuuaaauuaccaucaacuuaaacuagaaaaucuagcaguaaacguucaagaagccgaugcaaaauuaaauccuuuaaaucaaacacuaccaaugguacuuccaguaaaaguauacccagcuacagccuuuggagaaguccaauaccauaaaacaccaauacgaaccguauacauaagagaagaacacacaaaagcacuaaaaauggguaacuuuaaagcauugguuaaagauagacgauuaaauggccuauuuuccuucaucaaagaagagaacgauacccaaaaacacccgauaagucaauuacgauuaagacgggaauuagaaauauaccaaagccuacgagucgacgcauucaaagaaacacuuagucuagaagaaaaauuacuuaauaaacacacaucacucucaucccuugaaaacgaguucagagcgcuacucgaagaauggaagaaagaauacgcugccagcaguaugguaacagacgaacacauagcguucaucgcaucuguacgaaaugcauucugccauaaucaauacccauuuuacaaagaggcacuccacgccccaauaccccucuucacugucgcacaaccaacaaccgaagaaaaagacggccuuggaaucgccgaggcacuacuaaaaguacuaagagaauauugcgaaauaguaaaaagucagauauaa

SEQ ID NO: 11588 - RNA, 3288 nt, Artificial Sequence
  Cas13b variant__Riemerella anatipestifer__WP_004919755.1__Cas13b
auggaaaaaccucuauuaccuaauguuuauacacucaaacacaaauuuuucuggggagccuuccuuaauauagcgcgccacaacgcauucauaaccauaugccacauuaaugaacaacuuggacuaaaaacccccuccaaugacgacaaaauaguugauguuguuugcgaaacuuggaauaacauacuaaauaacgaccacgaccuccuaaagaaaucccaacuaacugaacuaauacucaaacauuuuccauucuuaacugcaaugugcuaccaucccccaaagaaagaaggcaagaagaaaggacaccaaaaagaacaacaaaaagaaaaagaaagugaagcacagucacaagccgaagcacuuaacccauccaaacuuaucgaggcacuagaaaucuuaguaaaucaacugcacagcuuaagaaauuacuacucucauuacaaacauaagaaaccagacgcagagaaagacauuuucaaacaccucuacaaggcuuucgaugccucccuaagaauggucaaagaagacuacaaagcacacuucacaguuaauuuaacaagagauuucgcacauuuaaaccgaaaaggcaaaaacaaacaagauaaucccgacuucaauagauauagauucgaaaaagauggauucuucacagaaucaggacuacuauucuuuacgaaucuuuuucucgacaaaagagaugcauacuggaugcuuaagaaaguuucaggauucaaagcaagccacaaacaaagagagaaaaugaccaccgaagucuuuugucgaagcagaauacuccuaccaaaacuuagacuagaaucccguuacgaccauaaccaaauguuacuagacaugcucuccgaacucagcagaugucccaaauuacuauacgaaaaacuaucagaagaaaacaagaaacauuuccaaguagaagcagacggauuucuagacgaaauagaagaagaacaaaacccauuuaaagauacacuaauucgacaccaggauagauuccccuauuuugcucuccgauaccuugacuuaaaugaaaguuuuaaaucaaucagauuccaagucgaccuaggaaccuaucacuacuguaucuacgacaagaaaauaggagacgaacaagagaaaagacaccuaaccaggacacuacucucuuucggacgacugcaagacuuuaccgaaauaaaccgcccccaagaauggaaagcauuaacgaaagaccuagauuauaaagaaacuucaaaucaaccauuuauaagcaaaacaacaccacacuaucauauaacugacaauaaaauuggauuucgacuaggcacaucuaaagaacuauacccaaguuuagaaauaaaagauggcgcaaacagaauagcaaaauaccccuauaauucaggauucguagcccacgccuucauaucaguucaugaacucuuaccccuuauguuuuaccaacaccuaacaggcaaaucagaagaccuccuaaaagagacuguccgacacauacaaagaaucuauaaagauuucgaagaagaacgaauaaauacuaucgaagaccucgaaaaagcuaaccaaggcagacuaccauuaggagcuuucccaaaacaaauguuaggacuacuacaaaauaaacaaccugauuuaucggaaaaagccaaaaucaaaaucgaaaaacuaauagcggaaacaaaacuacuaucacaccguuuaaacacaaaacuaaaaucaucuccaaaacuagguaaaagacgagaaaaacuaauaaaaacaggaguacuugccgauuggcuaguaaaagacuucaugagauuucaaccaguagcauaugaugcacaaaaccaaccaauuaaaucaucaaaagcuaacucaacugaauuuugguucauccgcagagcauuagcacuauauggaggagagaaaaauagacuagaaggcuacuucaagcaaacaaaccugaucggaaacacaaauccacacccuuucuugaauaaauuuaauuggaaagcguguagaaauuuagucgacuucuaccaacaauaccuagaacaaagagaaaaauuccuagaagccaucaaaaaccaaccaugggagccuuaucaauauuguuuacucuuaaaaauaccuaaagaaaaucgcaaaaauuuaguaaaaggaugggaacaaggaggcauaucccuaccccgcggucucuucaccgaagcaauacgcgaaacgcuauccgaagaucuuauguuaucaaaaccaauccguaaagaaaucaagaaacacggacgagugggcuucauaucaagagcuaucacguuauacuucaaagaaaaauaccaagacaaacaccaaaguuuuuauaaccuaaguuacaaacuagaagcuaaagcuccccuacuuaaaagagaagaacacuacgaauacuggcaacaaaacaaaccacaaagcccuacagagucacaaagacuagaacuccauaccucagacagguggaaagacuaccuguuauauaaacgguggcaacacuuggaaaagaaacuacgucuauauagaaaucaagaugucaugcucuggcucaugacucuagagcucacuaaaaaccauuuuaaagaauuaaaucuaaacuaucaccaacuaaaauuagaaaauuuagccgucaauguucaagaagcagacgccaaacucaacccuuuaaaucaaacauuacccauggucuuaccggucaaaguauaccccgccacagcauucggugaaguacaauaccacaaaacaccuauaagaaccguuuacauccgagaagaacauacaaaagcauuaaaaauggggaacuucaaagcauuaguaaaagaucgaagauugaacggacuauucaguuuuauaaaagaagaaaaugacacccaaaaacauccuauaucacaauuacgacuacgccgagaauuagaaauauaccaaucacuaagaguagacgcauucaaggaaacacuuuccuuagaggaaaagcuacugaauaaacacacaucauuauccucacucgaaaacgaguuccgagcucuacuugaagaauggaagaaagaauacgcagcuucaagcauggucacagaugaacacauagccuuuauagcuucgguccgcaacgcauucugucacaaccaauacccauucuacaaagaagccuuacacgcaccaauaccccuauuuacaguagcccagccuacaaccgaagaaaaagacggacuuggaauagcagaagcauuacucaaaguacuaagggaauacugugaaaucguaaaaucccagauauaa

SEQ ID NO: 11589 - RNA, 3288 nt, Artificial Sequence
  Cas13b variant__Riemerella anatipestifer__WP_064970887.1__Cas13b
auggaaaaacccuuacccccaaacguauauacacuuaaacacaaauuuuuuuggggggcauuucuaaauauagcacgucacaaugccuucauaacaauaugucacaucaacgagcaacuaggacuuacaacaccuccaaacgacgacaaaauagcugacguaguaugugguaccuggaacaauauacuuaacaacgaccaugacuugcuuaaaaaaucccaacuaacagaauuaauucuaaaacacuucccauuccuagcagcaauguguuaccauccaccuaaaaaagaaggaaaaaaaaaaggcagccagaaagaacaacaaaaagaaaaggaaaaugaggcacaaucacaagccgaagcccuuaaucccagcgaauuaauaaaaguacuuaaaacacuagucaaacaacuacgcacauuaagaaacuacuauucccaccauagccauaaaaaaccagaugcugaaaaggacaucuucaaacaccuauacaaagcauucgacgcuucucuacguaugguaaaagaagacuacaaagcacacuucacaguaaacuuaacucaagacuuugcacaucuuaauagaaaagguaaaaauaaacaagauaauccagacuuugaccgauacagauuugaaaaagauggguucuuuacagagucuggucuccuuuuuuucacaaaucuuuuccuagauaaacgugaugcauacuggaugcucaaaaaaguuuccggcuucaaagccucacacaaacaaagcgaaaaaaugacaacagaaguuuucuguagauccagaauacuuuuaccuaaacuacgauuggaaucacguuacgaccacaaucaaaugcuauuggauauguuaucggaacucucaagauacccaaaacuauuauaugaaaaguuaucagaagaagauaagaaaagauuucaaguugaagccgacggauuccuagaugaaaucgaagaagaacagaacccauuuaaagauacccuaauaagacaucaagauagguucccauacuuugcacuuagauacuuagaccuuaacgaaucauucaaaaguauaagauuucaagucgaucuagguacuuaccacuauuguauauacgauaagaaaaucggagacgaacaagagaagagacaucucacccggacacuauuauccuucggucgucuacaagauuucacugaaauaaaccgcccucaagaauggaaagcucuuacaaaagaucuugacuacaaagaaacuucaaaacaaccuuucauauccaaaaccacaccacacuaccacaucacugauaacaaaauugguuucagacuaggaacuucaaaagaacuauacccaucacuagagguaaaagacggugcuaacagaauagcgcaauacccuuacaauuccgacuuuguagcccaugcauucauaaguguccaugaacuccuaccuuuaauguuuuaccaacaucuaaccggcaaaucugaagaccucuuaaaagaaacaguacgccauauccaaagaauauauaaagacuuugaagaagaacgaauaaacacaauagaagaucuagaaaaagcaaaucaaggccgacuaccguuaggcgccuuuccuaaacaaauguuagguuuacuucaaaacaaacaacccgaccuaagugaaaaagcuaaaauuaaaauagagaaauuaauagcugaaacaaaacuauuaucacaucgacuuaacaccaagcuuaaaucaucgcccaaauuaggcaaaagacgcgaaaaauuaauuaagacuggaguauuagcagacuggcuagucaaagauuuuaugcgcuuccaaccggucgcauaugaugcccaaaaucaaccaaucgaaagcagcaaagcaaacucaacagaauuucaacuaauacaaagggcacuagcauuauacggaggagaaaaaaaucgacuagaaggcuacuucaaacaaacaaaucuaauaggaaauacuaacccacauccuuuuuuaaacaaauucaacuggaaagcaugucgaaacuuggucgacuuuuaucagcaauaccuugaacaacgugaaaaauuucuugaagcaauaaaaaaucaacccugggaaccauaucaauacugcuuauuacuaaaaauaccuaaggaaaauagaaaaaacuuagucaaagguugggaacaagggggcaucucucuaccaagaggauuauucacagaagcuauacgggaaacauuaagcaaagaccucacucuaucaaaaccaauucgaaaagaaaucaaaaaacacgguagaguaggcuucauaaguagagcgauaacucuauauuucagagaaaaauaccaagacgaccaccaaagcuucuacgaccucccauacaaacuggaagccaaagcuaguccucuuccaaaaaaagaacauuacgaauauuggcaacaaaauaaaccacaaucuccuaccgaauuacaaagacuagaacuccacaccuccgacagauggaaagauuauuuacucuacaaacguuggcaacaucucgaaaaaaaauuacgccuauaucgcaaucaagauguaaugcuuugguuaaugacacucgaacuaacaaaaaaucauuucaaagaauuaaaucucaauuaccaccaauuaaaacuagaaaacuuagcaguuaauguccaagaagcugacgcuaaacuaaauccacucaaccaaacacuacccaugguacuaccagucaaaguguauccugcaacagcguucggugaaguacaauaccaagagacaccuaucaggaccgucuauauaagagaagaacaaacuaaagcuuuaaaaaugggaaacuucaaagcacucgucaaagaucguagauuaaacggacucuuuuccuucauaaaggaagaaaacgacacccaaaagcaccccauaucccaacuacgccuaagaagagaacuagaaauauaucaaucacucagaguagacgcauuuaaagaaacucuaaacuuagaagaaaaacuucucaaaaaacauacaaguuuauccucaguagagaauaaauuuagaauucuacucgaagaauggaaaaaagaguaugccgcaucuucaaugguaacagacgaacacaucgcauucauugccucaguacgcaacgcauuuugccauaaucaauauccauucuacgaagaagcacuacacgcaccuauaccucuuuucacaguagcccaacaaacuacagaggaaaaagauggucuggguauugcagaagcccucuuacgcguccuuagagaauacugugaaauaguuaaaucgcaaauauag

SEQ ID NO: 11590 - RNA, 2853 nt, Artificial Sequence
  Cas13b variant__Riemerella anatipestifer__WP_061710138.1__Cas13b
auguucuucucauuccacaacgcucaaagaguaauauuuaaacaccuuuacaaggcuuucgacgcaagucuccgaaugguaaaagaagacuauaaagcacacuuuaccgugaaccuaacuagagauuuugcacaucuuaaccggaaagguaaaaauaaacaagauaauccagacuucaacagauaccguuuugaaaaagauggauucuuuacagaaucaggcuuacuauucuuuacaaaccuauuuuuagauaagcgagaugcguacuggaugcuuaagaaaguaucaggauucaaagccagccacaaacaaucagagaaaaugacuacagaagucuuuuguagaucaagaauauuacuacccaaacuuagauuagaaucuagauaugaucacaaccaaaugcucuuagacauguuaagcgaacuaucucgauguccaaaacuucucuacgaaaaauuaucagaaaaagauaagaaaugcuuccaagucgaagcagacggauuuuuagaugaaauugaagaagaacaaaaccccuucaaagacacacuuaucagacaucaagaccgauuuccuuacuucgcacuaagauaucucgacuuaaaugaaucauuuaaaagcaucagauuucaaguggaccucggaaccuaccacuauuguaucuaugauaagaaaauagguuacgaacaagaaaaacgacaucuaacccgcacacuacuaaacuucggaagacuacaagacuucacagaaauuaauagaccacaagaauggaaagcacuaaccaaagaccuugacuauaacgaaacuuccaaucaaccuuucauaagcaaaacaaccccacacuaccauaucacggacaauaaaaucgguuuccgcuuaagaaccucaaaagaacuuuaucccagucucgaaguaaaagacggugccaauagaauagcaaaauacccauacaauagcgacuuuguagcccaugcuuucauuucaauuagcguacacgaacucuuaccauuaauguuuuaucaacaucuaacuggaaaaucugaagaccuucucaaagaaacugucagacacauccaaagaaucuacaaagauuucgaagaagaacgaauaaauacuaucgaagacuuagaaaaagcaaaccaaggucgacugccuuuaggagcauuuccgaaacaaaugcuagggcuucuacaaaauaaacaaccagaccuaucggaaaaggccaaaauaaaaaucgaaaaauuaauagcugaaacaaaacugcuuucccaccgacuaaacaccaaacuuaaauccagucccaaauuagguaaacgaagagaaaaacuuauaaaaacaggaguacuagcagacuggcucguaaaagacuucaugagauuucaaccagucguauacgacgcccagaaucaaccuaucaaauccagcaaagccaauagcaccgaaucccgccuaauccgcagagcccuagcauuauauggaggugagaaaaacagacucgaaggauacuuuaaacaaacaaaccuuaucggaaacacuaacccucauccauucuuaaauaaauuuaacuggaaagcauguagaaaucucguagacuucuaucaacaauaucuagaacaaagagaaaaauuucucgaagccauuaaacaccaaccaugggaaccauaccaauacugcuuauuauuaaaaguaccaaaagaaaaucggaaaaaccuaguaaaaggcugggaacaaggaggcauaucauuaccacgcggauuauucacugaagccauacgagaaacccuauccaaagauuuaacucuauccaaaccaaucagaaaagaaaucaaaaagcacggacgaguuggauucauaaguagagcaauuacgcucuauuucaaagaaaaauaccaagacaaacaucaaucauuuuauaaccucagcuauaaauuagaagcaaaagccccauuacucaagaaagaagaacacuaugaauacuggcaacaaaacaaaccccaaucaccaacggagagccaaagguuagaauuacauaccagcgaucgauggaaagacuacuuacuauauaaaagauggcaacacuuagaaaagaaacucagauuauauagaaaccaagacauaaugcuauggcuuaugacauuagaauuaacuaaaaaccacuuuaaagaacuuaaucuaaacuaucaccaacuuaaacuugaaaaucucgccguaaauguccaggaagcagacgccaaauuaaauccauuaaaucaaacacucccuaugguccucccaguaaaaguauacccaaccacugcguucggagagguacaguaccaugaaacaccuauucgaaccgucuacauccgcgaagaacagaccaaagcauuaaaaaugggaaacuucaaagcauuaguaaaagaucgacaucuuaacggccucuucucuuucauaaaagaagaaaacgauacacaaaaacacccaauaucacaacuacgccuaagacgagaacucgaaaucuaccaauccuuaagaguggacgcauucaaagaaacacuaagccuagaagaaaaacuacuuaauaaacaugcaaguuuaucaagucuagagaacgaguucagaacacuacuugaagaauggaagaagaaauacgccgccucaucaaugguaacagauaaacacauagccuucaucgccucaguucgaaacgcauuuugucacaaucaauacccauuuuauaaagaaacccuacaugccccaauccuacucuucacuguagcacaaccuaccacagaagaaaaagauggcuuaggaauagcagaagcauuauuacgcguguuaagagaauauugcgaaauagucaaaucacaaauauaa

SEQ ID NO: 11591 - RNA, 2850 nt, Artificial Sequence
  ARMAN Cas9 variant__Candidatus Micrarchaeum acidiphilum__OJI07263.1__Cas9
augagagacucaauaacagcuccuagauauagcucagcacuagcagcacgaauuaaagaguucaacagugccuucaaauuagguauugaccuaggaacgaaaacuggagggguagccuuaguaaaagauaacaagguuuuacuagcaaaaacauuccuagacuaccauaaacaaacauuagaagaacgcagaauacauagaagaaaccgacgaucacgauuagcaagaagaaaaagaauagccagacuaagaaguuggauucuaagacaaaagauauacggaaaacaauugccagacccauauaaaauuaagaaaaugcaacuaccuaacggaguucguaaaggugaaaauuggauagaucuaguaguaucaggaagagaccuaucaccugaagcauucguaagagcaaucacccuaauauuccaaaaacgaggacaacgauaugaagaaguagcaaaagaaauugaagaaaugucauacaaagaauuuucaacucacauaaaagcacuaacaucagucacagaagaagaauuuacugcauuagcagcagaaauagaaagaagacaagaugucgucgacacagauaaagaagcagaacgguacacucaacucagcgaacuauuaucaaaaguaucagaaaguaaaagcgaauccaaagaccgcgcacaaaggaaagaagaucucgguaaagucguaaacgcauucuguagugcacacagaauagaagacaaagauaaauggugcaaagaacuuaugaaacuacuugaucgaccaguuagacaugcccgcuuuuuaaauaaagucuuaauaagaugcaacauaugugaucgagcuacuccaaagaaaucacguccagacgugagagaauuauuauacuucgauaccgucagaaacuucuuaaaagcaggucgugucgaacaaaauccagacguuauaucguacuacaagaaaauuuacauggacgccgaaguaauuagaguaaaaauacuaaauaaagaaaaacugacugaugaggacaagaaacaaaaacgaaaacuugcaagugaacuaaauagauauaaaaauaaagaguacgucacagacgcacaaaagaaaaugcaagaacaauuaaaaacacuacucuuuaugaaauugaccgggagaaguagauacuguauggcacaccuaaaagaaagagcagcagguaaagacgucgaagaaggucuucauggaguuguacagaaaagacacgaccgaaacauagcacaacgaaaucacgaccuaagaguaauaaaccugauagaauccuuacuauuugaucaaaauaaaucucuauccgacgccauaaggaaaaauggacuaauguacguuacuauagaagcaccugaaccaaaaacaaaacaugcaaagaaaggagcagcuguuguaagagacccaagaaaauuaaaagaaaaacuauucgaugaucaaaacggagucugcauauauacagggcuccaacuagauaaacucgagauaucgaaauacgaaaaagaccacaucuuccccgacucccgcgauggaccaaguauaagggacaaucuaguacugacaacaaaagaaauaaacagcgauaaaggagauaggacuccaugggaauggaugcacgauaaccccgaaaaauggaaggcuuucgaaagaagaguagcagaauuuuauaagaaaggaagaauaaaugaaagaaaaagggaauuauuacuaaauaaaggaacagaauaccccggcgauaaccccaccgaauuagccaggggaggagccagaguaaauaauuucauaacagaauuuaacgaccggcuaaaaacacacggaguccaagaauugcaaacaaucuucgaacgaaacaaacccauaguacaaguuguuagaggugaggaaacucaaagacugagacgacaauggaacgcguuaaaucaaaacuucauaccacuaaaagacagagcuaugagcuuuaaucaugccgaggaugcugccauagcagcaucuaugccacccaaauucuggagagaacaaauauaccgaacagcuuggcacuuuggcccaucuggaaaugaaagacccgacuuugcccuggcagaauuggcaccccaauggaacgacuuuuucaugacaaaaggcggaccgaucauugccguacuagggaaaacaaaauacucauggaaacacucaauaauugaugacacaauauauaaaccauuuaguaaaagcgcauauuauguuggaauauauaagaaaccaaaugcaaucacaaguaaugcaauaaaaguccuacgaccaaaacuacucaacggggaacauacaaugucuaaaaacgcuaaauauuaccaucagaaaauaggaaacgaacgauuccuuaugaaaucacaaaaaggaggaagcauaauaacaguaaaaccacaugacgguccagaaaaaguccuucaaauaucgccaacguaugaaugcgccgucuugacgaaacaugacggaaaaauaauuguaaaauucaaaccaauuaaacccuuacgcgauauguacgcccgagguguaauaaaagcaauggacaaagaauuagaaaccagccuaaguaguaugagcaaacacgcaaaauacaaagaauuacauacucaugauauaauauacuuaccagcaacuaaaaagcaugucgacggauacuuuauuauaacuaaacugucugccaaacacggcauaaaagcauuaccagaauccauggugaaaguaaaauauacccaaauagggagugaaaacaacagugaagucaaauuaacaaaaccaaaaccugaaauuacacuagacucagaagacauuacaaacauauacaacuuuacuagauaa

SEQ ID NO: 11592 - RNA, 2904 nt, Artificial Sequence
  ARMAN Cas9 variant__Candidatus Parvarchaeum acidiphilum__APG80630.1__Cas9
augcuagguuccucgcgauaucugagauacaaccuaacuuccuucgaaggcaaagaaccauuccuaauaaugggauacuauaaagaauacaauaaagaauuaucauccaaagcacaaaaagaguucaacgaccaaauuucagaauuuaacucguacuauaaacuaggcauagacuugggcgacaaaacaggaauagccauaguaaaaggaaauaaaauaauacuagcuaaaacauuaauagaccuacacagucaaaaacuagauaaaagaagagaagccagaagaaauagaagaacacgauuaaguaggaagaaaagacuagcacgguuacgaaguuggguaaugaggcaaaaaguuggaaaccaaagauugccagacccuuauaaaauaaugcacgacaacaaauauuggucaaucuauaauaaaaguaacagugcuaauaagaaaaacuggauugauuuacuaauccauucaaauagcuuaucugcagacgauuucguaagaggacuaacaauuauauuccgaaaacgcggauaccuagcguuuaaauaucuaagcagauuaucagacaaagaauuugaaaaauauauagauaauuuaaaaccaccaauuaguaaauacgaauacgacgaagacuuagaagaauuaucaagcagaguagaaaacggcgaaaucgaagagaagaaauuugaaggucucaaaaauaaacuagauaaaauagacaaagaaagcaaagauuuucaaguaaaacaaagagaagaaguaaagaaagaacuugaagaucuagucgaccuauuugccaaaucaguggacaauaaaauugauaaagcgcguuggaaaagagaauuaaauaaccuacuagacaagaaaguuagaaaaauaagguucgacaauagauucauacucaaaugcaaaauaaaaggaugcaacaaaaauacuccuaagaaagaaaaaguaagagauuucgaacuaaaaauggucuuaaacaacgcaagaagugacuaccaaaucagcgacgaagaucuaaauuccuucagaaaugaagucauaaauauauuccaaaagaaagaaaaucucaagaaaggugaacuaaaaggaguaacaauugaagauuuaagaaaacaacugaauaaaacguucaacaaagcaaaaaucaagaaagguauaagagaacaaauaagauccauaguauucgagaaaauaucaggcaggucgaaauucuguaaagaacaccugaaagaguucagugaaaaacccgcuccaucugacagaauaaacuacggcguaaacucagccagagaacaacaugacuucagaguacuaaacuuuauagacaagaaaauauucaaagacaaacuaauagacccaagcaaacuacgauacauuacaauagaaucuccagaaccugaaaccgaaaaauuagaaaaagggcaaauaucagaaaaaucauuugaaacccuaaaagaaaaacuagcaaaagaaacaggagguauagauauauacacaggagaaaaacuaaagaaagauuucgaaauagaacacauauucccacgagcaagaaugggcccaagcaucagagaaaaugaaguagcaaguaaucuagaaaccaacaaagaaaaagcggacagaaccccgugggaaugguuuggccaagaugagaaaagauggucagaguucgagaaaagaguaaacagccuauauagcaaaaagaaaauauccgaaagaaaacgagaaauacuacuaaacaaaucaaacgaauaccccggacuaaacccaacagaacuaucaagaauaccaucuacccuaucagacuucguagaaaguauaagaaaaauguucguaaaauacggcuacgaagaaccacaaacauuaguacaaaaagguaaaccaaucauacaaguaguaagaggacgagauacacaagcacuuagauggagauggcacgcauuagauaguaauauaauacccgaaaaagacagaaaaaguucauucaaccaugcagaagacgccgucauagcagcauguaugcccccauauuaccuuagacagaaaaucuucagagaagaagcaaaaauaaaaagaaaagucucaaauaaagaaaaagaaguaaccagaccagacaugccuaccaagaaaauugcacccaacuggucagaguucaugaaaaccagaaacgaaccuguaauugaaguaaucggaaaagugaaaccaucuuggaaaaacaguauaauggaucaaaccuucuacaaauauuuacugaaaccauucaaagauaaccuaauaaaaauaccaaacgugaaaaauacauauaaauggauagggguaaacggccaaacagacagucuaucacuaccaaguaaaguauuaagcauaucaaacaagaaaguagacaguucaaccguacucuuaguccaugauaagaaaggaggcaaaagaaacuggguaccaaaaucgauuggaggucucuugguuuacauuacaccgaaagauggacccaaaagaauaguacaaguuaaaccagcaacgcaaggauuacuaauauaccguaaugaagacgguagagucgaugcuguuagagaauuuauaaacccaguaaucgaaauguauaacaacggcaaauuagcguuuguagaaaaggaaaaugaagaagaacuacuaaaauacuuuaaucuuuuagaaaaaggacaaaaguuugagagaauacgcagauacgacaugauaacauacaauucaaaauuuuauuaugucaccaaaauuaacaaaaaccaccgagucacaauacaagaagaaucaaaaauaaaagcagaaucugacaaagugaaauccaguucaggaaaagaauacacaagaaaagaaaccgaagaacuaagccugcaaaaguuagcagaauuaauauccauauaa

SEQ ID NO: 11593 - RNA, 2850 nt, Artificial Sequence
  ARMAN Cas9 variant__Candidatus Micrarchaeum sp.__OJT94500.1__Cas9
augcgagacucgauuacagcuccuagauacucuucugcucuagcagcaaggauaaaagaguucaacagcgcguuuaaauuaggaauugacuuaggaacaaaaacaggaggaguagcgcucguaaaagacaacaaaguacuacucgcaaaaacauuccucgauuaucauaagcaaaccuuagaagaacgaaggauucacagacgaaacagacgaagcaggcuagcccgccgaaaaagaauagcacgcuuaaggucauggauacuccgccagaaaauauacgguaaacaauuaccagacccuuacaaaauaaagaaaaugcaacuaccaaacggcguccgcaaaggagagaacuggauagaucuagucgucaguggacgagaucuaaguccagaagccuuuguaagggcaauaacacuaauauuucagaaaagaggacaaagauaugaagaagucgcaaaagaaauagaagaaauguccuauaaagaauuuucaacucacauuaaagcucuaacuucaguaacagaagaagaguucacagcacuagcagcagaaauugaacgaagacaagacgucguagauaccgauaaagaagcagaaagauacacgcaacucagugaauuacuaucgaaaguaagugaaaguaaaucagaaaguaaagauagagcacaaagaaaagaggaccugggcaaagucguaaacgcauucugcucggcacaccgaaucgaagacaaagauaaaugguguaaagaacuaaugaaauuacuagaucgacccguaagacacgcaagauuuuuaaacaaaguacuaauaagaugcaauauaugcgauagggcaacaccaaagaaaucucgaccugauguaagagaacuuuuauacuuugauacuguucgaaacuuccuuaaagcaggcagaguagaacaaaacccagauguuauuuccuauuauaagaaaauauacauggaugcugaaguaauacgaguaaaaauacuaaauaaagaaaaacuuacagaugaagacaagaaacaaaaacgcaaacuagccagcgaauugaacagauacaaaaacaaagaguaugucacugacgcacaaaagaaaaugcaagaacaacuaaaaacacuccuuuucaugaaacuuacgggaagaucaagauauuguauggcacaccuaaaagaaagagccgcagguaaagauguagaagaaggccuacacggagugguacaaaaacgacacgauagaaacauagcccaaagaaaucacgaccuucguguaauaaaccugauagaaucuuuacuauuugacccaaauaaaucacuuucagaugccauacggaaaaacggacuaauguauguuacuauagaagcacccgaaccaaaaacuaaacaugcaaagaaaggagcagcaguagugagagaucccaggaaacucaaagaaaaauuauucgacgaucaaaauggagucugcauauacacaggauuacaauuagauaaauuagaaauaucgaaauacgaaaaagaucacauauuuccugacaguagagauggaccaagcauaagagacaaccuaguacuaacuacuaaggaaauaaacucagacaagggcgacagaacuccuugggaauggaugcacgacaauccagaaaaauggaaagcauucgaacgaagagucgcagaguucuauaagaaaggaagaauuaacgaaaggaaacgcgaauuacuacuuaauaaaggaacugaauauccuggcgauaacccaaccgaacuagcaagagguggagcaagaguuaauaacuuuauaacagaguucaacgacagauugaaaacccauggaguccaagaacuacaaacgauauuugaaaggaauaaaccaauagugcaaguagucagaggcgaagaaacacaacggcugaggagacaauggaaugcauuaaaucaaaauuuuauaccccugaaagacagagcaaugucauuuaaccaugcagaagaugcagcaauagcagcaucaaugccuccaaaauucuggcgagaacaaauauauagaaccgcauggcauuuuggaccuucaggaaaugaaagaccugacuuugcuuuggcagaauuagcuccucaguggaaugauuucuuuaugacaaaagguggucccauaauugcaguauuaggaaaaacaaaauauagcuggaaacauaguauuauagaugacacuauauacaaaccauucagcaaaucugcauauuauguaggcaucuacaagaaaccaaacgcaauaacaucaaaugcaaucaaaguucucagaccaaaauuacuuaacggagaacauaccaugucgaaaaacgcaaaauacuaccaucagaaaauaggaaaugaacgcuuucuaaugaaaagucagaaaggcggaucaauaauaacuguaaaaccacacgacggaccagaaaaagucuuacaaauaucaccgacauacgaaugugcagucuuaacgaaacaugauggaaaaauaauagucaaauuuaaaccaauaaaaccauuaagggacauguacgcucgcggcguaaucaaagcgauggauaaagaacuggaaacaucauugagcuccaugucaaaacacgcaaaauauaaagaacuacacacacacgacauaaucuacuuacccgcaacaaagaaacauguugacggauauuuuauuaucacgaaauuaagcgccaaacauggaauuaaagcacuuccugaaucaaugguuaaaguaaaauauacacaaauaggcagcgaaaacaacuccgaaguaaaauuaaccaaaccaaaaccugaaauaacacuugauucugaagauaucaccaauauauauaauuucacgagauaa

SEQ ID NO: 11594 - RNA, 2961 nt, Artificial Sequence
  CasX variant__Deltaproteobacteria bacterium__OGP07438.1__CasX
auggaaaagaggauaaauaagauacgaaagaaauuaagugcugacaacgcaacgaaaccaguuucuagaaguggaccaaugaaaacauuauuaguaagaguaaugacagaugauuuaaagaaaagacuggagaaaagacguaagaaaccggaaguaaugccacaaguaauuagcaauaaugcagcaaacaauuuacgaaugcuccuagacgauuacacaaaaaugaaagaagcuauauuacaaguauauuggcaagaauuuaaagaugaucaugugggucugaugugcaaauuugcacaaccagcaaguaagaaaauagaucagaauaaauuaaaaccagagauggaugaaaaaggaaaccuaacaacagccggauuugcaugcucacaaugcggacaaccucucuucguauauaaauuagaacaagugucugaaaaaggaaaagcauauacaaauuauuuuggaagaugcaacguagcagaacaugaaaaacuaauauuauuagcacaauuaaaaccagaaaaagacucagacgaagcuguaacauauucacuuggaaaauucgggcaaagagccuuagauuuuuacucaauacauguaacaaaagagaguacucaucccguaaaaccuuuggcccaaauagcaggaaaccgauaugcuucaggucccgucggaaaagcacuaucagaugcauguauggguacuauagcuagcuuucuaucaaaauaucaagauauaauuauagaacaucaaaaaguagucaaaggaaaucagaaaagacuugaaucacuuagagaauuagcaggaaaagaaaaucuagaauacccaaguguaacccuaccaccacaaccacacacaaaagaagggguugacgcauauaacgagguuauagcuagaguaagaauguggguuaauuuaaaucuauggcaaaaacuaaaacuaucacgagacgacgcaaaaccacucuuaagauuaaaaggguuuccaucauuuccaguaguugaacgaagagaaaacgaaguagauugguggaacaccauaaaugaaguaaagaaauuaauagaugcuaaaagagauaugggaagaguauucuggucugguguaacagcagagaaaagaaauacaauauuagaaggguauaauuaucucccaaaugaaaacgaccacaagaaaagagaaggauccuuagaaaacccaaagaaaccggcaaaaagacaauuuggcgacuuacuacuauauuuagagaagaaauacgcaggagauuggggaaaaguauuugaugaagcaugggaacgaauagacaagaaaauagcuggauuaaccucacauauagaacgugaagaagcgagaaacgcagaagaugcacaaagcaaagcagucuuaaccgauuggcuccgcgcaaaagcauccuucgucuuagaaagacuuaaagaaauggaugaaaaagaauuuuacgccugugaaauucaacuacaaaaaugguauggagacuuaagaggcaauccauuugcaguugaagcugagaaccguguaguggacauaucuggcuucucgauaggauccgauggucauucuauacaauauagaaacuuauuagcuuggaaauauuuagaaaauggcaaaagagaauuuuaccuacuaaugaauuaugguaagaaaggaaggauaagauuuacagauggaacugauauuaagaaaucggggaaauggcaaggacugcuguaugggggugggaaagcgaaaguaauagauuuaacuuuugaccccgaugacgaacaacucauaauucuaccacuagcauuuggaacacgacaaggacgcgaguucauauggaacgaucuacuaagccuagaaacaggauuaauaaaauuagcaaauggaagaguuaucgagaaaacaauuuauaacaagaaaaucggacgcgaugaaccugcacuauuuguggcauugacauucgaacgcagagaagucguagacccuaguaauauaaaaccgguuaaucucauaggaguagauagaggggaaaauauaccagcaguaauagcauugacagacccugaaggaugcccccuaccugaauuuaaagauucaagcggaggaccuaccgacauuuuaagaaucggagaagguuauaaagaaaaacagagagcuauccaagcagcaaaagaaguggaacaacgccgagcaggaggauauucaagaaaauuugcaucaaaaucacgaaaucuggcagaugacauggugagaaauagcgcaagagacuuauucuaucaugcaguaacucaugacgcaguauuaguauucgaaaaccuuaguagggguuucgggagacaagguaaacgaacauuuaugaccgaacggcaauacacgaaaauggaagacuggcuaacugcuaaacuagcauacgaaggacucacgagcaaaacauacuuaucaaaaacucuggcccaauacacaucaaaaacuuguagcaauuguggauuuacaaucacaacagcagauuaugacggaauguuagugcgguuaaagaaaaccucugauggcugggcaacgacacuaaacaauaaagaacuaaaagcugagggacaaauaacauacuauaacagguauaaaagacaaacuguugaaaaagaacuaagugcagaacuagacagacucagcgaagaauccggaaauaacgauauaucuaaauggacgaaagggagacgagaugaagcgcuauuuuuauuaaagaaaagauucagucauagacccguacaagaacaauucguaugcuuagauuguggccacgaaguacaugcugaugagcaagcagcuuuaaauauugcaagaagcuggcucuuuuuaaauucaaacucaaccgaguucaaaucauauaaaagcgguaaacaaccauuuguaggugccuggcaagcauucuauaaacgaagauuaaaagaaguauggaaaccaaacgcauaa

SEQ ID NO: 11595 - RNA, 2937 nt, Artificial Sequence
  CasX variant__Planctomycetes bacterium__OHB99618.1__CasX
augcaagaaauaaaaagaauuaauaaaauccgaagaagacuuguaaaagacucaaauacaaaaaaagcaggaaaaacaggcccaaugaaaacacuauugguacgaguaaugacaccagaccucagagagagacuggaaaaccuaagaaaaaaaccugaaaauauaccacaaccaauaucuaacacaagccgagcaaaccuaaauaagcuauuaaccgauuacacagaaaugaaaaaagcaauauuacacguauacugggaagaauuucagaaagacccaguaggacuaaugucacguguagcacaaccagcgccgaaaaauauugaucaaagaaaacuaauaccaguuaaagauggaaaugaaagauugacuagcaguggauucgcauguucccaauguugccaaccacuuuacguguacaaacuagagcaaguaaaugauaaaggaaaaccacauacgaacuauuuugggcgcuguaacgucucagaacaugaaagauuaaucuuguuaucgccacacaagccagaagcaaacgaugaacuaguaacuuauucacucggaaaauuuggucaaagagcauuagacuuuuacaguauacacgugacaagagaaagcaaccacccuguaaaaccacuugaacaaauaggaggaaacaguugugcaucaggaccaguaggcaaagcauuaucugaugcauguaugggagcaguagcaucuuuccuaacuaaguaucaagauauaauuuuggaacaucaaaaagugauaaaaaaaaaugaaaaaagguuagcuaaucuuaaagauauagcgucagccaacggauuagcauucccaaaaauuaccuuaccaccacaaccacauacgaaagaagguauagaagcguacaacaauguagucgcacaaaucguuauaugggugaacuuaaauuuauggcaaaaacuaaaaaucgguagagaugaagcaaaaccuuugcaacgguuaaaaggcuuuccaaguuuuccucuaguagaaagacaagcaaaugaaguggauuggugggacaugguauguaauguaaaaaaacuaauuaacgaaaaaaaagaagauggaaaagucuuuuggcaaaauuuagcagguuacaaacgucaagaggcacuacuaccauauuuaaguuccgaagaagauaggaaaaaaggaaaaaaauucgcaagauaccaauuuggcgaucugcuacuccauuuggaaaaaaaacauggggaagauugggguaaaguuuaugaugaagccugggaaagaaucgacaagaaaguagaagguuuaucaaagcauauaaaguuagaggaagaaagaagaucagaagacgcucaaaguaaagcggcccuaacugacugguuaagagcaaaagcaagcuucguaauagaagguuuaaaagaagcggacaaagaugaguucugucgcugugaauugaaacuucaaaagugguacggagacuuaagaggaaagcccuucgccauagaagcagaaaacagcauauuagauauaagcggauuuucuaaacaauacaauugugcuuucaucuggcagaaagauggaguuaagaagcuuaaccuauacuuaauaauaaacuauuucaaagguggaaaauuaagauucaaaaaaauuaaaccagaagcauuugaagcaaauagguucuacacuguaauaaacaaaaaaaguggagaaauaguaccaauggaaguaaauuuuaacuucgacgacccaaaccuaauaauacucccauuagcuuuuggaaaaaggcaagggagagaauuuauauggaaugauuuacuaucacuugaaacuggaaguuuaaaacuagccaacgggagggucauagaaaaaacacuauacaauagaagaacacgacaagaugaaccagccuuguucgucgcauuaaccuuugaaagaagagaaguucuggacucaucuaauaucaaacccaugaaccucauagggauugauagaggagaaaauaucccagcuguuauagcguuaacagauccagaagguuguccccuaagcagauucaaggauuccuuagguaauccaacacacauacucagaauuggugaaaguuacaaagaaaagcaaagaaccauucaagcagccaaggaaguugaacaaagaagagcagggggauauucaagaaaauaugcaucaaaagcaaaaaaccuagccgacgauaugguucgaaacacagcacgagauuuauuauacuaugcagucacccaagaugcuaugcugauauuugaaaaccuuucaagaggauuuggaaggcaaggaaaacgaaccuucauggcagaacggcaauacacaagaauggaggacugguuaacugcaaaauuggccuaugaaggacuuccaaguaagacauaucuauccaaaacucuggcgcaauauaccucaaagacauguucaaauugugguuuuacuauuacauccgcagauuacgaucgcguacuugaaaaauuaaaaaaaaccgccacagguuggaugacaacaauuaacggcaaagaauuaaaagucgaaggucagauaacauauuauaaucgauauaaaagacaaaacguaguaaaagaccuaucaguagaacuagauagguugagugaagaaagcgugaauaaugacauuucauccuggacaaaagguagaagcggcgaagcauuaucauuauuaaaaaaacgauuuagucacaggccaguccaggaaaaauuuguaugcuugaauugcggcuucgaaacacacgcagaugaacaagcagcacucaacaucgcgaggaguuggcuauuucuaaggucacaagaauauaaaaaauaccaaaccaauaaaacgacaggcaacacggacaaaagagcuuuuguagaaaccuggcagaguuuuuauaggaaaaaacuaaaagaaguauggaaaccggcaguauag

SEQ ID NO: 11596 - RNA, 3378 nt, Artificial Sequence
  CasY variant__Candidatus Katanobacteria bacterium__OJI08769.1__CasY
augagaaagaaacuauucaaagguuacauauuacauaauaaaagauuaguuuauacagggaaagcagcaauacgcaguauaaaauacccauuaguggcaccaaacaaaaccgcauuaaacaacuuaagugagaaaauaauuuaugacuaugaacaucuauucggaccccuuaauguugcaucauaugcuagaaauuccaaccgauauagucuaguagauuuuuggauagacucauuaagggcgggaguaauauggcaaucaaaaucaacaagucuuauagacuuaauaagcaaauuagaaggaucaaaaucaccaagugagaaaauauucgaacaaauagauuucgaacucaaaaauaaacuagauaaagaacaauucaaagauauaauacuacuaaauacaggaauacgaucaaguucaaauguuagaucucugagagggcgauuucuuaaaugcuuuaaagaagaauuuagagauacagaagaaguaauagcgugcguagauaaauggaguaaagaucuaauaguugaaggaaaaagcauucuaguuucgaaacaauuccuuuauugggaagaagaauuuggaauaaaaauuuucccgcacuucaaagauaaccacgauuuaccaaaacuaacauucuuuguagaaccuaguuuagaauuuagcccacaucuaccgcuugccaacugcuuagaaaggcuaaagaaauucgauauaucccgagaaucuuuacuagguuuagauaauaacuucucagcuuucagcaauuauuucaaugaacuauucaacuuacuauccagaggugaaaucaagaaaauuguaacagcuguacucgcaguuagcaaaagcugggaaaacgaaccagaacuagagaaaagacuucauuuucuaagcgaaaaagcaaaacuauugggauacccgaaacugacaucaaguugggccgacuacaggaugaucauaggaggaaaaauuaaaucguggcacucaaauuauacagaacaauugauaaaagucagagaagaccucaagaaacaccaaauagcacuagauaaauuacaagaagauuuaaagaaaguaguagauuccucacuaagggaacaaaucgaagcacaaagagaagcccuacuuccccucuuagacacuaugcuaaaagaaaaagacuuuagugaugaccuagaacuuuaccgcuuuauccuaagcgauuuuaaaagucuucuuaacgguucauaucaaagauauauacaaacagaagaagaaagaaaagaagauagagauguuaccaagaaauauaaagacuuauacucuaauuuaagaaacauaccuagauucuuuggggaaagcaagaaagaacaauuuaauaaauucaucaauaaaagccuaccuacaauagauguuggauuaaaaauauuagaagauauacgcaaugcacuggaaacagucucuguuagaaaaccaccaagcauaacugaagaauauguaacaaaacaacuagaaaaacugucaagaaaauauaaaauaaacgcauucaacucaaauagauucaaacaaauaacggaacaaguuuuacggaaauauaauaauggcgaauuaccaaaaaucuccgaaguauucuauagauaccccagagaaagccauguugcaauaagaauacuaccaguuaaaaucaguaacccacgaaaagacauuagcuacuuacuggauaaauaccaaauuuccccagacuggaaaaauaguaaccccggugaaguaguagaucuuauagaaauauauaaacuuacguuaggaugguuacuaucuugcaacaaagauuuuucaauggacuuuuccagcuacgaccuaaaacuuuucccagaagcagccucauuaaucaaaaacuucggcucaugucucagugguuacuaucuuucuaaaaugauauucaacugcauaacaagugaaaucaaaggcaugauuacccuuuauacaagagacaaauucguuguccguuacgucacucaaaugauaggaucaaaccaaaaauucccucuccuaugcuuaguuggcgaaaaacaaacuaaaaacuuuucacgaaacuggggaguucucaucgaagaaaaaggcgaccuaggagaagaaaagaaucaggaaaaaugcuuaauauucaaagauaaaacagacuucgcuaaagcuaaagaaguugaaauuuucaagaacaacauauggagaauaagaacaaguaaauaccaaauucaauuccucaaucgacuauucaagaaaacuaaagaaugggacuuaaugaaucuaguccuaucagaaccgucucuaguucuagaagaagaauggggcguaaguugggacaaagauaaauuacuucccuuauuaaagaaagaaaaaucaugcgaagaacgcuuauacuacucacuaccucucaaccuaguaccagcgacugauuacaaagaacaaagcgcugaaauagaacaacgaaacacuuaucuuggcuuagacguuggugaguucggaguagcauacgcuguagugagaauaguacgagacagaauagaauuguuaucauggggauuuuuaaaagauccugcacuacgcaaaauuagagaacgaguacaagauaugaagaagaaacaaguaauggcuguauucucgucaucaucaaccgcaguagccagaguaagagaaauggcaauacacagcuuacgaaaccaaauacacagcaucgcauuagccuacaaagcgaaaaucauauaugaaauaucuauaucuaacuuugaaacagguggaaacagaauggcuaaaauauacagaucgauuaaaguaucagaugucuaccgugaauccggagcagauacauuaguuucagaaaugauauggggcaagaaaaacaaacaaaugggaaaccauauaucauccuacgccacaucauauacuugcugcaauugcgcucguaccccauuugaguuaguaauagauaacgauaaagaauaugaaaaaggcggcgacgaguucauauucaacguaggcgaugagaagaaagucagaggcuuccuacaaaaaucacuauuaggaaaaacaauaaaaggaaaagaaguacuuaaaaguauaaaagaguaugcaaggccuccaauaagagaaguucuacuagagggugaagauguggaacaacuguuaaaacgaagaggaaacucauauaucuacaggugcccauucuguggauacaaaaccgacgcagauauacaagcagcacucaacauagccugucgaggauacauaucugacaacgcuaaagacgcaguaaaagaaggcgaaagaaaguuggacuauauacuagaaguuagaaaacuuugggagaaaaacggagcaguacuacguuccgcaaaauuuuuauag

SEQ ID NO: 11597 - RNA, 3864 nt, Artificial Sequence
  CasY variant__Candidatus Kerfeldbacteria bacterium__OGY82221.1__CasY
augaaacgaauauuaaacagccuaaaaguagcagcauuaagacuucuauuuagaggaaaaggaucugaauuaguaaaaaccguaaaauauccccuggucagucccguacaaggugcggucgaagaauuagcugaagcaauccgacacgauaaccuacaccuauucggacagaaagaaaucguagacuuaauggaaaaagaugaaggaacacaaguauauagcguagucgauuuuugguuagauacguuacgacuugguauguucuuuagucccucagcaaacgcacuuaaaauuacacuugggaaauuuaauucagaucaaguaagucccuuuagaaaagugcuagagcaaucucccuucuucuuagcuggaagacuaaaaguagaaccagcagaaagaauuuuaucuguagaaauaagaaaaauuggaaaaagagagaacaggguggaaaauuaugcagcagacguggaaacuuguuuuaucggacaacuaucaucagaugaaaaacaaucuauccaaaaacuggccaacgauauaugggauucaaaagaucaugaagaacagcguauguuaaaagcagacuuuuucgcuauaccacucauaaaagaucccaaagccgugacggaagaagauccagaaaacgaaacugcaggcaaacagaaaccauuggaauuauguguaugucuaguuccagaacuauacacacguggcuucggaucaauagcagauuucuugguacaacgccuuacucuacuccgggauaaaaugagcaccgacacugccgaagacuguuuggaauauguaggcauagaagaagagaaaggaaacgguaugaacagucuacuaggcacuuucuuaaagaaucuacaaggagauggauucgaacaaauauuccaauuuauguuagggagcuauguaggauggcagggaaaagaggacguauuacgggaaagacuagauuuacuagcagagaaaguuaaacgacuucccaaaccaaaauucgcaggagaaugguccggacacagaauguuucuacacggacaauuaaaaucauggucuucaaauuucuuuagauuauuuaaugaaacaagggaauuacuagagucaauaaaaucugacauccaacaugcaacuauguuaauauccuauguugaagaaaaaggaggauaccauccacaacuacuaucacaguacagaaaauugauggagcagcuuccagcacuacgaacaaaagugcuagauccagaaauagaaaugacacacaugucagaagcaguaagaucuuauauuaugauacacaaaagcguagcaggauuucuuccugaucuauuagagagcuuagauagagauaaagaucgugaauuucuccuaaguauauuuccacggauuccaaaaauagacaagaaaacuaaagaaauagucgcaugggaacuaccgggagaaccagaagaagguuaccuuuuuacagcaaacaaucuguuuagaaauuuucuggagaauccaaaacacguaccuagauuuauggcggaaagaauaccagaagauuggacaagacuacgaucagcaccaguaugguucgacgggaugguuaaacaauggcaaaaaguaguuaaccaauugguagaaucuccaggagcacuauaucaauuuaaugaaucauuuuugcgucaaagauugcaagccaugcucacuguauacaaaagagaccuacagacagaaaaauuucuuaaauuauuagcagaugucuguagaccacugguagauuucuuuggauuaggagguaacgacauaauauuuaaaaguugucaagauccaagaaaacaguggcaaacaguaauaccacuaucagugccagcugacguuuauacagcaugugaaggacuugcaaucagacugagagaaacccuagguuuugaauggaaaaaccuaaaaggacacgaaagagaagauuuucuacgguuacaccaauuauuaggaaaucuacuguuuuggauccgagacgcaaaauuaguaguuaaauuagaagacuggaugaacaauccaugcguacaggaauaugucgaagcuagaaaagcuauagaucugccauuagaaaucuuuggauuugagguaccuauauuuuuaaacggauaccuguucucagaacuaaggcaacuagaacuuuuacucagacgaaagucggugaugacuagcuacagugucaaaacgacaggaucacccaacagacuauuucaauuagucuacuuaccccuuaauccuucagauccagaaaagaaaaacucaaauaauuuucaagaaaggcucgauacaccgacuggccuuucaagacgauuccuagaccuaacacuugaugcguucgcuggaaaacuauuaacagaccccguuacacaagaauuaaaaacgauggcaggauucuaugaucaccucuucgguuucaaauuacccuguaaauuagcugcaaugaguaaucauccggguucgucgagcaaaaugguuguacuugccaaaccaaagaaaggcguugcuucgaacauagguuuugaaccaauaccagauccugcucacccaguauuccggguuagaucgucguggccugagcuaaaauauuuagaaggacuacucuauuugccagaagacacaccacuaacuauagagcuagccgaaaccucaguuucaugucaauccguaucaagugucgcauucgacuuaaagaacuuaacaacgauacuaggccgaguuggugaguucagaguuacagcagaucaaccuuuuaaauuaacuccaauaauaccugaaaaagaggagucauucauaggaaaaacguauuuaggacuagacgcuggugaaaggaguggaguaggcuuugccaucguuacgguugauggggauggguaugaaguacagcgccuuggcguccaugaggauacacaacuaauggcauuacaacaaguagcaucaaaaucccuaaaagaaccaguauuucagcccuuaagaaaaggaacauuuaggcaacaggagaggauuagaaaaagucuacguggauguuacuggaauuucuaucacgcacuaaugauaaaauaucgggcaaaagugguccaugaagaaucaguaggaucaucagguuuaguuggucaaugguugagggcguuccaaaaagaccuaaagaaagcagacguccuuccaaagaaagguggcaaaaauggaguagauaaaaagaaacgagagucaagugcacaagauaccuuaugggguggagcguuuaguaagaaagaagaacaacaaauagcauucgaaguacaagccgcuggaucuucccaauuuuguuuaaaauguggcuggugguuucagcuagguaugcgcgaaguuaauagaguacaagaaagcggaguuguacuagauuggaauagaaguauaguaacauuccuuauugagagcaguggagagaaaguuuaugguuuuagcccucaacaauuggaaaaaggauucagaccagauaucgaaacauuuaagaaaauggucagagauuuuaugcgcccaccaauguucgaucggaaaggaaggccagcagccgcauacgaacgauuuguauuggguaggcgacaucgaagauauagauucgacaaaguauucgaagaacgguuuggacgaagugcacuauuuaucuguccaagaguggguugcggaaacuucgaucacucauccgaacagagcgccguaguuuuagcccucaucggguacauagcugauaaagaaggcaugucaggcaagaaauuaguguauguacguuuggcagaacuaauggcggaguggaaacuaaagaaacuagaaagaucgaggguagaagaacagagcucggcacaauaa

SEQ ID NO: 11598 - RNA, 3579 nt, Artificial Sequence
  CasY variant__Candidatus Komeilibacteria bacterium__OJI06454.1__CasY
auggccgaaucaaaacaaaugcaauguagaaaauguggagcaucaaugaaguaugaaguuauuggacuaggcaaaaagucaugcagauauauguguccagauugugggaaucauacuucagcuagaaaaauacaaaauaaaaaaaagagagauaaaaaguauggaagcgcaaguaaggcacaaucacaaagaauagcaguagcaggagcacuuuaccccgacaaaaaaguacaaacaauaaaaacauauaaauauccggcagauuugaacggugaaguacacgaccggggaguugcagagaaaauugaacaagccauacaagaagacgaaauaggauuacuaggaccaucaucugaauacgcauguuggauugcaagucaaaaacaaagcgagccauacucaguaguagacuucugguuugaugcgguuugcgcagggggcguuuucgccuauucaggcgcaagacuacuaagcacuguacuacaauuaagcggcgaagagucuguacuuagagcagccuuagcaaguagcccuuuuguagaugauaucaauuuagcacaagcagaaaaguuuuuggcagucucacgacgaacaggacaagauaaacucggaaaacgcauaggagaauguuucgcagaaggaagauuagaagcuuuagguauuaaagacagaaugagggaauuuguccaagcaaucgauguagcacaaacagcaggucaaagauuugccgcuaaacuaaaaauauucggaauuagccaaaugccagaagcaaaacaauggaauaacgacucaggacugacaguaugcauauuaccagauuacuacgugccagaggaaaaccgagcugaucaauuaguaguauuacugagaagauuaagagaaauagcauauuguauggguauagaggacgaagcuggguucgaacacuuagguauagauccaggggcguugucaaauuuuagcaauggaaacccaaaaagaggguuucuuggacgauuguuaaauaacgacauuauugcacuugcaaacaacaugucggcaaugacgccauacugggaagguagaaaaggugaacuaauagaacgauuggcgugguuaaagcauagagcagagggccuauaucuaaaagagccucacuuuggaaacaguugggcugaucauagaucacgaauuuucagucgaauagcagggugguuauccgguugcgcaggaaaacuaaaaaucgcaaaagaccaaauaucuggaguuagaacugacuuguuucuacucaaaagauuauuggacgccgucccgcagagugcacccucuccggauuuuauagcaucaaucucagcauuagacagguuuuuagaggccgcugaaucaagucaagaucccgcugaacaagugagagcgcucuaugcuuuccauuuaaacgcuccggccguuagaucaauagcaaacaaagccgugcagcguucagauagccaagaguggcuaauaaaagaacuggacgcuguugaucauuuagaauucaauaaagcuuuuccuuuuuucucagauacgggcaaaaaaaaaaaaaaaggagcuaacucaaacggugcaccaucagaagaagaauauaccgagaccgaguccauacaacagccagaagaugccgaacaagaagucaacggccaagaaggaaacggagcaaguaagaaucaaaaaaaguuucaaagaauaccuagauuuuuuggugaaggguccagaagugaauauagaauuuuaacagaagcaccacaauauuuugauauguuuugcaauaacaugagagccauuuuuaugcaauuggaaagccaaccaagaaaagcuccaagggauuucaaauguuuucuacaaaaccgacuacaaaaauuauauaaacaaacauucuuaaaugcuagaaguaauaaauguagagcacuuuuagaaucaguauuaauaagcuggggggaauuuuauacauacggugcaaacgagaaaaaauuuagacuaagacaugaagcuucagaaagauccucagacccagauuauguaguucaacaagcacuagaaauagcaagaagauuauuuuuauuugguuucgaauggcgggauuguagugcgggagaacggguugaccuaguagaaauacacaaaaaagcaauaaguuuccuauuagcaauaacccaagccgaaguuucaguaggaaguuacaacuggcucggaaauuccacuguaucaagauaucuuucaguugcuggaacagacacccucuacggaacacaacuggaagaauuccuuaaugcgacaguucuuucacaaaugagaggccuggcaauacgguuaaguucacaagaguuaaaagauggcuuugacguacaauuggaauccucuugucaagacaaucuacaacauuuacucguauacagggccucaagagauuuggcagcuuguaaaagagcaacgugcccagcagagcuagacccuaaaauacugguauugccugcuggagcguucauagcaucuguaaugaaaaugauagaaaggggcgaugaacccuuagcuggggccuauuuaagacauagaccacacucguucggguggcagauaagaguacgagguguugccgagguagggauggaucaaggaacugcacuggcauuucaaaagccaaccgaaucagagccauucaagauaaaaccauucagcgcgcaguauggaccuguacuauggcuaaauucaaguucauacucccaaucccaauaucuagaugguuuccuaucucaacccaaaaauuggucuaugagaguauuaccucaagcagguuccguaaggguagaacaacguguagcucucauauggaacuuacaagcaggaaagaugcgcuuggaaagaucaggcgccagggcguuuuucaugccaguuccguucaguuuuaggccaaguggaaguggugaugaagcuguauuagcacccaaucgcuaccucggucuauuuccacacuccggagguauagaauacgcagucguggacguuuuagauucugcuggauucaagauacuagaaaggggaacgauagcaguuaauggguuuucacagaagagaggagaacgacaagaagaagcacacagagaaaagcaaaggagaggaauuagugauauaggacgcaaaaagccaguacaagcugaaguagaugcagcaaaugaauuacauagaaaauacacugauguugcaacaagguuggguugccgaauaguuguacaaugggcaccacaaccaaaaccagguacagcucccacagcacaaacgguguacgccagagccguaagaacagaagcuccgagaagcggaaaccaagaagaucaugcaagaaugaagaguaguugggguuacacuuggucaacauacugggaaaaacggaaaccagaagacauauugggaauaucuacccaaguauacuggacagguggaauuggagaaaguuguccagcaguagcuguagcauugcuaggacacaucagagcuacgucuacucaaacagaaugggaaaaggaagaagucgucuucggcagauuaaaaaaauuuuucccaagcuag

SEQ ID NO: 11599 - RNA, 3633 nt, Artificial Sequence
  CasY variant__Candidatus Parcubacteria bacterium__APG80656.1__CasY
augaguaaaaggcacccaagaauaucaggaguaaaaggauaucgacuucacgcccaaagacuagaauacacgggcaaaucaggagcaaugagaacaauuaaauauccauuauacucaucgccaucaggaggaaggacggucccuagagagauaguaucggcgauaaaugacgauuacguaggcuuauacggguuaucgaacuucgacgaucuauacaacgcugaaaaacguaaugaagaaaagguuuauucaguuuuagauuuuugguaugacugcguacaauacggagcuguguuuucauauacugcgccaggacuauuaaaaaauguagcagaaguacgaggaggaaguuaugaacuaacaaaaacauuaaaaggaagccaccuauaugaugaacuacaaauugacaaaguaauuaaauucuuaaauaaaaaagaaauaucucgcgcgaauggaucuuuagauaaacuaaaaaaagauauuaucgacugcuucaaagccgaauacagagaaagacacaaagaucaguguaauaaacucgcagacgacauuaaaaaugccaaaaaagaugcaggagcaagccuuggagaacgucagaaaaagcuuuuucgagauuucuucgguaucucggagcaaagugaaaaugauaaaccaagcuucacaaacccauuaaaccuaacauguugucuucuuccuuuugauaccgucaauaacaacagaaauagaggagaaguauuauuuaauaaauugaaagaauaugcacaaaaacuugauaaaaacgaaggaagucuugaaaugugggaauacauaggaaucggaaauucaggcacagcauuuucaaauuuuuuaggagaaggauuuuuaggaagacuaagagaaaacaaaauuacagaauuaaaaaaagcuaugauggauauuacggacgcauggcgaggccaagaacaagaggaagaacuggagaaacgacuaagaaucuuagcagcccuaacaauaaaauuaagagaaccaaaauucgacaaucacuggggcggcuauagaucagacaucaacggaaaguuaaguagcuggcugcaaaacuauauaaaccaaacaguaaagauaaaagaagaccuaaaaggucauaaaaaagaccucaaaaaagcaaaagaaaugauaaauagauucggcgaaagcgauacuaaagaagaagcagucgugagcagcuuacuagaguccauugaaaaaauaguaccagaugauucagcugaugaugaaaagcccgauaucccagcaauagcaauauacagaagauucuuauccgauggacgacuaacguuaaaccgauuuguacaacgagaggauguacaagaagccuuaaucaaagaaagacuugaagcugagaaaaaaaaaaaaccuaaaaaaagaaaaaaaaagucagaugcagaagaugagaaagagacaauugacuucaaagaauuauucccucauuuggcaaaaccucuaaaacuagucccaaacuuuuacggagacucaaaaagagaacuauauaaaaaguauaaaaacgcugcuauauauacugaugcacuuuggaaagcaguggagaaaauauacaaaagugcauuuucaaguucuuugaaaaauucauuuuuugacacagacuucgauaaagauuucuucauuaaacguuuacaaaaaauauuuucuguuuacagacgcuuuaauacugauaaauggaaaccaauaguaaaaaauuccuucgcaccauacugcgauauaguaucacucgcagagaaugaaguauuguacaaaccaaaacaaucaagaaguagaaaaagugcagcaauagauaaaaacagaguacgacuaccaucuacagaaaacaucgcuaaagccgguauagcacucgcaagagaacuaucaguagcaggauuugacuggaaagaucuauugaaaaaggaggagcaugaggaauacauagaccuaauagaauuacacaaaacagcccuagcauuacuacuggcagucaccgaaacacaacuagauauaagugcccuagacuucguggaaaacggcacuguaaaagacuuuaugaagacuagagaugguaaucuaguacuggaaggacgcuuucuagaaauguuuagucaaucaauuguuuuuagcgaauugaggggauuagcuggauuaaugagcagaaaagaauuuauaacuagauccgcaauacagacaaugaauggaaaacaagcagaguuacuauauauaccccaugaauuccaaucggcaaaaauaacaacacccaaggaaaugucaagggcauucuuggauuuagcgccggcagaauuugcuacaagcuuggaacccgaaucauuaucugaaaaaucauuauuaaaacuaaaacaaaugcgcuauuauccacacuauuuuggauacgaacugacaaggaccggacagggaaucgauggaggaguugcagagaaugcacugaggcuagagaaaucaccuguaaaaaaaagagaaauaaaauguaaacaauacaagacacuaggaagaggucaaaauaaaauaguauuauacguuaggucgagcuacuaccagacacaauuucuagaaugguuucuacaucgaccuaaaaauguacaaacagaugucgccguuucagguagcuuuuugaucgaugaaaaaaaagucaaaacaagauggaauuaugacgcauugacgguagcauuagagcccguauccggaucagaaagaguuuucguaucacaaccauucacaauauuuccagaaaaaucagcugaagaggaaggacaacguuauuuaggcauagauauaggcgaauaugggauagcuuauacugcauuagaaaucacaggcgacagugcaaaaauauuagaccagaacuuuauaucugauccucaacucaaaacacugcgcgaagaaguuaaagggcuuaaacucgaccaaagaagagggacauucgccaugccaucaacaaaaauagcaagaauuagagagucacuaguacacaguuuacgaaaucgaauacaucaucuugcauugaaacauaaagccaaaaucguauacgaauuagagguaucccgauucgaagaaggaaaacagaaaauaaaaaaagucuaugcgacauuaaaaaaagcugauguuuacucugaaaucgacgcagacaaaaaucuacagacaacuguauggggaaaacuggcagucgcaagcgaaaucagugccucauauaccucacaauuuuguggagcaugcaaaaaauuauggagagcagaaaugcaagucgacgaaacgauaacuacccaagaacuuauagggacaguaaggguaaucaaaggaggaacacuuauagacgcaauaaaagacuucaugagaccuccaauauuugaugaaaaugauaccccauuucccaaauaucgagauuuuugugauaagcaccauauuagcaagaaaaugcggggaaacucaugucuauuuauuugcccguucugcagggcaaacgcagacgcugauauacaggcaagucagacaauagcacuccugcgauauguaaaagaagagaaaaagguagaagacuacuuugaaagauuccgaaaacuaaaaaauauaaaggucuuaggucaaaugaaaaaaauauag

SEQ ID NO: 11600 - RNA, 3681 nt, Artificial Sequence
  CasY variant__Candidatus Vogelbacteria bacterium__OJI07455.1__CasY
augcaaaaaguacgaaaaacucuaucagagguacacaaaaacccauaugguacaaaggugagaaacgcuaaaacaggauacagcuuacagaucgaaagacuaagcuacacaggaaaggaaggaaugagaaguuuuaaaauacccuuagaaaacaagaauaaagaaguguucgacgaauuugucaaaaaaauaagaaacgauuauauaucccaaguaggcuuauugaacuuaucagauugguacgaacauuaccaagaaaaacaagaacacuacagcuuagccgauuuuuggcuugacucauuacgagcgggcguaauuuucgcacacaaagaaaccgaaauaaagaauuuaauuucuaaaauacguggagauaaguccauaguagauaaauucaacgcgagcaucaaaaaaaaacaugcagaucucuaugcauuaguagacaucaaagcauuguacgacuuccuaacaagugacgcccgcagaggucuaaaaaccgaagaagaauuuuucaauagcaagagaaacacuuuauuccccaaauuccgaaaaaaggauaacaaggcaguagauuuauggguaaaaaaauuuauaggccuggacaauaaggacaaacuuaauuuuacaaaaaaauucauaggcuuugauccuaacccacaaauaaaauacgaccacacguucuuuuuccaucaagacauaaacuucgaucucgaacgaauaacaacacccaaagaacugauuucaaccuauaaaaaauuucuaggcaaaaauaaagaccuauacggcuccgaugaaacaacagaagaccaauuaaaaaugguacuaggcuuccauaacaaucauggagcauucucaaaauauuucaaugcaucgcuugaggccuucaggggucgagacaauagcuugguagaacaaauuauuaauaacucacccuauuggaauucacaccgaaaagaacuagaaaaaagaaucauauuucuacaaguucaaucaaagaaaauuaaagaaacagaauuaggaaagccccacgaauauuuagcaucuuucgggggaaaauuugaaucauggguaucuaauuaccuucggcaagaggaagaaguuaaaagacaauuguucggguacgaggagaacaagaaaggccaaaagaaauucauaguagggaacaaacaagaacucgacaaaauuauacgagguacugacgaauacgaaauaaaagcaauuagcaaggaaacaauaggauuaacucaaaaaugccugaaacuauuagaacaacuaaaagacagcguagacgauuacacucuaucucuauauagacaacuaauuguggaauugcgaauacgguuaaauguagaauuucaagaaaccuacccugaacuaauuggaaaaagcgaaaaagauaaagagaaagaugcaaagaauaaaagggcugacaaaagauacccgcaaauauuuaaagauauuaaauuaauaccaaacuucuugggugagacaaaacaaaugguguauaaaaaauucaucagaucagcagacauccuauacgaagguauaaacuucauagaucaaauagacaaacagauaacucaaaaccuccuaccaugcuuuaaaaaugacaaagaaagaauagaauuuacagaaaagcaauuugaaacgcuaaggcgaaaauacuauuuaaugaacucaagcagauuccaucacguaauugaaggaauaaucaauaaucgaaaauuaaucgaaaugaagaaacgagaaaauuccgaauuaaaaacuuucucugacagcaaauuuguccuaagcaaacucuuccuaaaaaaagguaaaaaauaugaaaacgaaguuuacuauacuuuuuacauaaauccaaaagcacgggaccagagaagaauaaaaauaguccuagauauaaauggcaacaacucaguagggauacuccaagauuuaguacagaaacuaaagcccaaaugggacgauaucaucaaaaaaaacgacaugggagaacuaauagaugcuauagaaauagaaaaaguaagauuaggcauacuaauagcauuauacugcgaacacaaauucaaaauaaaaaaagaacuccuuucccuagacuuauucgcaagcgcauaucaguauuuagaauuagaagacgacccagaagaacuaaguggaacaaauuuagguagauucuuacagucucuugucugcucagaaauuaaaggagcaauaaacaaaauaucacggacggaauacauagagagauacaccguacagccgaugaacacugaaaaaaauuauccacuauuaauuaacaaagaaggaaaagcuacauggcauauugccgccaaagaugauuuaaguaaaaaaaaaggagggggaaccguugcaaugaaucaaaaaauaggaaaaaacuucuucggcaaacaagacuauaaaaccguauucaugcuacaagauaaaagauuugaucugcucacaucuaaauaucaccuucaauuucuaaguaaaacucuagauacgggaggagggaguugguggaaaaacaagaauauagaucuaaaucuuuccuccuauaguuucauauucgaacaaaaagucaaagucgaaugggaccucacgaaucuagaucacccaauaaaaauuaaacccucugaaaauagcgacgacagaagacucuucguaagcauaccauucgugaucaaaccaaaacaaacaaaacgaaaagaucuucaaacacgcguuaacuacaugggcauagacauuggagaauauggacuagcguggaccauaauaaauauagacuuaaaaaauaaaaaaauaaacaaaauaucaaaacaaggguuuauauacgaaccucuaacacauaaaguaagagauuacguugcaacuauaaaagacaaucaagucagaggaacauucgguaugcccgacacuaaauuagcaagguuaagagaaaaugcaauaacaagcuuacgcaaucaagugcacgauaucgcaaugagauacgacgcaaaaccaguauacgaauuugaaauaucuaacuucgaaacaggcucaaacaaaguaaaaguuauauacgauucaguuaaaagagccgacauagggcgaggacaaaauaacacggaggcugauaacaccgaaguaaacuuaguaugggggaaaacuuccaaacaauucggaucacaaauaggagccuacgcgacauccuauauaugcagcuuuugcggguauaguccguacuaugaauucgaaaauucaaaaaguggagacgaagaaggagccagagauaaucuguaccaaaugaaaaaacucucaagaccuagccuagaagacuuccuccaggguaauccuguauauaaaacauucagagauuucgauaaauacaaaaacgaucaacgccuucaaaaaacaggggacaaggacggcgaauggaagacacaccgggggaacacagcaauauacgcaugucaaaaauguagacauaucuccgacgcagacauacaagcaucauacuggauagcacuaaaacagguagucagagauuucuacaaagauaaagaaauggacggagaucuuauacagggagauaauaaagacaagagaaaaguaaacgaacucaauagacuaauagguguacauaaagacguaccaaucauaaacaaaaaccuaauaacaagcuuagacauaaaccucuuauaa

SEQ ID NO: 11601 - RNA, 3603 nt, Artificial Sequence
  CasY variant__Candidatus Vogelbacteria bacterium__OJI09436.1__CasY
augaaagccaaaaaaucauucuauaaccaaaaacggaaauuuggaaaaagagguuacagacugcaugacgaaaggauugcauauaguggagggaucggcucaaugagauccauaaaauaugaacuaaaagacaguuacggcauagcaggacuccgaaauagaauagcugaugccacaauaucugauaacaaguggcucuacggaaauauaaaucuaaacgauuaucucgaguggcgcucuuccaaaacagacaaacaaauagaagacggggauagggaaucaagucuacugggguucuggcuugaagccuugcgucuagguuucguauucaguaaacaaucacaugcaccaaaugacuucaaugaaacagcacuccaagaccuuuuugagacacuagacgaugaucuaaaacacguacuagaucguaaaaaauggugcgauuuuaucaaaaucggaacgccaaaaacaaacgaucaagggcgauuaaaaaaacaaauaaaaaaccuacuaaaagggaacaaaagagaagagauagaaaaaacauuaaaugaaagugaugacgaauuaaaagaaaaaauaaauagaauagcugauguguucgcaaaaaacaaaucggacaaauauaccauauuuaaauuagauaaaccuaacacagaaaaauacccaaggauaaaugacguacaagucgcauuuuucugccacccggauuuugaagaaaucacagaaagagacagaaccaaaacauuagaccuaauaauaaaccgauucaauaaaagguacgagauaacagagaacaaaaaagacgauaaaacuaguaauaggauggcccuuuauucacucaaucaagguuauauacccagaguauuaaacgaccuguuucucuucgugaaggauaacgaagacgauuucucacaguuccugucagaucuugagaacuucuucagcuucucaaacgaacaaauuaaaauaaucaaagagagguuaaagaaguuaaagaaguacgccgaaccaauaccaggaaagccccaauuagcugacaaaugggaugauuaugccagcgauuuugguggaaaacuugaaucaugguacagcaacagaauagaaaaauuaaaaaaaauaccagagucggugagugaccuuagaaacaaucuagaaaaaaucagaaacguacuuaaaaaacaaaacaacgcaaguaaaauacuagaacuaagccaaaaaauaauagaauauaucagagauuacgguguaagcuucgaaaaaccugaaaucauaaaauuuucuuggauaaauaaaacaaaagauggacagaaaaaggucuuuuacguagcaaaaauggcugauagagaauuuauagaaaaacuggacuuauggauggcagauuugcgaucacaacucaaugaauacaaccaagacaauaaaguaaguuucaaaaaaaaaggaaagaaaauagaggaauuaggaguauuagacuucgcgcuuaacaaagcaaaaaaaaacaaauccacaaaaaaugaaaacggauggcaacaaaaauugagcgaaagcauucaaagcgcacccuuauuuuuuggugaaggaaauagaguaagaaaugaagagguauacaaccuaaaggauuuauuguucuccgaaauaaaaaacguagaaaacauccuaaugagcagcgaagccgaagacuuaaaaaacaucaagauugaauauaaagaagauggggcuaaaaaaggaaacuauguacuaaauguauuagcucgcuucuacgccagauucaaugaagauggguacgguggauggaauaaagucaaaacaguacucgagaauauagcacgagaggcaggaacagacuuuaguaaguauggaaauaacaacaauagaaaugccggucgauucuauuuaaacggaagggaaagacaaguauuuaccuuaauaaaauucgaaaaaaguauaaccguagaaaaaauauuagaacuuguaaaacuacccucacuccuagacgaagcguauagagaucucgugaacgaaaacaaaaaccauaaacuaagagauguaauacaacuaucaaaaacaauaauggcauuaguacucucccauagugauaaagaaaaacagauaggaggaaacuacauacacucgaaacuaucuggauacaacgcauuaauaagcaaaagagauuuuauuucuagauacaguguacaaacgacuaacgggacacaauguaaacuagccauagggaaaggcaaaagcaaaaaagguaaugaaauugauagauauuucuaugcguuucaauuuuucaaaaaugaugacucuaaaauaaaccuaaaaguaauuaaaaacaacucacacaaaaacaucgacuuuaaugauaaugaaaauaagauaaacgcacuacaaguauacagcuccaacuaccaaauacaguuccuagacugguucuucgaaaaacaucaaggaaaaaaaacuucccuggaagucggaggaaguuucacaauagccgaaaaaagcuuaacaauugauuggucagguucgaacccaaggguaggauuuaagcgaucagauaccgaggaaaagagaguauucguaagccaaccauuuacauuaauucccgaugacgaagauaaagaacgaagaaaagaaagaaugauaaaaacaaaaaacagauucauaggaauagauauaggagaguacggacuagcuuggucacuaauugaaguagauaacggagacaagaauaauagagguauacgucaacuagagagcggauuuauaacagacaaucaacaacaaguacuaaaaaaaaauguaaaaucauggagacaaaaucaaauacgacagacauuuacaucuccugacacgaaaauagcaagacuaagggaaagccuaauuggaaguuacaaaaaucaacuagaaagccuaaugguggcaaaaaaagccaaucucaguuucgaauaugaaguaucagguuucgaaguaggaggaaaaagaguagcaaaaauauaugacucaauaaaaaggggaagcguaagaaaaaaagacaauaacucacaaaaugaccaguccugggggaaaaaaggaauaaaugagugguccuuugaaacaacugcagcaggaacaagucaauucuguacacauugcaaaagauggagcucacucgcaauaguagacaucgaagaauacgaacuuaaagauuauaaugauaaucuuuuuaaagugaaaauaaacgacggagaaguuagacuguuaggcaaaaaaggauggagaagcggggagaaaauaaaagguaaagaguuauucgggcccguaaaagacgcaaugagaccaaauguagacggguuaggaaugaaaauaguuaaaagaaaauaccugaaauuagauuuaagagauuggguuagcagauacgguaacauggcaauauucauauguccuuauguugauugucaccacauaagccaugcagauaaacaagcagccuuuaacaucgcaguccgaggauaucuuaagucagugaacccagauagagcaauaaagcauggagauaaaggacuaucgagagauuuucuaugucaagaagaaggaaagcuaaauuucgaacaaauuggucuacuauaa

SEQ ID NO: 11602 - RNA, 3462 nt, Artificial Sequence
  CasY variant__Candidatus Vogelbacteria bacterium__PIP58309.1__CasY
augcaaaaagucagaaaaacacuuucagaaguacacaaaaaccccuacggcacuaaaguaagaaacgccaaaacagguuauucacuacaaauagaaagacuaucauacacaggaaaagaaggaaugagaucauucaaaaucccauuagaaaacaaaaacaaagaagucuuugacgaauuuguaaagaaaauuagaaaugacuacauaagucaaguaggacuacucaauuuauccgacugguacgaacauuaucaagaaaaacaggaacauuacucacuagcagauuucuggcucgauagccuuagagcaggcguuaucuuugcucacaaagaaacugagaucaaaaaccuaauuucuaaaauaagaggcgacaaaaguauaguagauaaauuuaaugcauccaucaaaaagaaacacgccgaccuauacgcauugguagauauaaaagccuuauacgauuuccuaacaagcgaugcaagacgaggauuaaaaacggaagaagaauuuuucaacucaaaacgaaacacccuuuuuccaaaauuucgaaagaaagacaacaaagcaguagauuuauggguaaagaaauuuauaggacucgacaacaaagauaaauuaaacuucacaaagaaauuuaucggauucgauccaaauccacaaauaaaauaugaucauacuuucuuuuuccaucaggauauaaacuuugaucuugaaagaauaacaacacccaaagaauuaauauccacguauaagaaauuucucggcaaaaacaaagaccuguaugggucagaugaaacaacagaggaccaguuaaaaaugguacuaggauuccacaauaaucauggagcauuuuccaaauacuuuaaugccucucucgaggcauuuagaggcagagacaacaguuuaguagaacaaauaaucaacaacucaccauauuggaacagucaucgaaaagaacuagaaaaacgcauaauuuuucuccaaguccaaucaaagaaaauuaaagaaacagaacuagguaaaccacacgaauacuuagccaguuuuggaggaaaauuugaaucuugggucaguaacuaccuaagacaagaagaagaaguaaaaagacaacuguuugguuacgaagagaauaagaaaggacaaaagaaauuuauagugggcaauaaacaagaauuagacaaaauaauaagaggcaccgacgaauacgagauaaaagcgaucagcaaagagacaauuggacuaacacaaaaaugccuaaaauuauuagaacaacuaaaagacuccguagacgacuacacauugucccuauauagacaguuaaucguagaauuacguaucaggcuaaauguugaguuccaagaaacauaccccgaacucaucgggaaaagcgaaaaagacaaagaaaaagacgccaaaaacaaacgagccgauaaacgauauccucaaauauucaaagacauaaaguuaauaccaaacuuuuuaggugaaacaaaacaaauggucuacaagaaauuuauaagaucagcagacaucuuauacgaaggcauaaacuuuaucgaccaaauagacaaacaaauaacacaaaaccuacuaccgugcuucaaaaacgauaaagaaagaauugaguucaccgaaaaacaauucgaaacacuacgaaggaaauauuaccuaaugaacuccaguagauuccaccaugucauagaaggcauaauaaacaaucgaaaauuaauugaaaugaagaaacgcgaaaacucagaacuuaaaacauuuucagacagcaaauucguccuuucaaaacucuucuuaaagaaaggaaagaaauacgaaaacgaaguauacuacacauucuauauaaauccaaaagcacgcgaucaacgacguaucaaaauaguauuggacauaaauggaaacaauucaguuggaauacuccaagauuuaguacagaaauuaaaacccaaaugggacgauauaauaaagaaaaacgacaugggagaacugauugaugcaauugaaauagagaaaguaaggcucggaauuuuaauagcucuauauugcgaacacaaauuuaaaauuaagaaagaacucuuaagccucgaucucuuugccucagcauaccaauauuuagaacuagaagaugacccagaggaacuaucaggcacuaacuuaggaagauucuuacaaucuuuaguauguucugaaauaaaaggagcaaucaauaaaauuucucgcacugaauauaucgagcgauacacaguccagcccaugaauacugagaaaaauuacccacuccugauaaauaaagaaggaaaagcaacauggcacauagcggcuaaagaugaccuuaguaaaaagaaaggaggagggacaguagcuaugaaucagaaaauaggcaaaaacuucuucgguaaacaagauuacaaaacaguauucaugcuccaagacaaacgauucgaccugcuaacuucaaaauaccacuuacaauucuuaucaaaaacccuugauacagguggcggaucaugguggaaaaacaaaaacauagacuugaaccuaaguucauacucauuuauauucgaacaaaaaguaaaaguagagugggaccuuaccaaccucgaucacccuauaaaaauaaaaccuagugaaaacagcgacgaucgaaggcuauucguuucaauaccauucgucaucaaaccaaaacaaacaaaaagaaaagauuuacaaaccagaguaaauuacauggggauagauauaggcgaauacggccuagcauggaccauuaucaauauagaccucaaaaauaagaaaauuaacaaaauuucuaaacaaggauuuauauacgagccacuaacucauaaaguaagagauuacguagcaacgauuaaagauaaucaaguaagaggcacauucgguaugccggacacaaaacuugcaagacuaagagaaaaugcaauuacauccuugagaaaucaaguccaugauaucgcuaugagauacgaugcaaaaccaguuuaugaguucgaaauaucuaacuucgaaacaggcaguaacaaagugaaagugaucuacgauucaguuaaaagagcagauauaggaaggggacaaaacaacacugaagccgacaauaccgaaguaaauuuaguauggggcaaaacaucaaaacaauucggaucgcaaauaggagcauacgcaaccagcuacauaugcagcuuuugcggauacaguccuuacuacgaauuugaaaacucuaaaucaggugacgaagaaggagcaagagacaaccuauaucaaaugaagaaacucagccgaccaagccuugaagauuuccuacagggaaacccaguguauaaaaccuucagagauuucgauaaauacaaaaaugaccaacgauuacagaaaaccggagauaaagacggggaauggaaaacgcauaggggaaacaccgcaauauaugcaugccaaaaaugcuaa

SEQ ID NO: 11603 - RNA, 3480 nt, Artificial Sequence
  Cas13a variant__Leptotrichia buccalis__WP_015770004.1__Cas13a
augaaaguaacaaaaguaggagggauaagccauaagaaauacacgagcgaagggcgccucguaaaauccgaaucagaagaaaaccgcaccgacgaacgccucagcgcccugcuaaauaugcgccucgacauguacaucaaaaaucccagcagcacagaaaccaaggaaaaccagaagcgcauaggcaaacucaagaaauucuuuuccaauaaaaugguauaccuaaaagacaacacgcuaucgcuuaagaauggcaagaaagaaaacauagacagagaauacuccgaaaccgacauacuagaauccgacguccgggacaagaaaaacuucgcugugcugaagaaaaucuaccuuaacgaaaacgucaacuccgaggaacucgaaguuuuccgaaacgacaucaaaaagaaacucaauaaaaucaacucacuaaaauauuccuucgagaaaaacaaagccaauuaccagaaaaucaacgagaacaacaucgaaaagguagagggaaaaucgaagcgcaacaucauauacgacuauuaccgcgaaucagccaaacgggaugccuacguuuccaacgucaaagaggcuuucgacaaacuuuacaaagaagaagacauugcgaaacugguacuagaaaucgagaaccugaccaagcuagagaaauauaaaauccgagaguuuuaccacgaaauaaucggacgcaaaaacgacaaagaaaacuucgcgaagaucaucuacgaggaaauccaaaacguaaacaacaugaaagaacuuauagagaagguuccggacaugucggagcucaaaaagucacagguauucuacaaguacuaccuggacaaagaggaauuaaacgauaaaaacaucaaguaugccuuuugccacuucguagaaauagaaaugagccagcuacucaaaaacuacgucuacaaacgucuaucaaacaucucgaacgacaaaaucaagcgcaucuucgaguaccagaaccucaagaaacuuauugagaacaagcuccucaacaagcucgacaccuacgugcgcaacuguggcaaauacaacuacuaccuccaagacggugagaucgccaccagcgacuucaucgccaggaaccgacagaacgaagcauuccucagaaacauuaucggcgucagcagcguggccuacuuuagcuuacgcaacauccuagagaccgagaacgagaacgauaucacaggacguaugcgaggcaaaaccgugaaaaacaacaagggcgaagagaaauacguguccggcgaagucgacaagaucuacaacgaaaacaagaaaaacgaagucaaggagaaucucaagauguucuacuccuacgacuucaacauggauaacaaaaacgaaaucgaagacuucuucgcuaauaucgacgaagcgaucagcucaauccgacacggaauagugcacuucaaucuagaacuggagggaaaagacaucuucgcauucaagaacauugcccccagcgaaaucagcaagaaaauguuccaaaaugaaaucaacgaaaagaaacugaaacuaaaaaucuuccgccagcuaaauagcgcuaacgucuuccgcuaccucgaaaaauacaaaauacucaacuaccugaaacgcacacgauucgaguucguaaacaagaacauccccuucguaccguccuuuacaaaauuauacagccgcaucgacgaccucaagaacagccucggcaucuauuggaaaaccccgaaaacaaacgacgacaacaagaccaaagaaaucauagacgcucaaauauaucuccucaagaacaucuauuacggcgaguuccucaacuacuucaugucgaacaacgguaacuuuuucgaaaucagcaaagaaaucaucgaacuuaauaagaaugacaaaaggaaccucaaaacgggcuuuuacaaacuacagaaauucgaagacauccaagaaaagaucccaaaagaauaccucgccaacauacaaagccucuacaugaucaaugccggcaaccaggacgaagaggaaaaagacaccuacauugacuucauccagaaaaucuuucugaagggauuuaugacauaccuugccaacaacggacgccucagccucauauacaucggcuccgaugaggagacuaacaccucguuagcggagaagaaacaagaguuugacaaauuccucaagaaauacgaacaaaauaacaacaucaaaauaccguacgagaucaacgaguuccuccgcgaaaucaaacucggaaacauuuuaaaauacaccgaacgccucaacauguucuaccucauccuuaaauuacuuaaccauaaagagcucacaaaccuaaaagguagucuagagaaauaccaaagcgcgaauaaagaagaggccuucagcgaccaacucgaauuaauaaacuuauuaaaccuagacaauaaccgaguaaccgaggauuucgagcucgaagcagacgaaauagggaaauuccuagacuucaacggaaacaaaguaaaagacaacaaggaacuaaagaaauucgacacaaauaaaaucuacuucgacggugaaaauaucauaaaacaccgggcauucuacaauaucaaaaaguacggaaugcuaaaucuauuagagaaaauugccgacaaggcgggcuauaaaauaucaauugaggaacugaagaaauacucaaacaagaaaaacgaaaucgagaaaaaccacaaaaugcaggaaaaucuccaccgcaaguacgcacgaccucguaaagacgaaaaguucaccgacgaggacuacgagucauacaagcaagccauagagaacaucgaagaauacacacaccucaaaaacaaggucgaguucaacgaacuuaacuuacuucaggggcuguugcugcgcauacuccaccggcuuguagguuacacaucaaucugggaacgcgaucuccgguuccgccuaaaaggcgaauuucccgaaaaccaauacaucgaagaaauauucaacuucgaaaacaagaagaacguaaaauacaaaggaggacagauaguggaaaaguacauaaaguucuacaaagaacuccaccaaaacgacgaaguaaaaauaaacaaguauagcagcgcgaacaucaagguccuaaagcaggagaaaaaggaccuauacauccgcaacuacaucgcgcacuucaacuacauaccccacgcagaaaucagccuacuagaagugcuugaaaaucucaggaagcuccucuccuacgaccgcaaacucaaaaacgcaguaaugaagucagucgucgacauccuaaaggaauacggauucgucgcgaccuucaaaaucggagccgacaaaaagaucggcauccaaacccuggaaucggagaaaaucgugcaccucaaaaaccuaaagaaaaagaaacucaugaccgaccgcaacagcgaagaacucugcaaacuugucaaaaucauguucgaauacaaaauggaagaaaagaaaagcgaaaacuaa

SEQ ID NO: 11604 - RNA, 3480 nt, Artificial Sequence
  Cas13a variant__Leptotrichia buccalis__WP_015770004.1__Cas13a(R472A,H477A)
augaaggucaccaaggucgggggcauaagccacaagaaauacaccagugagggccgccuaguuaagucugaguccgaggaaaaccgcaccgacgaaagacucagcgcccuccuaaacaugcgccuagacauguacauaaaaaacccaucaucaaccgagaccaaagaaaaccaaaagagaauaggcaagcuuaaaaaauucuucagcaacaagaugguuuaucucaaggacaacacacuaucacucaagaacggaaagaaagaaaacaucgaccgcgaauacagugaaaccgauauacucgagagcgaugucagagacaaaaaaaacuucgccgugcuaaaaaaaauauacuugaaugaaaacguuaauagugaagagcuagagguauuucgcaaugacaucaagaagaaacugaacaaaaucaacagcuugaaguacucauucgaaaaaaacaaggcaaacuaccaaaagaucaacgaaaacaauauagagaaagucgagggaaaauccaagcgaaacaucauauacgauuacuaccgcgaauccgcuaaaagagacgcauacguaagcaacguaaaagaagccuucgauaagcuauacaaggaagaggacaucgccaaauuggucuuggaaauagaaaaccucacaaaacuggaaaaauacaaaauacgagaguucuaccacgagaucaucgggcgcaaaaacgacaaagaaaacuuugccaaaaucaucuacgaagagauacagaacguaaacaacaugaaagagcuaaucgagaaaguaccagacaugagugagcugaagaaaagccaaguuuucuacaaguacuaccuugacaaagaggaacucaacgacaaaaacaucaaauaugcauucugccacuucguagagauugaaaugagccaguugcuaaagaacuaugucuacaaaagacuuagcaacauaagcaacgacaaaauaaagcggauauuugaauaucagaaccucaaaaaacucaucgagaacaaacuacuuaacaaacucgacacuuacguacgcaauugcggcaaauacaacuacuaccuacaagacggcgaaauagcaacgagcgacuucaucgcgcgaaaccggcagaacgaagcauuccuccgaaacauaaucggcgucucuagcguagccuacuucucauugcgcaacauccucgaaacagaaaacgaaaacgauauaacuggccgcaugcgagggaagaccguaaagaacaauaaaggcgaagaaaaauacgucagcggggaaguggauaaaaucuauaacgagaacaagaaaaaugaggucaaagaaaaccucaagauguuuuacucguacgacuucaacauggacaacaaaaacgagaucgaggacuucuucgcaaacaucgacgaggccaucuccagcauagcgcauggcauaguugcguucaacuuggagcucgaaggcaaagauaucuuugccuucaagaacaucgcccccuccgagaucuccaaaaaaauguuccaaaacgaaaucaaugagaagaagcucaaacugaaaaucuuccgccaacucaacagugcaaacguguucagguaccucgagaaauacaaaauacugaacuaucuaaaaagaacacgcuucgaguucguaaacaaaaacauccccuucgugcccucauuuaccaaacuauacucacgaauagacgaccucaaaaacucccuggggauauacuggaagacuccuaaaaccaacgacgacaacaagacaaaagaaaucauagacgcacagauauaccuacuaaagaauauuuacuauggagaguuccuaaauuacuucaugucgaacaauggcaacuuuuucgagauauccaaagaaauaauagagcugaacaagaacgacaaaaggaaccucaaaacaggauucuacaaacuccaaaaauucgaggacauccaagaaaagauccccaaagaauaccuggcgaacauacagucacucuacaugaucaacgccgggaaccaagacgaggaggaaaaggacacguacauugacuuuauacaaaagaucuuccucaaaggguucaugacguaccuggcaaacaacggucgccuaagccugaucuacauaggcuccgacgaagagaccaacacgucgcuggcggagaaaaagcaagaguucgacaaauuccucaaaaaauacgaacaaaacaacaacaucaaaaucccauacgaaauuaacgaguuccugagagaaaucaaacucggaaauauacuaaaauacacggaacggcuuaacauguucuaccuuauucuaaaacucuuaaaccacaaagagcucacgaaccuaaaaggcagccuagagaaauaccagucggccaacaaagaagaggccuucuccgaccagcucgaauugauuaaccugcucaaccuugacaacaacaggguaacugaagacuucgaacuggaagccgacgaaauuggaaaguucuuagacuucaacggcaacaagguaaaagacaacaaagaacuaaaaaaguuugacacgaacaaaaucuacuucgacggggagaauauuauuaaacacagggcauucuacaacaucaagaaauacggcaugcucaaccuacuggagaaaaucgccgacaaggcaggauacaagauaucgauagaagaacucaaaaaauacagcaacaagaaaaacgagauugaaaagaaccauaagaugcaggaaaaccuucacaggaaauacgcacgcccccgaaaagacgaaaaguucaccgacgaagauuacgaaagcuacaagcaggccaucgaaaacauagaagaauacacacaccucaaaaacaaagucgaauuuaacgaacucaaccuccuacaaggacuccuacuccgcaucuugcaucgccugguaggguauaccagcauuugggagcgagaccuccgcuucagacucaagggggaguuccccgagaaccaauauaucgaagaaaucuuuaacuucgagaacaagaaaaacguaaaauacaaaggaggccagauaguggaaaaauacaucaaguucuauaaagagcuccaccagaacgacgaggugaagaucaacaaauacucaagugcgaacaucaagguacugaagcaagagaagaaagaccuguacauccgcaacuacauagcccacuucaacuacaucccacacgccgagauuucccuccuugagguacucgagaaccugcgcaaacuccuaagcuacgacaggaagcugaaaaacgcggugaugaaaagcguaguagacauacucaaggaauacggauucguggcaaccuucaaaaucggcgcagacaagaaaaucggcauacagacucuugagagcgaaaagaucgugcaccuaaaaaaccuaaagaaaaaaaaguuaaugaccgaccgcaacagcgaagaacuaugcaaacucgugaagaucauguucgaguacaagauggaggaaaaaaaauccgagaauuag

SEQ ID NO: 11605 - RNA, 3480 nt, Artificial Sequence
  Cas13a variant__Leptotrichia buccalis__WP_015770004.1__Cas13a(R1048A,H1053A)
augaaagucaccaaggucggaggcauuucacacaaaaaauacacaagcgagggcagacuagucaaaagcgaaagcgaagagaaccgaaccgacgagcgcuuaagugcccuacucaacaugcggcucgacauguacaucaagaauccgaguagcaccgaaaccaaggagaaccaaaagcggaucggaaaguugaaaaaauucuucagcaacaaaaugguauauuuaaaggacaacacgcuuagucuaaaaaacggcaaaaaggaaaacaucgaccgagaauacucggaaaccgacauacucgaaagugacguacgggauaaaaagaacuucgcaguccucaaaaaaauauaccuaaacgaaaacgugaacagugaggaacucgaaguauuccgaaacgacauaaaaaagaaacuaaacaaaaucaauucgcuaaaauacucauucgaaaaaaacaaagcgaacuaccaaaaaaucaacgagaacaacaucgagaagguggagggcaaguccaaacgcaacaucaucuacgacuacuaccgcgaaucagcgaaacgagacgcguaugucucaaacgugaaagaagccuucgacaaacuguacaaagaagaggacaucgcaaagcucguucucgagauugagaaucucaccaaacuagagaaguauaagauucgcgaauucuaccacgagaucauaggccgcaaaaaugacaaagaaaacuucgcgaaaaucauauacgaagagauccaaaauguaaauaacaugaaagaacucaucgagaagguacccgauaugucagaacugaaaaagucgcaggucuucuauaaguacuaccucgacaaggaggaauugaacgacaaaaacaucaaguacgccuucugccacuucguagaaaucgaaaugucucaguuacucaagaacuacguuuauaaacgcuugucgaauauuucgaaugacaaaaucaaaaggaucuucgaauaccagaaccucaagaaacuuauagagaacaaacucuuaaacaaauuggacacauacgugcggaacugcggcaaauacaacuacuacuuacaagauggcgaaauagcaacgagugacuucaucgcacgcaaccgccagaaugaggcguuccucaggaacaucauaggagucagcucaguggcauauuucagccuccgcaacauccuagaaaccgaaaacgaaaacgacaucaccggccgaaugagaggcaaaacagugaaaaauaacaaaggcgaggagaaauaugugagcggugaggucgacaaaauuuacaacgaaaauaaaaaaaacgaggucaaggagaaccucaaaauguucuacagcuacgacuucaacauggacaacaaaaacgaaauagaggacuucuucgccaacaucgacgaggcaauaagcucgauacggcacggcaucguccacuucaaccuagaacuggaaggcaaagacaucuucgccuucaaaaacauagccccauccgaaaucuccaagaaaauguuccaaaacgaaaucaacgagaaaaaacugaagcugaagaucuuccgacagcugaacucagccaacgucuuuagauaccuggagaaauauaaaauacucaacuaccucaaacggacccguuucgaauucgucaacaaaaacaucccauucguaccaucauucaccaagcuguacucgcgaauagacgacuugaagaacucguuaggcaucuacuggaagacgcccaaaaccaaugaugacaacaagaccaaggaaauaaucgacgcccaaaucuaccuucuaaaaaacauauacuacggcgaauuccuaaacuacuucauguccaacaaugggaacuuuuucgaaauuagcaaggagauuauagagcucaacaagaacgacaagaggaaucuaaaaacaggauucuacaagcuacaaaaauucgaagacauccaagaaaaaauacccaaggaauaccuagcuaacauccaaagccucuacaugauaaacgccggcaaccaagacgaagaggagaaagacacguacaucgacuucauccagaagaucuuucuaaaaggauucaugacauaccuagccaacaacggcagacuaagccuaaucuacaucggcuccgacgaagaaacgaauacgagccucgccgagaaaaaacaggaauucgacaaauuccucaaaaaauacgaacagaacaacaacaucaagauaccguacgagaucaacgaguuccuccgagagaucaaacuaggcaacauacucaaauacacggaacggcugaacauguucuaccuuauccuuaagcuccuaaaccacaaagaauugaccaaucucaaaggcagccuggaaaaguaccaauccgcaaacaaagaagaggcauucagugaccagcuagaacuaaucaaucuccucaaccucgauaauaaccgcgucaccgaagauuucgagcucgaggcagacgaaauaggaaaauuccucgacuucaacggcaacaaagugaaagacaacaaagagcucaaaaaauuugacaccaacaaaauauacuucgacggggaaaacauaauaaaacaucgcgcguucuauaacauaaaaaaauacggaaugcuaaacuuacuggagaaaaucgccgacaaagccggauacaagaucuccaucgaagagcuaaaaaaauacagcaacaagaagaacgaaaucgagaaaaaccauaaaaugcaagagaaccuccaccgcaaguacgcucgcccgcggaaggacgagaaguucaccgacgaggacuacgaaagcuacaaacaagcaauugagaacaucgaggaauacacgcaccucaaaaacaaagucgaguucaacgaacugaacuuacuacaagggcuccuccucagaauacuccacagacuuguaggauacacuaguaucugggaacgcgaucuccgguuucgacucaaaggggaauucccggaaaaccaguacauagaagaaauauucaacuucgagaacaagaagaacguuaaguacaaaggcggacagaucgucgagaaguacaucaaguucuacaaagagcuccaucaaaacgacgaagucaaaauaaacaaauacagcuccgccaacauuaaaguacucaagcaagaaaagaaagaccucuacauagccaauuacauagcagcauucaacuacauuccacacgccgagauaucacuucuugagguccuugagaacuuacgaaagcuacucucauacgacagaaagcugaagaaugcaguaaugaagagcgucgucgacauacugaaggaauacggcuucgucgccacauucaagaucggagccgacaaaaagaucggcauccagacgcucgagucggaaaaaauugugcaccugaagaaccuaaagaagaaaaaacuuaugaccgacagaaacagugaagagcucuguaaguuaguaaaaauaauguucgaauacaagauggaagaaaaaaaauccgagaacuga

SEQ ID NO: 11606 - RNA, 3480 nt, Artificial Sequence
  Cas13a variant__Leptotrichia buccalis__WP_015770004.1__Cas13a(R472A,H477A,R1048A,H1053A)
augaaaguuaccaaagucggaggcauaucgcacaagaaauacacuuccgaaggcaggcucguaaaauccgaaucugaagaaaaccgaaccgacgagcgauuaagugcccuccuuaauaugaggcucgacauguauaucaaaaacccgagcuccaccgaaaccaaagagaaccagaaacgcauaggcaaacugaagaaauucuucucgaauaaaauggucuaccuaaaagacaacacguuaagccuuaaaaauggaaagaaagaaaacaucgacagagaauacuccgagaccgacauccuagaaucggacguccgagacaagaaaaacuucgcaguccucaagaaaaucuaccucaacgagaacguaaacucagaggaacucgaggucuuucggaacgauaucaagaagaaacucaacaaaaucaacagccucaaauacagcuucgagaaaaacaaagcaaauuaccagaaaauaaaugaaaacaauauagaaaaaguagaaggcaaaagcaaacgcaacauaauauacgacuacuaccgagagagcgcgaaaagagacgccuacgucucgaauguaaaggaagcauucgacaagcucuacaaagaagaggacaucgcaaagcuaguacuagagauagaaaaccuaacgaaacuggaaaaauacaagaucagggaguuuuaccacgaaaucaucggacgcaaaaacgacaaagaaaacuucgccaaaaucaucuacgaagagauccaaaaugucaauaauaugaaagaguugaucgaaaaaguacccgacaugagcgaacucaagaaaagccaagucuucuacaaguauuaccucgauaaagaggaacuaaacgacaaaaacaucaaguacgcauuuugccacuucgucgaaauagaaaugucccaacugcucaagaacuacguguacaaaagacuauccaacaucaguaaugacaaaaucaaaagaaucuuugaauaccagaaccucaagaaacuaauagagaacaagcuccuuaacaagcuggacaccuacgucagaaacuguggcaaauauaauuacuaccugcaggacggcgaaaucgcgaccucggacuuuauugccagaaaccgccaaaacgaggcguuccugaggaacauuauaggagugagcaguguugccuacuucucccuacgcaacauccuggaaacagaaaacgagaacgauauuacaggccgcaugcgaggcaaaaccgucaaaaacaacaaaggggaagaaaaauacguaagcggcgaggucgacaaaauauacaacgaaaacaaaaagaacgaaguaaaggaaaaucugaagauguucuacuccuacgacuucaacauggacaacaaaaacgaaaucgaggauuucuuugcaaauauagacgaagccaucuccagcauugcccacggcauaguggccuucaacuuggaacuugagggcaaggauaucuucgcauucaaaaacaucgcccccagcgagaucuccaagaaaauguuccagaaugaaauaaacgagaaaaagcucaaacuuaaaauauuccgucagcugaacucggcgaacgucuuccgauaccucgagaaauacaagauccucaacuaccuaaaacgcacucgguuugaguucgucaacaaaaacaucccauuugugcccagcuucaccaaacucuauucccggaucgacgaccucaagaacucccuaggcauuuacuggaagaccccgaaaacaaacgacgacaacaagaccaaggaaauaauagaugcgcagaucuaccuacucaagaacauauacuacggcgaguuccugaacuacuucaugagcaacaauggcaacuuuuucgaaaucagcaaagaaaucaucgaacucaacaagaaugacaaacgcaaccucaaaaccggcuucuacaaacuacagaaauucgaggacauacaagagaaaauuccaaaagaauaccuagcaaacauccaaucacucuacaugaucaacgcgggcaaucaagaugaagaggaaaaagacaccuauaucgacuuuauacagaaaaucuuccuuaagggcuucaugacauaccucgcaaacaacggcagacucucccugauuuauaucgggagcgacgaagaaaccaacaccagucuagccgagaagaagcaagaguucgacaaauuccuaaagaaauacgaacaaaauaacaacauaaaaaucccguacgaaaucaacgaguuccuaagggaaauaaaacugggaaacauccuaaaguacacagaacggcucaacauguucuaccugauccuaaaacuucuaaaccacaaagaacucacgaaccuaaaggguucucuagaaaaauaccagucggcaaacaaggaggaggcauucagcgaccaacuagagcuaauaaaccuccugaaccuugacaacaaucgaguaacggaagacuucgaauuagaagcggacgaaauugggaaauuucuagacuucaacggcaacaagguaaaggacaacaaagaauugaagaaauucgacacaaacaaaauuuacuucgacggugagaacaucaucaagcaccgcgcuuucuacaacaucaagaaauacggaaugcucaaccuacucgaaaagaucgccgauaaagcagguuacaagauauccaucgaggaacucaaaaaguauagcaacaagaaaaacgaaaucgaaaagaaucacaagaugcaagaaaaccuacaccgcaaauacgcacgaccacgcaaagacgaaaaguucacagacgaggacuacgaauccuacaaacaggccauagagaacaucgaagaauacacacaucucaaaaacaagguagaguucaacgaacugaaccuacuacaaggacugcuacuccgcauccuacaccgacuggucggcuacaccagcauuugggaacgagaccugcgcuuuagacucaaaggggaguucccggaaaaccaguacauagaagaaaucuucaauuucgaaaacaagaaaaacgucaaauacaaaggaggccagaucguagaaaaauacaucaaguucuacaaggagcuacaccagaaugacgagguaaaaaucaacaaguacucauccgccaacauuaaaguccucaaacaagagaaaaaggaccucuacaucgcgaauuacauagcagcguucaacuacauaccccaugccgaaauaucuuuacuugaaguccuggaaaaccuccgcaaacuccugucuuacgaccgcaaguuaaagaacgccguaaugaaauccguagucgacauacuaaaagaguacggguuugucgccaccuuuaaaaucggagcagacaaaaagauagggauccaaacccucgaaucagaaaagaucguccaccucaaaaaccugaagaagaagaagcugaugaccgaccgaaacuccgaagaacugugcaaacucgucaaaauaauguucgaauacaagauggaagaaaagaaauccgagaacuaa

SEQ ID NO: 11607 - RNA, 3480 nt, Artificial Sequence
  Cas13a variant__Leptotrichia buccalis__WP_015770004.1__Cas13a(R1079A)
augaaaguaacaaaagucggcggcaucagccacaagaaauacacguccgaaggacggcuaguaaaaagcgaauccgaagaaaaccggaccgacgaacgccuuucggcccuacucaacaugcgccucgacauguauaucaaaaacccaagcucuacagaaacaaaagaaaaucagaaaaggaucgggaaacucaagaaauucuuuaguaacaaaauggucuaccuuaaagauaacacacuaucccucaaaaacggcaagaaagaaaacauagaccgugaauacucggaaacagacauccuagaaagcgacgucagagacaagaaaaacuucgccguacuaaagaaaaucuaccuaaacgaaaacguaaacagugaagaacuggaaguguuccgaaacgacaucaaaaagaaacugaacaaaauaaauagccugaaauauucuuucgagaaaaacaaagcgaauuaccagaaaaucaacgaaaacaacauagaaaaagucgaaggcaaaaguaaacgaaacauuaucuacgacuacuaccgggaaucagccaaaagagacgccuacgucagcaacgucaaagaagcguucgauaaauuauacaaagaagaagacaucgcgaaacucguucuagaaaucgaaaaccuaaccaaacuagaaaaguacaaaaucagggaguucuaccacgaaaucauagggcgaaagaacgacaaggaaaauuucgcaaaaauaauauacgaggaaauccaaaacgucaacaacaugaaagaacucaucgaaaaggucccggacaugagugaacucaagaaaucgcaaguauucuacaaguacuaucuagacaaagaagaacuuaacgacaaaaacaucaaauacgccuucugccacuuuguagaaauagagaugucacaacuccucaagaacuacgucuacaagcggcuauccaauauuagcaacgacaaaaucaagcgcauauucgaguaccagaaccucaaaaagcuaauagagaacaagcuccugaacaaacuggacacauacguacgcaacugcgggaaguacaacuacuaccuacaagacggggaaaucgcgaccucggacuucauagcgcgaaaccgucagaaugaggcauuccuacgcaacauaaucggcguaucauccguggcauacuucagccuaagaaacauccuagagacggaaaacgaaaacgauaucaccggccgaaugcgcgggaaaaccgugaagaacaacaagggugaggaaaaauacguaucaggagaagucgacaagaucuacaacgagaacaagaaaaacgagguaaaggaaaaccucaaaauguucuauagcuacgacuucaacauggacaacaaaaaugaaauagaggacuucuuugcgaacauagaugaggcaauuagcucgauccgacacggaauaguccacuucaaccucgaacuugaaggcaaagacaucuucgccuucaagaauaucgcacccagcgaaaucagcaagaaaauguuccagaacgagauaaacgagaagaaacuaaaacucaaaauauuccgccaacuaaacuccgccaacgucuuucgauaccuugaaaaguacaaaauccuaaacuaccugaagcgcacccgauucgaguucgucaacaagaacauucccuucguccccaguuucaccaaacuauacucgcggaucgacgaccucaaaaacucgcucggaaucuacuggaagacacccaagacaaacgacgacaacaaaaccaaagaaaucaucgacgcgcagaucuaucuacuaaagaacaucuacuauggcgaguuccucaacuacuucaugucaaauaacggcaacuucuucgagaucucgaaagagaucaucgagcugaacaagaacgauaagaggaaccugaaaaccgguuucuacaaacuacagaaauucgaagauauccaagagaaaauaccgaaggaguaccucgcgaacauacagucccucuacaugaucaacgccggaaaccaagacgaggaagaaaaggauacauacaucgacuucauccaaaagauauuccucaaaggguucaugaccuaccuugccaauaacggacgccucagccuaauauacaucggcucugacgaggaaacgaacacaucccuugccgaaaagaaacaagaguucgauaaauuccuuaagaaauacgaacaaaacaacaauauaaagaucccguacgaaauaaacgaguucuugcgggagauaaaacucggcaacauacuuaaauacaccgagagacugaacauguucuaccucauuuugaaacuccucaaccacaaagagcucaccaaccugaaaggaagccuagaaaaauaucagucagcgaacaaggaagaggcauucucagaccagcuagaacugaucaaccugcuuaaccuggacaacaaccgagugacagaagacuucgaacucgaagcagacgagaucggcaaauuccuagacuucaacggcaacaaagugaaagacaacaaagagcucaagaaauucgacacaaacaaaaucuacuucgacggcgaaaacauaauaaaacaucgcgcauucuacaacauuaaaaaguacggaaugcucaaucugcuagagaagaucgcggacaaagcgggcuacaagauaucaaucgaagaacucaaaaaguauucaaacaagaaaaacgaaauugagaaaaaccacaaaaugcaggaaaaccuccaccgaaaauacgccagaccacgaaaggacgaaaaguucaccgacgaggacuacgaaucauacaagcaagcaauagaaaacaucgaagaauauacccaccucaaaaacaaaguagaguucaacgaacugaaccuacugcaggggcugcuccuacgcauccuccaccgccucguaggauauaccuccaucugggaacgagauuugcgguuccgcuuaaagggagaauuucccgagaaccaguacauagaagaaaucuucaacuucgaaaacaagaagaacgucaaguacaagggaggacaaaucgucgagaaauacaucaaguuuuauaaggaguuacaccagaacgaugaagucaaaauaaauaaguacagcucggcaaauaucaaggucuuaaaacaagagaagaaagaucucuacauacgcaauuauaucgcacauuucaauuacauaccgcacgcggagaucagccuccuagagguacucgaaaaccuaagaaaacuccuaucauacgacgcgaagcucaagaacgcaguuaugaaaagcgucguagauauccuuaaggaauacggcuucguggccacauucaagaucggcgccgacaagaaaauugggauacagacacuggaaucagagaaaauaguccaccugaaaaacuugaaaaagaaaaagcucaugacggaccggaauagcgaagaacugugcaaacucgugaagaucauguucgaguacaaaauggaggagaagaaaagcgagaacuga

SEQ ID NO: 11608 - RNA, 3480 nt, Artificial Sequence
  Cas13a variant__Leptotrichia buccalis__WP_015770004.1__Cas13a(E299A)
augaaagucacaaaagucggagggauuagccacaagaaauacaccagugagggcagacucguuaaaucagaauccgaagagaaccgaacagacgagaggcucucagcgcuucucaacaugaggcuagacauguacaucaaaaaucccaguagcaccgaaacaaaagaaaaucagaaacgcauaggaaaacucaagaaauuuuucuccaacaaaauggucuaccucaaagauaacacccuuucccucaaaaacggcaagaaagaaaacaucgaccgcgaauauuccgaaacagacauccuagaauccgacguaagagacaagaaaaacuucgcaguucuaaagaaaaucuaccugaaugaaaacgucaacagcgaagaacuagaaguauuccggaaugacaucaaaaagaaacucaacaaaauaaauagccucaaauacagcuucgagaaaaacaaagcgaauuaucagaaaaucaacgaaaauaacaucgaaaaaguggaagggaaaagcaaaagaaacauaaucuacgacuacuacagggaauccgcaaaaagagacgcauacgugagcaacgucaaagaagccuucgacaaacuauacaaggaagaagacauagcuaaacucguacucgaaaucgaaaaccucacaaaacuagaaaaauacaagauccgcgaguucuaccacgaaaucaucggaaggaagaacgacaaagaaaacuucgcuaaaauaauauacgaggaaauccaaaauguaaacaacaugaaagaguuaaucgaaaagguaccggacauguccgaauuaaagaaaagccaaguauucuacaaguacuaccuagacaaagaggaacucaaugacaaaaacauaaaauacgcauucugccacuucgucgagaucgccaugagccaacuccugaagaacuacgucuauaaaagacuuuccaauaucagcaacgacaaaaucaagcgaaucuucgaguaccagaaccugaagaaacucaucgaaaacaaacuccugaacaaacuggacacguacguccgaaacugcggaaaguacaacuauuaccuacaagacggugagaucgcaaccagcgacuucaucgcacgaaaccggcaaaacgaagcguuccuccggaacaucaucggaguaucguccguagccuacuuuucgcuccggaacauccuggagacggagaacgagaaugacaucacgggcagaaugagaggcaaaacagugaaaaacaacaaaggcgaagagaaauaugucucgggcgaagucgacaaaauauacaacgaaaacaaaaagaacgaaguuaaagagaaccugaaaauguucuacuccuacgacuucaacauggacaacaagaacgaaauagaagauuucuucgccaauaucgacgaagcuauaucguccauccgccauggcauaguccacuucaaccucgagcucgaggggaaagacauauucgcuuucaaaaacaucgcaccauccgaaauaucaaagaagauguuccaaaacgagauaaaugagaagaaacucaaacuuaaaauauuccgccaacucaacuccgcaaaugucuuccgguaccucgagaaauacaaaauccuaaacuaccuaaaacgcacccgcuucgaguucguaaacaaaaacaucccauucgugccguccuucacaaaacuuuacucacgaauagacgaccucaagaacagccuuggaauauacuggaaaacccccaaaacgaaugacgacaauaagacuaaagaaauaauugacgcacaaaucuaccuccugaagaacauauacuacggcgaguuccucaacuacuucaugagcaacaacggaaacuucuucgaaaucagcaaggagauaaucgaacucaacaaaaacgacaaacgaaaccucaaaaccggauucuauaagcuccagaaauucgaagacauccaggaaaagaucccuaaagaauaucuggccaacauccaaagccuauauaugauaaacgccggaaaccaggacgaagaagaaaaagacacauacaucgacuucauccagaagaucuuccugaagggcuuuaugacguaccuggcgaacaauggacgacucucgcugaucuacaucgggagcgacgaagaaaccaacaccucacuagccgaaaagaagcaagaguucgauaaguuccugaagaaauacgagcaaaacaacaacauaaaaauaccauacgagaucaacgaguucuuaagagaaauuaagcucgggaacauccuaaaauacacggaacggcugaacauguuuuaccucauccucaaacuccuaaaccacaaagaacucacaaaccuuaaagggagccuggaaaaguaucaguccgcaaacaaggaagaggccuucuccgaccaacuggagcucaucaaccuacucaaccucgacaacaaccgcgucacagaggauuucgagcucgaggccgacgaaauaggaaaauuccucgacuuuaacgggaacaagguaaaggacaacaaagagcugaagaaauucgauacaaacaaaauauacuucgacggcgaaaacaucauaaaacaccgggccuucuauaacauaaagaaauacggaaugcugaaccuuuuagaaaagaucgcagacaaagccggauacaaaaucuccaucgaggagcucaaaaaguacagcaacaaaaagaaugagaucgaaaagaaccacaaaaugcaagaaaaccuucaccgcaaguacgcacggccucgcaaagaugaaaaauucacagacgaagacuacgaaucuuacaaacaggccaucgaaaacaucgaggaguacacucaccucaaaaacaaagucgaguucaacgaacucaacuugcuccaagggcuacugcucagaauccuccaccgacucgugggcuacacuucgauaugggagcgcgaccuccgcuuuagauugaaaggcgaguucccugaaaaccaauacauagaggaaaucuucaacuucgaaaauaagaaaaacguaaaauacaaaggaggucaaaucguagagaaauauauaaaauucuauaaagagcuccaucagaacgacgaggucaagaucaacaaguacuccagcgccaacauaaaaguccucaagcaagagaagaaagaccuauacauccgcaacuacaucgcccacuucaacuacauaccacacgcagaaauaagucuacucgaaguccucgagaaccuccgcaaacuccuaagcuacgaccgaaaacucaagaaugccguaaugaaauccgucguggauauacuaaaagaauauggcuucgucgcaaccuucaaaauaggcgccgauaagaaaaucgggauucagacacucgagagcgaaaagaucguacaucuuaaaaacuuaaagaagaagaaacucaugacugacagaaacucagaagaauugugcaaacuggucaaaaucauguucgaguacaaaauggaggagaaaaaguccgagaacuag

SEQ ID NO: 11609 - RNA, 3480 nt, Artificial Sequence
  Cas13a variant__Leptotrichia buccalis__WP_015770004.1__Cas13a(K310A)
augaaagucaccaaggugggcggaauaagccacaagaaauacaccucagaagggcggcuagucaaguccgaaagcgaggagaauagaaccgacgaacgccuguccgcucuccucaacaugcgccucgacauguauaucaaaaacccaagcucgacggaaaccaaggagaaccaaaaacggauuggaaaacuaaagaaauucuucucaaacaaaaugguguaccuaaaagacaauacucuuagucucaaaaacgggaagaaagagaacauugacagggaguacagcgaaacugacauccuagaaagcgacguccgggacaagaaaaacuucgccguuuuaaagaaaauauaccucaacgagaaugucaacuccgaggaauuagaagucuuccgcaacgacauuaaaaagaaacuaaacaagauaaacagccucaaauauucguucgagaaaaacaaagccaacuaccagaagauaaacgaaaacaacaucgagaaaguagaaggcaaguccaaacgcaauauaaucuacgacuacuaccgugaguccgccaaaagggaugccuacgucagcaacgucaaagaagcauucgacaagcuguacaaggaggaggacaucgcgaaacucguccucgaaaucgaaaaccugacaaaacuugaaaaauacaaaauccgagaguucuaccacgagauaauuggccgcaaaaacgacaaagaaaacuucgccaaaaucauauacgaagagauccaaaacgugaacaacaugaaggagcuuauagaaaaagugcccgacaugucagagcucaaaaagagccagguuuucuacaaguacuaccuagacaaagaggaacuaaacgacaaaaacaucaaguacgccuuuugccacuucgucgaaaucgaaaugucacaacuccucaaaaacuacguauacgcacgacuaucgaacauuagcaacgacaaaaucaaacgcauuuucgaauaccaaaaccuaaagaaacucaucgagaacaaacuauugaacaaacuagacacauacguccgaaacugcggaaaauacaauuacuacuuacaggacggagaaaucgcaaccucugauuucauagccaggaaccgccagaacgaggcuuuccucaggaacaucaucggggucucuagcguagcauacuucagcuuacgaaacauccuagaaaccgaaaacgaaaacgauauaacugggcgaaugcggggcaaaaccgucaaaaacaacaaaggagaagagaaguacguaagcggagaaguggacaaaaucuacaacgagaauaagaagaacgaagucaaagaaaaucugaaaauguucuacuccuacgacuuuaacauggacaauaagaaugaaaucgaagacuucuucgcgaauauagacgaggccauuagcucaaucagacacggcauaguccacuucaaucucgaacuagaaggaaaagacauauucgccuucaaaaacaucgcccccagcgaaauauccaagaaaauguuccagaacgaaauaaaugagaagaaacugaaacuaaagaucuuccggcaacugaacucagccaacgucuuccgcuaccucgaaaaguacaaaauccuaaacuaccugaagcgaacccgguucgaguucgugaacaagaauauaccauuuguacccagcuucacaaaacuguacucccgcaucgacgaccugaagaacucucugggaaucuacuggaaaaccccaaaaacuaacgacgacaauaagacaaaagagauaaucgacgcacaaaucuaccuacucaaaaacauauacuacggggaguuccuaaacuacuucaugucaaacaacggaaacuucuucgaaauaucaaaggagaucauugaacuuaacaagaacgacaaaagaaaccucaaaacaggauucuacaaacuccagaaauucgaggacauccaagagaaaaucccgaaagaauaccuagcgaacauccagagccuguacaugauaaacgcggggaaucaagacgaagaagaaaaggacaccuacaucgacuucauacagaagauauuccugaagggauucaugacauaccuagcaaacaacggacgacugagccugaucuacauugggagcgacgaagaaaccaacacuucucuagcugagaaaaagcaagaguucgacaaauuccugaagaaauacgagcaaaacaacaauaucaaaauccccuacgaaaucaacgaguuccuucgcgaaauaaaacucgguaacauucuaaaauauacagagaggcucaacauguucuacuuaauccucaaauuacuuaaccacaaagagcuaacaaacuuaaagggcucgcuggaaaaguaccaguccgcgaacaaagaagaggccuucagcgaccagcucgaacucaucaaccucuuaaaccucgacaacaaccggguaaccgaagacuucgagcucgaagccgacgaaaucgggaaauuccuggacuucaaugguaacaaggucaaagacaacaaggagcuuaagaaauucgacaccaacaaaaucuacuuugacggcgagaacauaauuaagcaucgagccuuuuauaacauaaagaaauauggcaugcucaaccuauuggagaaaaucgcggacaaagccggcuauaagauaagcauugaagaacucaagaaguacucuaacaagaaaaacgaaauugagaaaaaccacaagaugcaagaaaaucuccacaggaaauacgcccgcccuaggaaagacgagaaguucaccgacgaggacuacgagagcuacaaacaggccauagaaaacauagaagaauacacccaccuuaaaaacaaaguugaguucaacgaacuaaaccuucuccagggucuacuccugcgaauccuucaccggcuagugggguacaccagcaucugggaaagagaucuacgcuuccggcuaaaaggcgaguuccccgaaaaccaauacaucgaagaaaucuucaacuucgaaaacaagaaaaaugugaaauacaaaggcggccagauaguagaaaaauauaucaaguucuacaaggaauuacaccagaacgacgaagucaaaauaaacaaguacagcuccgccaacauaaagguacuaaagcaagagaaaaaggaccuauacauaaggaacuacaucgcccacuucaacuacauaccacacgccgaaauuucacuucucgagguauuggaaaaccuucggaaacuacugucuuacgacagaaaauuaaagaacgcuguaaugaaauccgucguagacauucuaaaagaauacggcuucgucgccacauucaagauaggggccgacaagaagaucggcauucaaacccuagagucagaaaagaucguccaccuuaaaaaccucaaaaagaaaaagcuaaugaccgaccgaaacagugaggaacucugcaagcucgucaaaaucauguucgaguacaaaauggaagaaaagaaauccgaaaacuga

SEQ ID NO: 11610 - RNA, 3480 nt, Artificial Sequence
  Cas13a variant__Leptotrichia buccalis__WP_015770004.1__Cas13a(N314A)
augaaagucaccaaaguuggcggaaucucccacaagaaauacaccuccgaaggacgauugguaaaaucagagagcgaagaaaacaggaccgacgagagacuguccgcccuccugaacaugcgauuggacauguauaucaaaaaucccagcucuacagaaacaaaagaaaaucagaaacgaaucggcaagcucaaaaaguucuucagcaacaaaaugguuuaccucaaagacaauacccuaagucugaagaacggaaagaaagaaaacaucgacagggaauacucagaaacggauaucuuagagucagacguccgagacaagaaaaacuucgccguacucaagaaaauauaccuaaaugagaacgucaacagcgaagaauuggagguguuccggaacgacaucaaaaagaagcucaacaagauaaacagccucaaguacucauucgagaaaaacaaagcuaacuaccagaaaauaaacgagaacaacaucgaaaagguagaagggaaaucaaaacgcaacauaauauacgacuacuaccgcgaauccgccaaaagagaugcguaugucuccaacgucaaggaagcguucgacaagcuauacaaagaggaggacauagccaaacugguccuagagauugagaacuuaaccaaauuagaaaaauacaaaauccgggaguucuaccacgaaaucaucgggcggaaaaacgacaaggaaaacuucgcaaagaucaucuacgaggaaauacaaaaugucaacaacaugaaggaacuaauagaaaaggucccggacaugucggaacucaagaaaagccaaguauucuacaaauacuacuuagacaaagaggagcucaacgacaaaaacauaaaguacgccuucugccauuucguagaaauugaaaugucacaacugcuuaagaacuauguguacaagcgccucucugcaauaaguaacgacaaaaucaaacggauauucgaauaccaaaaccucaagaagcuaauagagaauaaacuacucaacaagcucgacaccuacguacgcaacugcggcaaguacaacuacuaucuccaagacggcgaaaucgccacaagcgacuucaucgcuaggaaccgccaaaacgaagccuuccuucggaacauuaucgguguaagcucaguagcauauuucuccuuacgaaacauacuagaaaccgaaaaugagaacgacauuacaggccgcaugcgaggcaaaaccgucaaaaacaacaagggugaagagaaguacgucucaggcgaaguggacaagauauacaacgaaaacaaaaagaacgaaguuaaagagaaccucaagauguucuauagcuaugacuucaacauggacaauaaaaacgagaucgaggacuuuuucgcaaacauagaugaggcgaucagcuccauccgccacggcaucguccacuucaaccuagaacucgaggguaaagacaucuucgcuuucaaaaacauagccccuuccgagaucucaaagaaaauguuccagaaugaaauaaacgaaaagaaacucaagcucaaaauauuuaggcaguugaacagugcgaauguuuuucgcuaccuugagaaguacaaaauccucaacuauuuaaagcgcacgcgauucgaguucguuaacaaaaacauacccuucgugcccuccuucacaaagcuauacucucgaauagacgaccugaaaaacucguuaggaaucuauuggaagacccccaagacaaaugaugacaacaagacaaaggagaucaucgacgcacaaaucuaccugcucaagaacauauacuacggcgaguuucucaauuacuucaugucaaacaacggcaacuucuucgagauauccaaggagaucaucgagcuaaacaaaaacgacaaacgcaauuugaagacaggauucuacaagcuacagaaauucgaggacauccaagagaaaauaccaaaagaauaccuggcgaacauacagucccucuacaugaucaacgcgggaaaccaagacgaagaagaaaaagacaccuacaucgacuuuauccagaaaauauuccuuaaaggcuucaugaccuaccucgcgaacaacgggcgccuaagccuaaucuauaucggcucagacgaagaaaccaauacaagccuagccgaaaagaagcaggaguucgacaaauuccugaaaaaguaugaacaaaacaauaacauaaagauccccuacgagaucaacgaguuccuacgugaaaucaaacucggaaacauccuaaaguacacggaacgacugaacauguuuuaucucauacucaagcuccuuaaccacaaagaacucaccaaccuaaaagggucccucgaaaaguaccaguccgccaacaaagaagaagcguucucggaccaacuugaacuaauaaaccuacugaaccucgauaacaauagagucacagaagacuucgaacucgaggcugacgaaaucggaaaguuccuagacuucaacggaaacaaagucaaagacaacaaagaacucaagaaauucgauacgaauaagauuuacuucgauggcgaaaacauaauaaagcacagagcauucuacaacauaaagaaauacggaaugcuaaaccugcuggaaaagaucgcagacaaagccggcuacaaaauauccaucgaggagcucaagaaguacuccaacaaaaagaacgaaaucgaaaagaaccacaaaaugcaagaaaaccuacaccgcaaguacgcccgcccccggaaagacgaaaaauuuaccgacgaggacuaugagucauacaaacaagccauagaaaacauagaagaauacacgcaccuuaagaacaaagucgaguucaacgagcucaaccuucuccaggggcuccuacuccgcauucuccacagacucguaggguacacauccauuugggaacgcgaccuacgauuccgccugaagggcgaguuccccgaaaaccaauauauagaagaaaucuucaauuucgaaaacaaaaagaacgucaaauacaagggcggccagaucguagaaaaauacaucaaauucuauaaagaacuccaccagaaugacgaagucaagaucaauaaauacagcucggccaacauaaaagugcuuaaacaggagaagaaagaccuguacauccggaacuacaucgcccauuuuaauuacauaccccacgcugaaauaucacuccuugagguccuugaaaaccuaagaaaacugcucucauacgacagaaaacucaagaacgcuguaaugaaaagcgucguggacauacucaaggaguacggauucgucgccaccuucaagauuggcgcagacaagaaaauaggaauacagacgcucgaaucagagaaaaucguacaccucaaaaaccugaaaaagaagaaauugaugaccgaccgaaacagcgaggaacuaugcaagcuaguuaaaaucauguucgaguacaaaauggaggagaagaaauccgaaaacuag

SEQ ID NO: 11611 - RNA, 3480 nt, Artificial Sequence
  Cas13a variant__Leptotrichia buccalis__WP_015770004.1__Cas13a(R1072A)
augaaagucaccaaaguaggaggcauuucccacaagaaauacaccagcgaaggacgccuaguuaaaagcgaaagugaagaaaacaggaccgacgaacgccuaucagcccuacugaacaugcgccucgacauguauaucaaaaacccaucaucaacagaaacgaaagaaaaccagaaaaggauagggaaacugaagaaauucuucuccaacaaaaugguauaccucaaagacaacacgcuaucccucaaaaacggcaagaaagaaaacauagacagagaauacagcgaaacugacauccucgaaagugacguccgcgacaagaaaaacuuugccguccuaaagaaaauuuaccuaaacgaaaacgucaauuccgaagaacuggaggucuucagaaaugacaucaaaaagaaacucaauaaaaucaacagccucaaauacagcuucgagaaaaacaaagccaacuaccagaaaaucaacgaaaauaacaucgaaaaagucgaagguaaaagcaaaagaaauauaaucuacgacuacuaccgcgaaagcgcgaaacgugacgccuaugucuccaacgucaaagaggcauucgacaaacucuacaaagaagaggacaucgccaaacuggugcuagaaaucgagaaccugacaaagcuagaaaaauacaaaauccgcgaauuuuaccacgaaaucaucggcaggaaaaacgacaaagagaauuucgcaaaaaucauauacgaggaaauccaaaacguuaacaacaugaaagaauugaucgaaaaagugccggacaugucugagcucaagaaaucacaggucuucuauaaauacuaccucgacaaagaagaacucaacgacaaaaauauaaaguaugcauucugucacuucguggaaauagaaaugucccagcuacucaaaaauuacguguacaaacguuugaguaacauauccaaugauaaaauaaagcggaucuucgaauaccagaacuuaaagaaacuuaucgagaauaaacuccuuaacaaacuagacacauacguacgaaacugcggcaaauacaacuacuaccuccaagacggggaaaucgccaccuccgauuucauagcacgcaacaggcaaaacgaggcguucuugcgcaacauaaucgggguaagcagcgucgcuuacuucucccugagaaacauccuagagacagaaaacgaaaacgacaucacaggccgaaugcgcggcaaaaccgucaaaaacaacaaaggcgaggaaaaauacgucuccggcgaggucgacaaaauauacaaugagaacaaaaagaacgaggucaaagagaaccugaagauguucuauagcuacgacuucaacauggacaacaagaaugaaaucgaggauuucuucgccaacaucgacgaagccauauccagcauacgccacgguaucguucacuucaaccuagaacucgagggaaaagacaucuucgccuucaagaauaucgccccuucagaaauaucgaagaaaauguuccagaacgaaauaaacgagaaaaagcuaaagcugaaaaucuucagacagcugaacagcgccaacgucuuccgauaccucgaaaaauauaagauucuaaacuaccuaaagcggacacgauucgaguucgugaacaagaacaucccguuuguaccauccuuuacaaagcuguacuccagaaucgacgaucuuaagaacagccucggcaucuacuggaaaaccccuaaaacuaacgacgacaacaaaacaaaagaaaucauagacgcccagauauaccuacucaagaacaucuacuacggagaguuccucaacuacuucauguccaacaacgggaacuucuucgaaauaagcaaggagaucauagaauuaaacaaaaacgacaagcgaaaccuuaagacaggguucuacaaacugcaaaaguucgaagacauacaagagaaaaucccuaaagaguaccuggccaacauccaaucccuguacaugaucaacgcagggaaccaagacgaagaagaaaaagacaccuacaucgauuucauccagaaaauauuccuaaagggcuucaugacguaccuugcaaacaacggccgacucagccugaucuacaucggcuccgaugaggagacaaacaccagccuggccgagaagaaacaagaguucgauaaauuucucaagaaauaugaacagaacaacaauaucaaaauaccuuacgagauaaacgaauuucugcgugaaaucaagcuggggaacauccuuaaguacacggaacgccucaacauguucuaccucauccuaaaacuucuaaaccacaaggagcugacgaaccuaaagggaucacuggagaaauaucaaucugccaacaaagaagaagcauucucggaccaacucgagcucaucaaccuacugaaccuugacaacaaccgagucaccgaagacuucgaacucgaagcugacgaaauaggaaaauuucuagacuuuaacgggaacaaagucaaagacaacaaagagcugaagaaauucgacacaaauaagauauacuucgacggagaaaauauuaucaaacaccgggcguucuacaauaucaagaaauacggaaugcucaaccuccucgaaaagaucgcagacaaagccggguacaagaucaguauagaagaacuaaagaaguauagcaacaagaaaaacgaaauagagaaaaaucacaagaugcaagaaaaccuucaccgcaaauacgcacgcccacggaaggacgaaaaauucaccgacgaagacuacgaaagcuacaaacaagcgaucgaaaacaucgaagaauacacacaccucaaaaacaaaguggaguucaaugagcugaacuuacuccagggucuccuccucagaauacuccaccggcuuguaggauacacgagcauaugggagcgugaccuccgauuccgcuuaaagggagaguucccagagaaccaauacauagaggaaaucuucaacuucgagaauaaaaagaacgucaaguacaagggcgggcagaucgucgaaaaguacaucaaauucuacaaagagcuccaucaaaacgacgaaguaaaaaucaacaaguacaguagcgcuaacaucaaaguccuaaagcaagagaagaaagaccuauacauaaggaacuacauagcacacuucaacuacauaccccaugccgagaucucccugcuagagguacucgaaaaccuggcgaaacuacugagcuacgaccgcaaacugaaaaacgcugugaugaaauccguaguugacauacucaaagaguacggcuucgucgcaacauucaagauaggcgcagacaagaaaaucggcauccaaacucucgaauccgaaaagaucguacaccucaagaaccucaagaagaagaaacucaugacggaccgaaacagcgaggagcucugcaagcuagugaaaauuauguucgaauacaagauggaagagaagaaaagcgagaacuag

SEQ ID NO: 11612 - RNA, 3480 nt, Artificial Sequence
  Cas13a variant__Leptotrichia buccalis__WP_015770004.1__Cas13a(D1078A)
augaaagucacaaaaguaggaggaauaucucacaagaaauacacauccgaaggccgcuuggugaaaagcgaaagcgaagaaaaccgcaccgacgaacgacuaagcgccuuauugaacaugcgacuggacauguacauuaaaaaccccuccucaaccgaaaccaaagaaaaccaaaaacgcauaggaaaacugaagaaauucuucucaaauaaaauggucuaccuaaaagacaacacccugagccuaaagaacggcaagaaagaaaacauagaccgcgaauacagugaaacggacauacuagaaagugauguccgagacaagaaaaacuucgccgugcuaaagaaaaucuaccuaaacgaaaacgucaacucagaggaacuagaaguuuuccggaacgacaucaaaaagaaacucaauaaaaucaauagccuaaaauauagcuuugaaaagaacaaagccaacuaccagaaaauaaacgaaaacaacauagagaaagucgaggggaaaagcaagagaaacauaaucuaugauuauuaccgcgaaucggccaaacgcgacgccuaugucuccaacguaaaggaggccuucgacaaacuauacaaagaagaagacaucgcaaaacucguacuagaaaucgaaaacuugacgaaacucgaaaaguacaaaauaagagaguucuaccaugagauaauugggcggaaaaacgacaaggaaaacuuugccaaaauaaucuacgaagaaauccagaacguuaacaacaugaaagaacuaauugaaaaggucccggacaugucagagcucaagaaaagccaagucuuuuauaaauauuaccucgacaaggaagaacucaacgacaaaaacaucaaguacgcguucugccacuucgucgagaucgagaugagccaacuacugaaaaacuacguguacaaaagacucucgaacauuuccaacgacaagauuaaacgaauauucgaauaccagaaccucaagaagcucauagagaacaaacuacucaacaaacucgacaccuauguccgaaacugcggcaaauacaacuacuaccugcaggacggggaaaucgccaccagcgacuucaucgcacgaaaccgccaaaacgaggcauuccuccgcaacaucaucggagucuccucaguagcauauuucagccuccgcaacauacucgaaacggagaacgaaaacgacaucaccgggcgaaugagaggcaaaaccgugaaaaacaauaaaggcgaggagaaauacgucagcggcgaaguugacaaaaucuacaacgagaauaagaaaaacgaagugaaggaaaaccuaaaaauguucuacuccuacgacuucaauauggacaacaagaacgagauagaagacuucuuugcgaacaucgacgaagcuauaucaagcauacgacacggcauaguccacuucaaccucgaacuugaagggaaagacauauucgcuuucaaaaacaucgcgcccucagaaaucagcaagaaaauguuccagaacgaaauaaacgaaaagaaacucaaacuuaaaauauucagacagcucaacagcgccaacguguuccgauaccuggagaaauauaaaauucucaacuaccucaaacgaacccgguucgaguucgucaacaaaaacauccccuucguccccuccuucacaaagcucuacagccgcaucgaugaucugaagaacucgcuaggaaucuacuggaaaaccccuaaaaccaaugacgacaacaaaacuaaagagauaaucgacgcccaaaucuaccuacucaaaaacaucuacuacggagaguuccucaacuacuucaugaguaacaauggcaacuucuucgagaucucaaaagagaucauagagcuaaacaagaacgacaaacgcaaccugaagacaggcuucuacaagcuacaaaaguucgaagacauucaggagaaaauacccaaggaauaucuagccaacauccaaagccuguacaugauaaacgccgggaaccaagacgaagaagaaaaagacacauacaucgacuucauccagaagaucuuccugaagggauucaugaccuaucuagcaaacaacggccgacugagccuaauuuacauuggcuccgaugaagaaacaaacaccucgcucgcagagaagaaacaagaguucgacaaauuccucaagaaauacgaacaaaacaacaacaucaaaauacccuacgaaaucaacgaguuccuccgcgaaauaaaauuaggcaacauccucaaauacacggaacgacucaacauguucuaccuaauacucaagcugcucaaucacaaagaguuaacgaaccuaaaaggaucguuagagaaguaccagagcgcaaacaaagaagaggccuucagcgaccaacuggaacuuaucaaucuccugaaucuggacaauaacagaguaaccgaagacuuugaacucgaagccgacgagaucggcaaauuucucgacuuuaacggcaacaaggucaaggacaacaaagaacucaagaaauuugacacgaauaagaucuacuucgacggcgagaacaucauaaagcaccgcgccuucuacaacaucaaaaaguacggaaugcucaaccuacucgaaaagaucgccgacaaagcaggguacaagauauccaucgaagaacugaagaaauacucaaacaagaagaacgaaaucgagaaaaaccacaaaaugcaagagaaccuccaccgaaaauacgcucgcccaaggaaagaugaaaaguuuacggacgaagacuacgaaagcuacaaacaagcgaucgagaacauagaggaauauacacaccugaaaaauaaagucgaguucaacgagcuaaaccuccuccagggacuauugcuucgcauccuacaucgacuggucggguacaccuccaucugggaaagagaccuacgauuccgccugaaaggcgaauuuccggaaaaucaguacauugaagagauauucaacuucgagaauaagaaaaacgucaaguacaaagggggucaaauaguugaaaaguacauaaaguucuacaaagaacuacaccagaacgacgaaguaaaaauaaacaaguacuccucagcuaacaucaagguacucaaacaggagaagaaagaccuauacauacggaacuacaucgcgcauuucaacuacaucccgcacgcggaaaucagccucuuagaaguccuagagaaucuacgaaaacugcucaguuacgcccgaaaacuaaagaacgccgucaugaaaagcgucgucgauauccuaaaagaguacggauuuguagcaaccuucaaaauaggggccgacaaaaagauuggcauacagacccuugaauccgagaaaaucguacaccucaagaaccucaagaagaagaaacuuaugacagaccggaacagcgaagaacucuguaaacuugucaaaaucauguuugaauacaaaauggaggagaagaaaagcgaaaacuag

SEQ ID NO: 11613 - RNA, 3480 nt, Artificial Sequence
  Cas13a variant__Leptotrichia buccalis__WP_015770004.1__Cas13a(R1079A,K1080A)
augaaagucacgaaagugggcgggaucucccacaagaaauacaccuccgaaggacguuuggucaagucggaguccgaggaaaacaggacggacgaacgacuauccgcauuacugaacaugcggcucgacauguacaucaaaaacccauccuccacggaaacgaaagagaaccagaaaagaauuggcaaacucaaaaaguuuuucucaaacaaaauggucuaccucaaagacaacacccucagucucaagaacgggaagaaagaaaacauagaccgagaguacagcgaaacagacauucuugaauccgacguccgcgacaagaaaaacuucgcuguacugaagaagauauaccucaacgaaaacgucaauuccgaagaacucgaggucuucagaaacgauauaaagaagaaacuaaacaaaauaaacucccugaaauauaguuucgagaaaaacaaagccaacuaccagaaaaucaaugaaaacaacauagaaaaaguagaaggcaaaagcaaaaggaacauuauauaugacuacuaccgcgaaagugccaagcgugacgccuacguaucaaaugucaaagaggcauucgacaagcuauacaaagaagaagacaucgccaagcucguacuggaaaucgaaaaccuaaccaagcuggagaaauauaaaauccgagaguucuaccacgaaauaaucggccgaaagaacgacaaggaaaacuucgcaaagauaauauacgaagaaauacagaacguaaacaacaugaaggagcuaaucgagaaagucccggacaugagcgaacucaagaaaucccaaguauucuacaaauacuaccuagacaaagaggaacuaaacgacaaaaacauaaaguacgcguucugccacuucgucgagauagaaaugagccaacuccugaaaaauuacguauacaaacgacuaaguaacauuagcaacgacaagauaaagagaaucuucgaauaccaaaaucuuaagaaguuaauagagaacaagcuauugaacaaacuagacacguacguccgaaacugcggcaaguacaacuacuaccuucaagauggcgagaucgccaccucggacuucauagccaggaaucgccagaacgaggcguuccucagaaacaucauuggcgucuccuccguagccuacuucagucuacgcaacauccucgaaacggaaaacgaaaacgauaucacaggccgcaugagaggcaaaacaguaaagaacaacaagggggaagaaaaauacguaagcggcgaaguagacaaaauauacaacgaaaacaagaagaacgaggugaaagagaaccuuaaaauguucuacucauacgacuucaacauggacaacaagaacgaaaucgaggacuucuucgccaacauagaugaagccauauccaguauccgccacgggauaguacacuucaaccucgaacuagaaggaaaagacauauucgccuucaaaaacauagccccaagcgaaauaaguaagaaaauguuccaaaacgaaaucaacgaaaagaaacuuaaacugaaaaucuuucgacaacucaacagcgccaaugucuuccgguaccuagaaaaauacaaaauccucaacuaccucaagcgaacccgauucgaguucgucaacaaaaacauccccuucgugccaucauucaccaaacuuuacagccgcaucgacgaccugaagaacuccuuaggaauauacuggaaaacacccaagacuaacgacgacaacaaaacaaaagaaauaauagacgcccagaucuaucugcugaagaacauauacuacggagaauuucucaacuacuucaugagcaacaauggaaauuucuuugaaaucuccaaagaaauaaucgaguuaaacaaaaacgauaagcgcaaccugaaaacaggguucuacaaacuccaaaaauucgaagacauccaggagaaaaucccaaaagaauaccuggcgaacauacagucccucuacaugaucaacgcgggaaaccaagacgaggaagaaaaagacaccuacaucgauuucauccagaaaaucuuccucaaaggauucaugaccuacuuagcgaauaacggucgacucagccuaaucuacaucgguagcgacgaagaaacaaacacaucccuagccgagaagaagcaagaguucgacaaguuucucaagaaauacgaacagaacaacaacaucaaaauaccguacgagauaaacgaguuccuuagagaaauaaagcucggcaacauccucaaauacaccgagcgacuaaacauguuuuaccuaauccucaagcuacucaaccacaaagaauugaccaaucugaaaggcucacuugagaaauaucaguccgcaaacaaggaagaggcuuucagcgaccaacuugagcucaucaaucuacugaaccuagacaacaaucgcguaacggaagacuucgaacuggaagccgacgaaaucggcaaguuccuggacuucaacggcaacaagguaaaggacaauaaagagcugaagaaauucgacacaaacaaaaucuacuucgacggcgaaaacauaauaaaacaccgcgcauucuacaacauuaagaaauacgggaugcucaaccuccucgagaaaauagcagacaaagccggcuacaaaauauccauagaggaacucaagaaguacuccaacaaaaagaacgaaaucgagaaaaaccacaaaaugcaagagaaccuccaccggaaauaugcacgaccgaggaaagaugaaaaguucacagacgaggacuacgagucauacaagcaagccauagagaacaucgaagaguacacccaccugaagaacaaaguagaguucaacgaacucaaccuccugcagggccugcuacugcggauucuacaccgccuaguaggguacacgaguaucugggagcgcgaccuacgcuuccgacugaaaggagaguucccggaaaaccaauacauagaggaaauauucaacuucgaaaacaaaaagaacguaaaauacaagggugggcagauaguggagaaauacaucaaauucuacaaagagcugcaccaaaacgacgaggucaaaauaaacaaauacagcuccgcaaacauaaaggugcuaaaacaagagaagaaagaucuauacaucagaaacuacauagcacacuucaacuacaucccccacgcagaaaucucacuacuugagguccuggagaaccuccgaaaacuguuaucuuacgacgcagcccucaaaaacgccgugaugaaauccgucgucgacauacuaaaagaauacggguucgucgcaacauucaagauaggcgcugacaagaaaauagggauccaaacccuagaauccgagaaaaucguucaccucaaaaaccucaagaaaaagaaacucaugacugaccgcaacucugaggaacucugcaaacuggucaaaaucauguucgaauacaaaauggaggagaagaaauccgaaaacuaa

SEQ ID NO: 11614 - RNA, 3480 nt, Artificial Sequence
  Cas13a variant__Leptotrichia buccalis__WP_015770004.1__Cas13a(K1080A)
augaaagucacgaaagucgggggcauuagccacaagaaauauaccagcgaaggacgacucgugaaaagugaauccgaagagaaccgcaccgaugaacgccucucggcccuacuuaacaugcgacucgacauguacaucaaaaacccgagcucuaccgaaacgaaagaaaaucaaaaacgcauagggaaacucaagaaauucuuuuccaacaaaauggucuaccugaaagauaacacacucucccuuaaaaacggcaagaaagagaacaucgaucgcgaauacuccgagacagacauccucgaauccgacguccgcgauaagaaaaauuucgcggugcucaagaaaaucuaccuaaacgagaacgucaacagcgaggaacucgagguguuuaggaacgacauuaaaaagaaacuaaacaaaaucaacucacuuaaauacuccuucgaaaagaacaaagcaaacuaccagaaaauaaacgagaacaacaucgagaaggucgaaggaaaauccaaacgaaacaucauauacgacuacuaccgugaguccgcgaaacgcgacgccuacgucucaaacguaaaagaagcauucgacaaacucuacaaggaagaggacaucgcaaaacucguacucgaaaucgagaaccugaccaagcucgaaaaguauaaaauucgggaguucuaucaugaaauuaucggccguaaaaaugauaaggaaaacuucgcaaagauuauauacgaagaaauccaaaacgugaacaacaugaaggaacucaucgaaaaggugccagauaugagcgagcuaaagaaaagccaagucuucuauaaauacuaccucgacaaagaggaacuuaacgacaaaaacaucaaauacgccuucugucacuucguagaaaucgaaaugagccaacuccuuaaaaacuacguuuacaagagacuaucgaauauuagcaacgacaaaauaaagaggauauucgaguaccaaaaccuaaagaagcucauagaaaacaaguuacucaacaaacuagauacguaugucaggaauugcggcaaauacaauuacuaccuccaagacggggaaaucgcgacaagcgacuucaucgcccgcaaucgacaaaacgaggcauucuuaaggaacaucauaggcguaucguccguggcauacuucucccugcgcaacauccuggaaacagaaaacgaaaacgacauaacgggccgcaugcgcggaaaaacggucaaaaacaacaaaggcgaagaaaaguacguaagcggagaggucgacaaaauauacaacgaaaacaagaaaaacgaagucaaagagaaccuuaaaauguucuauucguacgacuucaacauggacaacaaaaaugaaauagaagacuucuucgccaacaucgacgaggcuaucagcuccauacgacaugggauaguacacuucaaccucgaacuagaggggaaagacaucuucgccuuuaagaacauugccccuuccgaaauauccaaaaagauguuccaaaacgaaaucaacgagaaaaagcucaagcugaaaauauuccgccaguuaaacucugcgaauguauuccguuaccucgaaaaguacaagauccucaacuaucucaaacgcacucgcuuugaauuugucaacaagaacauccccuucgugccauccuucaccaaacucuacucgcgaauagacgaucucaagaacucacucgggaucuacuggaaaacacccaagacaaacgaugacaacaaaaccaaggaaauuauagacgcccagauauacuuacucaaaaacaucuacuacggcgaguuccucaacuacuucaugagcaauaacggaaacuucuucgaaauaucgaaggaaaucauagaacucaacaagaacgacaagcguaacuugaagaccggcuuuuacaaacuacagaaguucgaggacauacaggagaaaauccccaaagaauaucucgccaacauacagagccucuacaugauuaacgccggcaaccaagaugaggaagagaaagacaccuacaucgacuucauccagaaaauuuuccucaaaggcuucaugaccuacuuggcaaacaacggccgacucucacucauauauauaggauccgacgaagaaacaaacacgucccuagcagagaagaagcaagaguucgacaaauuucugaaaaaguacgaacaaaauaacaacauaaaaauaccguacgaaaucaacgaguuccugcgggaaauaaagcugggcaacauccugaaguacaccgagcgacuuaacauguucuaccugauucucaaacuacugaaccacaaagaacuaaccaaccugaaggguagccucgaaaaauaccagucugcaaacaaggaagaggccuuuucagaccaacuugaacucauuaaccugcucaaucuugacaacaaccgaguuacagaagauuuugagcucgaggccgacgaaauaggaaaauuucuagacuucaacggaaacaaagucaaagacaacaaagagcuaaagaaauucgacaccaacaagaucuacuucgacggagaaaacaucauaaagcaccgcgcauucuauaacaucaagaaguacggaaugcuaaaccuacuagaaaagauugcggacaaagcaggcuacaagaucucgauagaggagcugaagaaauacuccaacaagaaaaacgaaauugagaaaaaccacaagaugcaagaaaaccuccaccgaaaguacgcccgcccaagaaaagacgaaaaguucacagacgaagacuacgaauccuacaagcaggccauagagaacaucgaagaguacacccaccucaagaacaaaguugaguucaacgaacuaaaccuccugcaaggccuacuacuccgcauccuucaucgacucgucggauacacuucaauuugggaacgagaccuaagauuccgccuaaaaggugaguuccccgaaaaccaguacauagaagaaaucuucaacuucgaaaacaaaaagaacgucaaguacaaagggggacagaucguagaaaaguacauaaaauucuacaaagaacugcaccaaaacgacgaaguaaaaauaaacaaguacucaagcgccaacaucaaggugcucaaacaagagaagaaagaccucuacauaagaaacuacauugcacauuucaacuacaucccccaugccgagauaucacuccuagaaguacuagaaaaccugcgcaaacugcucagcuacgaccgggcacucaaaaaugcugucaugaaguccguggucgacauccuaaaagaguacggcuuugucgccacguucaaaaucggagccgacaagaaaauaggaauccaaacccucgaauccgagaagaucguccaccuuaaaaaucugaaaaagaagaaacuaaugaccgaccgcaacucggaagaguuaugcaaacucguaaaaauaauguucgaauacaaaauggaagagaagaaaucagagaacuga

SEQ ID NO: 11615 - RNA, 3480 nt, Artificial Sequence
  Cas13a variant__Leptotrichia buccalis__WP_015770004.1__Cas13a(K1082A)
augaaagucacgaaagugggcggaaucucgcacaagaaauauacuuccgagggccgccucgugaaaagugagagcgaagaaaaccgaacagacgaacggcucucagcgcuauuaaacaugcggcucgacauguacaucaagaacccaagcagcaccgaaacaaaggagaaccaaaaacgcaucgggaaacugaaaaaguucuuuucgaacaagaugguguaccuaaaagauaacacccuaagucucaaaaacgggaagaaagagaacaucgaccgggaguacagcgaaacggacauucuagagagcgacguacgcgacaagaagaacuucgcaguucuuaagaaaaucuaccuaaacgaaaacguaaacagcgaggaacuggaaguauuccgcaacgacaucaaaaagaaacuuaauaaaauaaacaguuugaaguacucguucgaaaagaacaaggccaacuaccagaaaaucaacgaaaacaacauagagaaaguugaaggcaagagcaaaagaaacaucauauacgacuacuaucgagaaagugccaaacgcgacgccuauguguccaacgucaaggaagcguuugacaagcuauacaaagaggaggacaucgcgaagcuaguccuggaaaucgaaaaucuaacgaagcuagaaaaguauaaaauaagagaguucuaucacgaaauaauagggcggaagaacgacaaagaaaacuucgcgaaaaucaucuacgaggaaauccaaaacgugaacaacaugaaggagcucaucgaaaaagugcccgauaugagcgaauugaaaaagagccaaguguucuacaaauacuaccucgacaaagaggaacuuaacgacaaaaacauuaaauacgccuuuugccacuucguagaaaucgaaaugucacaacuacucaaaaacuacgucuauaagcgacucagcaacauaagcaacgacaagauaaaacgaauauucgaauaucagaaccuuaagaaacugauagagaacaagcuccugaacaaacucgacacauaugucagaaacugcgggaaauacaacuacuaucuucaagacggcgaaaucgcaacgagcgauuucauagcacgcaaucgccagaaugaggccuuccugagaaacaucaucgggguaaguucaguggccuauuucagccuacgcaacauccuagaaaccgaaaacgagaacgacauaaccggacgaaugcgaggcaagacggucaaaaacaacaaaggagaagaaaaauacguaagcggggagguagacaagaucuacaacgaaaacaagaaaaacgaagucaaagaaaaccuaaagauguucuacuccuacgacuucaauauggacaacaagaaugaaauagaagacuucuucgcgaauauagacgaagccaucagcagcaucagacacggcaucguccacuucaaccuggaacucgagggcaaagacauuuuugcguuuaagaacauagcccccuccgaaaucuccaagaaaauguuccagaacgagaucaacgagaagaaacugaaacugaagauauuucggcaacuaaacuccgcgaacguauuccgauaucucgaaaaauacaagauccuaaacuaucuuaagcggacacgcuucgaguucgucaacaagaacaucccuuucguacccuccuucacaaaacuauacucccggauugacgaccucaaaaacagccuaggaauauacuggaagaccccaaaaacaaacgacgauaacaaaacuaaagaaaucauagacgcgcagaucuaccuccuuaaaaacauuuacuacggcgaguuccugaacuacuucauguccaacaacggcaacuucuucgagaucucaaaagagaucauagaacucaacaagaaugacaagcgcaaccugaaaaccggguucuacaaacuacagaaauucgaggacauccaggagaaaauccccaaagaauauuuagcaaacauccaaucacucuacaugaucaacgcaggaaaccaagacgaagaggagaaagacaccuacauagacuucauccagaaaaucuuccugaagggguucaugacguaccucgcaaacaacggcaggcuaagccucaucuauauaggaagcgacgaagaaacaaacacaagucuagccgaaaagaaacaagaguucgacaaauuccucaagaaauacgagcaaaacaauaacaucaaaauuccauacgagaucaacgaguuccucagggaaaucaaauuaggcaauauacucaaguacacggagcggcucaacauguucuaccugauccugaaacuuuuaaaccacaaagagcucaccaaccucaagggaagucucgagaaauaucaauccgcaaacaaagaagaggcguucucggaccaacucgagcuaaucaaucuccuaaaccucgacaacaaccgagucacagaagacuucgaacucgaagcagacgaaauaggaaaguuccuagauuuuaauggaaacaaagugaaagacaacaaagagcucaagaaauucgacaccaacaaaauauacuucgauggagagaacauaaucaaacaccgcgccuuuuauaauaucaagaaauacggcaugcuaaaucuacuagagaaaauugcagacaaggcaggcuacaagauaucgaucgaagaacugaagaaauacaguaacaaaaagaaugaaauugaaaagaaccacaaaaugcaggaaaaccuccaccggaaauacgcccggccccggaaagacgagaaguucacagacgaggacuacgagucguacaaacaagcaaucgagaacaucgaagaauacacacaccugaaaaacaaaguagaguucaacgaacuaaaccuccuccaaggccuccuacuccgcauccuacaccgccucgugggcuacacaucaauaugggaaagggaccuuagauuccggcuaaagggcgaguucccagaaaaccaauacaucgaagaaauauucaacuuugaaaacaagaaaaacgugaaauacaaaggcggccaaaucgucgaaaaguacaucaaauucuacaaagaacuucaccaaaaugacgaagugaaaaucaacaaguacucgucagcgaacaucaagguccuaaaacaggaaaagaaggaccucuacauacgaaacuacaucgcacacuucaacuauaucccgcacgcagagaucucgcugcuggaaguacuggaaaaccugagaaagcuccuaagcuacgaccgcaaacuugccaaugcaguaaugaaaucaguaguagacauacugaaagaauacggcuuuguggcuacuuucaagauaggagcagacaaaaagaucggaauacagacccuagaaagcgagaagauuguacauuuaaagaaucucaagaagaaaaagcugaugaccgaucgaaacuccgaagaacucugcaaacucguaaagaucauguucgaauacaaaauggaggaaaagaaaucggagaacuaa

SEQ ID NO: 11616 - RNA, 3480 nt, Artificial Sequence
  Cas13a variant__Leptotrichia buccalis__WP_015770004.1__Cas13a(K1087A)
augaaggugaccaaggucggaggaaucucacacaagaaauacacuuccgaaggccgccucguuaaaagcgaaucggaggagaaccgcacagacgaaaggcuaagcgcgcuccucaacaugcgccucgacauguacaucaagaacccgucaagcacagaaaccaaagagaaccaaaagcgaaucgguaagcuaaagaaauuuuucagcaacaaaaugguauaccucaaagacaacacacucagccucaaaaauggaaagaaagagaacaucgaccgagaguacuccgagaccgacauccuagaauccgacgugagagacaagaaaaacuucgcaguacucaagaaaauauaccucaacgagaacgugaacagugaagaacuagaaguauucagaaacgacaucaaaaagaaacucaacaaaaucaacucucugaaguacucguucgagaaaaacaaagccaacuaccagaaaaucaacgaaaacaacauagaaaaaguggaaggcaaaagcaagcgaaauaucauauacgacuacuaccgcgaaucagcgaagagggacgccuacguaucgaacguaaaagaagcguucgauaaacuguacaaagaggaagacaucgccaaacuuguucuggaaaucgaaaaccucaccaaacucgaaaaguauaagauacgagaguucuaccacgaaaucaucggucgcaagaacgacaaagaaaacuucgcaaagauaaucuacgaagaaauccaaaacgugaacaacaugaaagaacuaaucgaaaaaguacccgacaugagcgaacuaaagaaaagccaaguauucuacaaauacuaccucgacaaggaagaacuaaacgacaaaaacaucaaauacgcauucugccacuuugucgaaauagaaaugagccaacuucucaagaacuacgucuauaagcggcucagcaacauaagcaacgauaaaaucaaaaggauauucgaauaccaaaaccugaagaaacucauagaaaauaaacuacugaacaagcuggauacauacguacgaaacugcgguaaguacaauuacuaccugcaagacggugaaaucgcaacaucggacuucaucgcgcggaacaggcaaaacgaagcauuccuuagaaacauuaucggaguuaguagcguagcauacuucagucuccgcaacauccuugagaccgagaacgaaaacgacaucacgggccgaaugaggggcaagaccgucaaaaacaacaaaggcgaagaaaaauacgugucuggggagguagacaaaauauauaaugagaacaagaaaaacgaggucaaagagaacuuaaaaauguucuacucauacgacuucaauauggauaacaagaacgaaauagaagacuucuucgccaacaucgacgaagccaucagcuccauccgucacgggauuguacacuucaaccuggaacucgaaggcaaagacauauucgcauucaaaaauauagcgccaucagaaauaucaaagaaaauguuccagaaugaaaucaacgagaagaaacuaaaacucaaaauuuuucggcagcucaauucugcaaacguguuccgguaccucgagaaauauaaaauacugaauuaccugaaacgaacucgcuucgaguucgugaacaagaacaucccauucgugccgucuuucacgaaacuauacagccggauagacgaccucaagaacagccucggaaucuacuggaagacacccaagacgaacgacgacaacaagaccaaggaaauaaucgaugcgcaaaucuaccugcucaaaaacauauacuacggcgaguuccucaacuauuucauguccaauaacggaaacuucuucgaaauaucaaaagagauaaucgaacuaaacaaaaacgacaaacggaaccucaaaaccgguuucuacaaacuacaaaaauucgaagauauccaagagaaaauuccaaaggaauaccuggccaacauacagagccuguacaugaucaacgcugggaaccaagacgaggaggaaaaagacaccuacaucgacuucauccagaaaauauuccugaaagguuucaugaccuaccuagccaacaauggucggcuaagccuaauauacaucgguucagaugaggaaaccaacacgagccuagcggagaaaaagcaagaguucgacaaauuccucaagaaauaugaacaaaacaacaauauuaaaauccccuacgaaauaaacgaguuccugcgggaaauaaaacucggcaacauucuaaaauacaccgaacgccucaacauguucuaccucauucucaagcuacuaaaccacaaagaacucacaaaucucaagggcagccuggaaaaguaccaauccgcuaacaaagaagaagcauuuucugaccaacucgagcugauaaaccuacucaaccuagacaacaaccgcgucacggaagacuucgaacuggaggcggacgaaaucgggaaguuccucgauuucaacggcaauaaaguaaaggacaacaaagaacucaagaaguucgacacaaauaaaaucuacuucgacggcgagaacaucaucaagcaccgagcguucuacaacauuaagaaauacggcaugcugaaccucuuggagaaaaucgcagacaaggcaggguacaaaauaagcauugaggaacucaaaaaguacagcaacaagaaaaacgaaauagagaaaaaccacaaaaugcaagaaaaccuacaccgcaaauacgcgcgaccaaggaaagacgaaaaauucaccgacgaagauuacgaaucauacaagcaagcaaucgaaaauauagaagaauauacccaccucaagaacaaaguagaauuuaacgaacugaacuugcuccagggccuccuccuucgcauacuccaccgucucguggguuacaccuccaucugggagcgggacuugcguuucaggcuaaaaggcgaguuccccgaaaaccaauacauagaagagaucuucaauuucgagaacaagaagaacguaaaguauaaaggcggucagauagucgagaaauacaucaaguucuacaaagagcuccaccagaacgacgaggugaagauuaacaaauacagcucagcaaacauuaaaguacucaaacaggaaaagaaagaccuguacauccgcaacuacaucgcgcauuucaauuacauaccucacgcggagaucagccuguuggaaguacucgaaaaccuccgaaaacugcuuagcuacgaccgcaaacucaaaaacgccgucauggccucugucguggacauauuaaaagaguauggcuucguagcaaccuucaaaauuggcgcggacaagaagauaggaauccagacgcuggagucagaaaagauaguccaccugaaaaaccugaaaaagaaaaaguuaaugacugaccgcaauagcgaggagcuuugcaaacucguaaagauaauguucgaauacaaaauggaagaaaagaaguccgaaaacuaa

SEQ ID NO: 11617 - RNA, 4170 nt, Artificial Sequence
  Cas13a variant__Leptotrichia shahii__WP_018451595.1__Cas13a
auggggaaccucuucggccacaaacguugguacgagguccgugacaagaaagacuuuaaaauaaagcgcaaaguaaaaguuaaacgaaauuacgauggaaacaaguacauucucaacauaaaugagaacaacaacaaagagaagaucgacaacaacaaauucauccgcaaguauauaaacuauaagaaaaacgacaauauacuaaaagaguucaccagaaaguuccacgcaggaaacauacucuuuaagcucaaagguaaagaaggcaucauacggauugaaaacaacgacgacuuccuggaaaccgaagagguggugcuguacauagaggcuuauggcaagucggagaagcucaaggcgcucggcauaacgaagaagaagaucaucgacgaagccauccgacaaggaauuaccaaggaugacaagaagauagagaucaaacgacaagaaaaugaagaagaaaucgaaaucgacauacgggaugaguacaccaauaaaacacucaacgacugcagcauuauacuacgaauaauagagaacgaugagcucgagaccaagaaauccaucuacgagaucuucaaaaacauaaacaugagccuguacaagauaaucgaaaagaucauagaaaacgaaacagaaaaagucuucgaaaaccgauacuacgaagaacaccuccgcgaaaaacuccuaaaagacgauaagauagaugucauccuaaccaacuuuauggaaauccgggaaaagauaaaaucgaaccuggaaauccuaggauucgucaaauuuuaucuaaacguaggcggcgauaaaaagaaaucgaaaaacaaaaagaugcuaguugagaaaauacuuaauaucaacgucgaccugaccguagaggacaucgcggacuuugucauuaaggaacuagaguucuggaacauaacuaaacgaaucgaaaaaguuaagaagguaaauaacgaguuccuagaaaaacgacgaaacagaacuuacaucaaauccuacguccuacuagauaaacacgaaaaauucaagaucgagagagagaacaagaaagauaaaauaguaaaauucuuuguggagaauaucaagaacaacucuauaaaagagaaaauagagaaaauacuagcagaguucaaaauagacgaacucaucaaaaagcuggaaaaggagcuuaaaaagggaaacugugacacagagaucuuuggaauauucaagaaacacuacaaagucaacuucgacuccaagaaauucaguaagaaaagcgaugaggaaaaagaauuauacaaaauaaucuaccgcuaccucaaagggcgaauagagaaaaucuuagucaacgagcaaaaggucaggcuaaagaaaauggagaaaaucgaaaucgagaaaauccucaacgaauccaucuuauccgagaaaauucucaaacgcgugaaacaguauacacucgaacacaucauguaccucggcaaauuacgccacaacgacaucgacaugacgacagucaacaccgaugacuucucccgccuccacgccaaagaggaacuggaccuagaacucaucacuuucuucgcaagcaccaauauggaacuaaacaagaucuucucccgcgaaaacaucaacaaugacgaaaacauagacuuuuucggcggggacagagagaagaauuacgugcuggacaaaaagauacucaauuccaaaaucaagaucauccgcgacuuagacuucauugacaacaaaaacaacaucacgaacaacuucauucggaaauucacuaagauaggcacgaacgaaaggaacaggauauuacacgcaaucucaaaagagcgcgacuuacaagggacgcaggacgacuacaacaaagucaucaacaucauccaaaacuuaaaaaucuccgacgaggaaguuucgaaagcccugaaccucgacguggucuucaaagauaagaaaaacaucaucacgaaaauaaacgauaucaaaaucagcgaagaaaacaauaacgauauuaaauaccuucccucguuuucaaaggucuugcccgaaauacugaaccuauaccgaaacaaccccaaaaacgaaccauucgauacgauagagaccgagaaaaucguccuaaacgcgcuaauuuacgucaacaaggaacuauacaagaaacucauacuggaagacgaccucgaagaaaacgaaucuaaaaacaucuuccuucaagagcucaaaaagacuuuaggcaacaucgacgagauagacgaaaacaucaucgaaaacuacuacaaaaacgcacagaucucagccagcaaggguaacaacaaggcuauaaagaaguaccaaaagaaaguaaucgaaugcuacaucggauaccuacggaagaauuacgaagaacuauucgacuucucggacuuuaaaaugaacauacaagaaaucaagaaacaaauuaaggacauaaacgacaauaagacauacgaacgaaucaccgucaagaccuccgacaagaccaucgucaucaaugacgauuucgaauacaucaucuccaucuuugcccuccuaaacucaaacgccguaauaaacaagaucagaaaccgguucuucgcgacuuccguuuggcuaaacacgucggaauaccaaaacauuaucgacauacuugacgagaucaugcagcugaacacacuacggaacgaaugcauaacggaaaacuggaaccugaaccucgaggaguucauucagaaaaugaaggaaauagaaaaggacuucgacgacuuuaagauacaaaccaagaaagagauauucaacaauuacuacgaagauaucaagaacaauauacucacggaguucaaagacgacauaaacgggugugacguacucgaaaagaaacuagagaaaauagucaucuucgacgacgaaacaaaguucgaaaucgacaagaaguccaacauccuacaagaugaacaaaggaaauugagcaacauaaacaagaaagaucucaaaaagaaaguagaccaguacauaaaagacaaggaccaggagaucaagucaaaaauacugugcagaauaaucuucaacuccgauuuccuuaagaaguacaagaaagaaaucgacaaccugaucgaggacauggaguccgagaacgaaaacaaguuccaagagaucuacuacccaaaggaacgcaagaacgagcucuacauauacaagaaaaaccucuuucugaacaucggaaaccccaacuucgacaaaaucuacggccucaucagcaacgacauuaaaauggccgacgcuaaauuccucuuuaacaucgacggcaagaacauccgcaaaaacaaaaucucggaaaucgacgcaauccuuaaaaaccugaaugacaagcuaaacggguacuccaaagaauacaaggaaaaauacauaaagaaacucaaagaaaacgacgacuucuucgccaagaacauccaaaauaagaacuacaaaaguuucgaaaaagauuacaaucggguaagugaguacaagaaaauacgcgaccucguggaguucaacuaccuuaauaaaauagaaagcuaccucaucgauauuaauuggaagcuagccauacagauggccagguucgaaagagacaugcauuacaucguaaacggccuacgugagcuggggaucaucaaacugagcggcuauaacacggguauaucacgggcauaccccaaacgcaacggcuccgacggcuucuacaccacuacggccuacuacaaguucuucgacgaagaguccuacaagaaguucgagaaaauaugcuacggcuucggaauagaccucuccgaaaauucagaaauaaacaaacccgaaaacgaauccauuaggaacuacauaucacacuucuacauuguccgaaacccuuucgcagacuacucuauugcggagcagaucgacagaguguccaaccuccucucauacagcaccagguacaacaacucaacguacgccagcguguucgaagucuucaagaaagauguuaacuuggacuacgacgaguugaaaaagaaauucaaacuaauaggcaauaacgacauccuagaacgguuaaugaaaccaaagaaagugucuguccucgagcuagaauccuacaacuccgacuacaucaaaaaccuuauaaucgagcuucugacgaaaaucgaaaauaccaaugacacacucuga

SEQ ID NO: 11618 - RNA, 4170 nt, Artificial Sequence
  Cas13a variant__Leptotrichia shahii__WP_018451595.1__Cas13a
augggcaaccucuucggccacaaacggugguacgaagugcgcgacaagaaagacuucaaaaucaaaagaaaagucaaagugaaaagaaacuaugacggaaacaaauacauccuaaacaucaacgaaaacaacaacaaagagaaaaucgacaacaacaaauucauacgcaaauacauaaacuacaagaaaaacgacaauauauuaaaagaguucacccgcaaauuucacgcaggcaacauccuguucaaacugaaaggaaaagaaggaauaauccgcauugaaaauaacgaugacuuccuagaaacggaagaagugguccuuuacaucgaagcguacggcaaaagcgaaaaacuaaaagcacugggcaucacuaaaaagaaaauaaucgacgaagcgaucagacagggcauuacaaaagacgacaaaaagaucgaaaucaaacgccaagaaaacgaagaagaaauugaaauugacauccgcgacgaguacaccaacaaaacacucaaugacugcuccauaauacugcgaauuauagaaaacgacgaauuggaaaccaaaaagagcaucuaugagauauucaaaaacaucaacaugagccuauacaaaaucauagagaagauuaucgagaacgaaaccgaaaaaguuuucgagaacagauauuacgaagaacaccuacgcgagaaacuccucaaggacgacaagaucgacgugauacuuaccaacuucauggaaauccgggagaagauaaagagcaaccuugagauccucggauucgucaaguucuaccucaacguuggcggggacaagaagaagucgaaaaacaagaaaaugcucguagaaaagauacugaacauaaacgucgauuugacgguugaagacaucgcggacuucguuauaaaagaguuggaguucuggaacauaacgaagcgcauagaaaaagucaagaaagugaacaacgaguuccuagaaaagaggcgaaaccggacauacauuaagagcuacgugcugcuagacaaacacgagaaauucaaaaucgagagagagaacaaaaaggacaaaaucguaaaauuuuucguugagaauaucaaaaacaacagcauaaaagagaaaaucgagaaaauacucgcagaauuuaaaauagaugaacucaucaagaaacuggaaaaagaacuuaagaaagggaauugcgacaccgaaaucuuugggauauuuaagaagcacuauaaggucaacuucgacagcaagaaguucagcaagaaaucagacgaagagaaagagcuauauaaaaucauauaccgauaccuaaaaggccgcaucgagaaaaucuuagugaacgaacagaagguacggcugaagaaaauggagaaaauugagauugagaaaauacuuaacgaaagcauccucucugagaaaaucuugaaaagagucaaacaauacacccucgaacacauaauguaccuggggaagcucaggcauaacgacauagauaugaccaccguaaacaccgacgacuucaguaggcuacaugccaaagaagaacuagaucuagagcucaucaccuuuuucgccucaacgaacauggaacuaaacaaaauuuucagccgggagaacauaaacaaugaugaaaacauagacuucuucggcggagaccgugagaaaaacuacguccucgacaagaaaauacucaacucaaaaaucaaaaucauccgugaccuugauuucauagacaacaaaaacaacaucacuaacaacuuuaucaggaaguucacaaagaucggcacaaaugaacgaaacaggauucuacaugccauauccaaagagcgggaccuccaaggcacacaagaugacuauaacaagguaauaaacauaauccaaaaucugaaaauuagcgacgaggaggugucaaaggcacucaacuuagacguagucuucaaagacaagaaaaacaucauaacgaaaauaaacgacaucaagaucucagaggaaaauaacaacgacauuaaauaccuaccaaguuucagcaaggugcuaccggaaauccugaaccuauacagaaacaacccgaagaacgaaccguucgauacgauagaaaccgaaaagaucguccuaaacgcgcugaucuauguaaacaaggaacucuacaagaaacugauccucgaggacgaccuggaggagaacgaaagcaagaacaucuuucuccaggaacucaagaaaacacucggcaacauagacgaaaucgacgaaaacauaaucgagaauuacuacaaaaaugcacagaucucggccucaaaagguaacaacaaagcgaucaagaaauaucaaaagaaagucaucgagugcuauaucggcuaccugaggaagaauuacgaagaacuguuugacuucagugacuucaagaugaauauacaagaaauuaagaaacagaucaaagacaucaacgacaacaaaacuuacgaacgcaucacagugaaaacguccgacaagaccauaguuauuaacgacgacuucgaauacaucauauccaucuuugcgcuacucaauagcaacgccgugaucaauaagauccgcaaccgcuucuucgcgaccagugucuggcucaacacuagcgaauaucaaaacauaauagacauacuggacgagauuaugcaacuaaacacccugcgcaacgagugcaucaccgaaaacuggaaccugaacuuagaggaguucauccagaaaaugaaagagauagagaaagacuucgacgacuucaaaauacaaacgaagaaagagaucuucaacaacuauuacgaagacaucaaaaacaauauccucacugaguuuaaagacgauaucaacggcugcgacguacuagagaagaaacuggaaaagauagucaucuucgacgacgaaacgaaauucgaaaucgacaagaaaucuaacauacugcaggaugagcaaaggaagcuaagcaacauaaacaagaaggaccuaaagaaaaagguggaccaguacaucaaagauaaagaucaagaaauaaaaucuaaaauccucugcaggauaaucuucaacagcgacuuccugaagaaauauaagaaagagaucgacaaccugaucgaggacauggaaagcgaaaaugaaaacaaguuccaggagauauacuaccccaaggagcgcaagaacgaauuauacauuuacaagaagaaucuguuccucaacaucggcaauccgaauuuugacaagauauauggccugaucuccaaugauaucaaaauggccgacgcaaaauuccuauucaacaucgacggcaagaacaucaggaaaaacaaaauaagcgaaauagacgccauauugaaaaaccuaaaugacaaacucaacggauacucaaaggaguauaaggagaaauacauaaagaagcuaaaagaaaacgacgacuuuuucgcgaaaaacauacaaaauaaaaacuauaagagcuucgagaaagacuacaacagggucagcgaguacaagaaaauccgggaucucguugaguucaacuaucucaauaaaauagaauccuaccucaucgacauuaacuggaaacuugccauccaaauggcccguuucgaaagagacaugcauuacaucgucaauggccuccgagaauuaggcauaauaaaacucagcggcuacaacaccgguauaucucgagcguaccccaagcggaacggcuccgacggcuucuacaccaccacugccuacuacaaauucuucgaugaggaaagcuacaaaaaguucgagaaaaucugcuacggauucggcauugaccugagcgaaaacagcgaaaucaacaaaccugagaacgaaagcauccggaacuacauaagccacuucuacauaguccgcaaccccuucgccgacuacaguaucgcagagcagauugacaggguauccaaccugcuaagcuacagcacacgguacaauaacucaacauacgcuucggucuucgaaguauucaagaaagacguaaaccucgauuacgacgaacuaaagaagaaauucaaacucaucggaaauaacgacauccucgagcgacuaaugaaaccaaagaaagucucgguccuggaauuagaauccuacaacagcgacuacaucaaaaaccucauuaucgaguugcugacaaaaaucgagaacacaaaugacacccuauag

SEQ ID NO: 11619 - RNA, 4305 nt, Artificial Sequence
  Cas13a variant__Leptotrichia shahii__WP_018451595.1__Cas13a(long)
augggcaaucuauucgggcauaaacgaugguacgaaguacgcgacaagaaagacuuuaaaauaaaaaggaaagucaaaguaaaacguaauuacgaugggaacaaauacauucuaaacauaaacgaaaacaacaacaaagagaaaauagacaacaacaaauucauacgaaaauacauaaacuacaagaaaaacgauaacauccucaaagaguucacgcggaaauuucacgccgguaacauacucuucaaacucaaaggcaaagaaggaaucaucagaaucgaaaacaacgacgacuuccuggaaacagaagaaguuguccucuacauugaagccuacgggaaaucagaaaaacuuaaagcccucgggauuacuaaaaagaaaaucauagacgaagccaucagacaaggaaucacaaaagacgauaagaaaauugaaaucaaacgccaagaaaaugaagaagaaauagaaauugacauccgcgacgaauauaccaacaaaacccuuaaugacugcucaauaauauugcggaucauagaaaaugacgaacuggaaacaaagaaaaguauuuaugaaauauucaaaaacaucaacaugagucuguacaaaauaaucgagaaaauaaucgaaaacgagacggagaaaguguucgagaaccguuacuaugaggagcaucuaagagagaaacuauuaaaagacgacaaaauagauguaauccugaccaacuucauggagauacgcgagaaaauuaaaagcaaccucgagauucucggauucguaaaauuuuaucuaaacguagguggggacaagaaaaagagcaaaaacaagaaaauguuaguggagaaaauacugaacauaaacguagaccucacgguagaagacaucgcugacuucgucaucaaggagcuagaguucuggaacauuacaaagcgcaucgagaaggugaagaaagugaauaacgaguuccuagagaagcgucggaaccgcacuuacauuaagagcuauguacuccuugacaaacacgaaaaguucaagaucgaaagagagaacaagaaggacaaaaucgucaaauucuucgucgaaaacaucaagaauaacagcaucaaggagaaaauagagaaaauccucgcagaguucaagaucgaugaacuaaucaagaaacucgaaaaagaacugaagaaagguaacugcgacaccgaaaucuucggaaucuucaagaagcauuacaagguaaacuucgacuccaagaaauucagcaagaaaagcgacgaagaaaaggaacucuacaagauaauauaccgcuaucuuaagggacgcaucgagaaaauucuagugaacgagcaaaaaguccgccugaagaaaauggagaaaauagaaaucgagaaaauccugaacgaaagcauccuaagcgagaaaauccuaaaacgcgucaaacaauacacucuggaacacaucauguaccuggggaaacuacgucauaacgacauagacaugaccaccguaaacacugacgacuucucuagacuccacgcgaaagaagaacucgaccuagaacucaucacguucuucgccagcaccaacauggaacuaaacaaaauauucuccagggaaaacauaaacaacgacgaaaacaucgacuucuucggcggcgaccgcgaaaagaacuacguucuagacaagaaaauacuaaauucaaaaauaaaaauuauccgagaccucgacuucaucgacaauaaaaauaauaucacaaacaacuucauccgcaaguucacuaagaucggaacaaaugaaagaaacagaauccugcacgccaucuccaaggagcgcgaccuccaagggacgcaagacgauuauaacaaagucaucaauauaauacaaaacuugaagaucuccgacgaggaaguaucgaaagcauuaaaccuggacgucgucuucaaagauaagaaaaacauaauuacgaaaauaaacgauaucaaaaucuccgaagagaacaacaacgacauaaaauaccugcccagcuucaguaaagugcucccggagauccugaacuuauaccgaaacaaccccaaaaacgaacccuucgacacaaucgagacagagaaaaucguacugaacgcacuaauuuacguuaacaaagagcuauauaagaaacuaauccuugaggacgaccuagaggagaaugaaucuaagaacaucuuccuacaagagcucaagaaaacgcucggcaacaucgacgagauagacgaaaacaucaucgaaaacuacuacaaaaacgcacagauaagcgccucgaagggaaacaacaaggccaucaagaaauaccagaagaaagucaucgaaugcuacaucggcuaccuacguaagaacuacgaagaacuguucgacuucucggauuucaaaaugaacauccaggaaaucaaaaagcaaaucaaggauaucaacgacaacaaaacuuacgaacguaucacagucaagaccucagacaaaacaaucgucaucaacgaugacuucgaauacaucaucaguauauucgcccugcucaacucaaacgccguaaucaauaaaaucagaaaccgguucuuugccaccagcguauggcuaaacacgagcgaguaccagaacaucaucgacauccuugacgagauaaugcaacuuaacacauuaagaaacgagugcauaacagaaaacuggaaccuaaaucuagaggaauuuauccagaaaaugaaggagauugaaaaagacuucgacgacuucaaaauacaaacuaagaaagagauuuucaacaacuacuacgaggacaucaaaaacaacauccucaccgaguucaaagaugauauaaacggaugcgacgugcuagaaaagaaacuagagaaaaucgugaucuucgacgacgaaaccaaguucgaaaucgacaagaaaucgaacauucugcaagacgaacaacgcaagcuauccaacaucaauaagaaggaccugaagaagaaggucgaccaauacaucaaagacaaggaccaagaaauaaagucgaaaauacucugcagaaucauauucaacucagauuuccucaagaaauacaagaaagagaucgacaaccucaucgaggacauggaaucugaaaacgagaacaaauuccaggaaauauacuaucccaaagaaagaaagaacgaacucuacauauacaagaaaaaccucuuccucaauaucggcaacccaaacuucgacaaaauauacggacuaaucuccaacgacaucaaaauggcagacgcuaaguuccuguuuaacaucgacgggaagaacauaaggaagaacaaaauaucggaaaucgacgccauccugaaaaaccucaacgacaaacucaacggauacaguaaagaguacaaggagaaauacauaaagaaacugaaggaaaaugacgauuucuucgcgaaaaacauccaaaacaagaacuauaagucauuugaaaaggacuauaaccggguaucugaauacaagaaaauccgcgaccuaguugaguucaacuaccucaauaaaauugagucauacuuaauagacaucaacuggaaacuagccauacaaauggcacgcuucgagcgcgacaugcacuacaucgucaacggccuccgagagcugggcaucauaaaacuaagcggauacaacaccggcaucuccagggcuuacccaaaacgaaacgguucagacggcuucuacacuacgaccgcauacuauaaauucuucgaugaggagucguacaagaaauuugagaaaaucugcuacggcuucgggauagaccucagcgagaacagugaaaucaacaagccugagaacgagaguauacggaacuacaucagccacuucuacauagucaggaacccauucgccgacuacuccauagcggagcagaucgaccgagugucgaaccugcucuccuacucaacacgcuacaacaacucuacguacgcuaguguauuugagguguucaagaaagacgucaaccucgacuacgacgagcucaagaagaaauucaaguugauaggaaacaacgacaucuuggaacgccuaaugaaaccaaagaaaguaagcguccuagaauuggaauccuacaacagcgacuacaucaaaaaucuaauaauagaacuucugacgaaaauagagaacacaaacgacacccuaaaacgacccgcggcaacgaaaaaggccgggcaggccaaaaagaagaaaggcagcuacccguacgacgucccggacuacgcauauccauacgauguccccgauuacgcauauccuuacgacgugcccgacuacgccuag

SEQ ID NO: 11620 - RNA, 4158 nt, Artificial Sequence
  Cas13a variant__Leptotrichia sp. oral__WP_021744063.1__Cas13a
augggcaaccucuuuggucacaaacgcugguaugaggugcgagacaagaaagauuucaaaaucaagcgaaaagugaaaguaaaacgaaacuacgacggaaacaaauacauucuaaacauaaacgaaaauaacaacaaagaaaagaucgacaacaauaaauucauaggagaguucguaaacuacaaaaagaacaauaacguccuaaaagaguucaaacgcaaauuucacgccggaaacauccuauuuaagcucaaaggcaaagaagaaaucauacgcauugagaacaacgacgacuuucuagagacagaagagguaguccuguacauagaaguguauggcaaaucugagaaacuaaaggcgcuagaaauaaccaagaaaaagauaaucgacgaagccauucgucaagggauaacaaaggacgacaagaagauagaaauaaagaggcaagagaacgaagaggaaaucgagaucgauauccgugacgaauauacaaacaagacgcuaaacgacugcucaauaauacuccggaucauugaaaaugaugaauuagaaacuaagaaauccauauacgaaauauucaaaaauaucaacaugucgcucuacaagauaaucgagaagauuaucgagaacgaaacagaaaaggucuucgagaacagguacuacgaagaacaccuacgggagaaacuccucaaagacaacaagaucgaugugauccuaaccaacuucauggaaauccgcgagaagauaaaaagcaaccuagagaucauggguuuugugaaguucuaccucaacgucucgggggacaaaaagaaauccgaaaauaaaaagauguucgucgagaagauccuuaacacgaacguggaucugaccguagaggacaucguagauuucaucgucaaagaacugaaauucuggaacauaacuaaacgaauagaaaaagucaagaaauucaacaacgaguucuuggaaaaccgccgcaacagaacguauauaaaaucguacguacuacucgacaaacacgagaaguucaagaucgaaagagagaacaagaaggacaagaucgucaaauucuuugucgaaaacauuaaaaauaauuccauaaaggaaaagauagagaaaauacuagcggaguucaaaauuaacgagcucaucaagaaacuggagaaagagcuaaagaaaggcaacugcgauacagagauuuucggaauauucaagaagcacuacaagguaaacuucgacucuaagaaauucagcaauaaguccgacgaggagaaagaacucuacaaaaucauauacagguaccucaaggggagaauagaaaagauacugguuaacgaacaaaaaguccggcucaagaaaauggagaaaaucgaaauagaaaagauacugaacgaguccaucuugagcgaaaagauucuaaaacggguuaaacaguacacccuugagcacaucauguaucucggcaaacucagacacaacgacaucguaaaaaugaccgucaacaccgacgacuucaguagguugcacgcgaaagaggaacuugaccucgagcuaauaaccuucuucgccucaacaaacauggaacuaaacaagauuuuuaacgggaaggagaaggucacagauuucuucgguuuuaaccucaauggccagaaaauaacgcugaaagagaaagugccauccuucaaacugaauauccuaaagaaacuaaacuucaucaauaacgagaacaacaucgacgagaagcucagucacuucuacucauuccaaaaggagggauaccuccugaggaauaagauucuccacaacucauacggaaacauacaagaaacgaaaaaucucaaaggggaauacgagaacguagaaaaguuaaucaaagaacuaaaagugucugacgaggagaucagcaagagccucagccuagacgugauauucgaaggcaagguggacauaauuaacaaaauaaacucacuaaagaucggagaguacaaggacaagaaauaccuuccaucguuuagcaaaauaguauuagaaauaacucgcaaguuccgagaaauaaauaaggauaaacuauucgauaucgagagcgagaaaaucauccugaaugccgucaaguacgucaacaaaauacucuacgaaaagaucacaucuaacgaagaaaacgaguuccucaaaacacuacccgacaaauuagugaaaaaguccaauaacaagaaagaaaacaaaaaccugcugagcauagaagaauacuacaaaaacgcccaggucucgucgucgaaaggagacaagaaagccauaaagaaauaccagaacaaagugacaaacgcguaccuagaauaccucgagaacaccuuuaccgagauaaucgacuucuccaaauucaaccugaacuacgacgagaucaaaaccaaaauagaggagagaaaagacaauaaaagcaaaaucaucauagacuccauauccacaaacaucaacauaacaaacgacauagaauacauuaucuccauauucgcguuacuuaacagcaacaccuauaucaacaaaauuagaaacagauucuucgccaccucaguuuggcuggaaaagcagaacggcaccaaagaauacgacuaugagaacauaaucagcauacuagacgagguauuacuuaucaaccuacuacgggagaacaacauuaccgacauccuagaccucaaaaacgcaaucaucgacgccaaaaucgucgagaacgacgagacauacaucaaaaacuacauauuugagaguaacgaagaaaaacucaagaaacggcucuuuugcgaggagcuagucgacaaggaagauauacgaaagauauucgaagacgagaacuucaaauucaagagcuucauaaagaaaaacgaaauaggaaacuucaaaauuaacuucggaauccucucaaaccucgaguguaauagcgaggucgaagcgaagaaaaucauuggcaaaaacaguaaaaaguuggagucguucauccagaacauaaucgacgaguacaagucgaacauccgaacacucuucucguccgaguuucuagaaaaauauaaagaggaaaucgacaaccuaguagaggacacggaaagcgagaacaagaacaaguucgagaagaucuacuacccuaaggaacacaagaacgagcucuacauauacaagaaaaaccucuuccugaacaucggaaauccgaacuucgacaaaaucuaugggcucaucagcaaagacaucaagaacgucgacaccaagauccuauuugacgacgacaucaagaagaacaagaucucggagauugacgccauacucaaaaaccuaaaugacaaacuaaacggguacucaaacgacuacaaggcaaaguacgucaacaaacuuaaagagaaugaugacuucuucgcgaaaaacauacagaacgaaaacuacaguucauucggcgaguucgaaaaggacuacaacaaaguuagcgaguacaagaaaauacgcgaucuaguagaguucaacuaccucaacaaaaucgaaucauaccuaauagauaucaacuggaaacuagcaauccagauggcaagguucgaaagagauaugcacuacauuguuaauggccuucgcgaauugggcaucauuaaacuaucgggcuacaauaccgguauaagccgagccuacccgaagcgaaacggcagcgacggcuucuacacaaccaccgccuacuacaaguucuucgaugaggaaaguuacaagaaauucgaaaagaucugcuacggcuuuggaaucgaccugagcgaaaauucagagaucaacaaacccgaaaacgaaucaauucgaaacuacauaucgcauuuuuacaucguaaggaacccauuugccgacuacucaauagcggagcaaaucgauagagugagcaaccuccucuccuacuccacccgcuauaacaacucaacguacgcaagcguauucgaggucuucaaaaaggacguaaaccuggauuacgacgaguugaagaagaaauuccggcuuaucggcaacaacgacaucuuggaacgccucaugaaaccgaaaaaggucuccguacucgaacucgaaagcuauaacagcgauuacaucaaaaaccucaucaucgagcuccuaacgaagaucgagaacacaaacgacaccuuauag

SEQ ID NO: 11621 - RNA, 3459 nt, Artificial Sequence
  Cas13a variant__Leptotrichia wadei__WP_021746774.1__Cas13a
augaaaguaaccaaagucgacgguaucucccacaaaaaguacaucgaagaaggcaaacucguaaaaagcacaagcgaggaaaauagaacguccgagcgacuaagcgaacuacucagcauucgccucgacaucuacaucaaaaaucccgacaacgcgagcgaagaagagaaccgcauccgccgcgaaaaccuaaagaaguucuucaguaacaaagucuuacaucucaaagacucgguacucuaccucaagaacagaaaggaaaagaacgcgguccaggacaagaauuauucagaagaagacaucagcgaguacgaucuuaaaaacaagaacucguucucgguacuaaagaaaauauuacucaacgaagacguuaauuccgaggagcuggaaauauuccgcaaagauguggaggccaaacuaaacaaaauaaacagccucaaguacuccuuugaagagaacaaggcaaauuaccagaaaaucaacgaaaacaacgucgaaaaagucgggggcaaaagcaagcggaacaucaucuacgacuauuacagggaaagcgccaagagaaacgacuacaucaacaacguccaggaagcauucgacaaacucuacaagaaagaagacaucgaaaaacuauucuuccucaucgaaaacuccaagaagcacgaaaaauacaaaauccgagaauauuaccacaaaauuaucggcagaaagaacgacaaagaaaacuucgcgaaaauaaucuaugaagagauacagaacguaaacaacaucaaagaacuaaucgaaaagauccccgauauguccgaacuuaagaagucccagguauucuacaaauacuaccucgacaaagaggaacucaacgacaaaaauaucaaauaugccuucugccacuuugucgagauagaaaugagccaacuacucaaaaacuacguguacaagcgacuaucaaacaucaguaacgacaaaauaaaacgcauauucgaauaccagaaucugaaaaagcugaucgagaauaaacuccuaaacaaacuagauaccuacgugcgcaacugcggcaaauacaacuacuaccugcaagucggcgagaucgccacuagcgacuucaucgcacgcaaccgucaaaacgaagccuuccugcgaaacauaauaggcgucaguuccguggccuauuucucccuccggaacaucuuagagacagagaacgagaacggcaucaccggucgcaugcgcggcaaaaccgucaaaaauaacaaaggcgaagaaaaguauguaucaggagaagucgauaaaauuuauaaugagaauaaacaaaacgaaguaaaggaaaaccucaagauguucuacagcuacgacuucaacauggacaacaaaaacgaaaucgaggacuucuucgccaacaucgacgaagccaucagcucaaucaggcacgggaucgugcacuucaaccuagagcucgaggguaaagacauauucgccuucaagaauaucgcgcccuccgagaucagcaagaaaauguuccaaaacgaaaucaacgagaagaaacuaaaacucaaaauauucaagcaacugaacagugcgaauguauuuaacuacuacgagaaagacgucaucaucaaauaucucaaaaacaccaaguucaacuucguaaacaaaaacauccccuucgugccaaguuucacaaaacuauacaacaaaauagaggaccuucgaaacacccuaaaauucuucuggagcguacccaaagacaaagaagaaaaagacgcucaaaucuaccugcuaaagaauauauacuauggggaguuucucaauaaauucgugaaaaauuccaaggucuucuucaaaaucacgaacgaagucauaaaaauaaacaaacaacgcaaccaaaagacuggucacuacaaauaccagaaguuugaaaacaucgagaaaaccguaccagucgaauaccuagcuauaauucagucccgggaaaugaucaacaaccaagacaaggaggagaaaaacaccuacauagacuucauccaacaaauauuccuuaagggauucaucgacuaccucaacaagaauaaccugaaauacauagagucuaacaacaacaacgauaacaacgacaucuucagcaaaaucaaaaucaagaaggacaacaaggaaaaguaugacaaaauucucaaaaacuaugagaaacacaaccgcaacaaagagauaccccaugaaaucaaugaauuugucagggagaucaaacugggcaagauacucaaguacaccgagaaccuaaacauguucuaccuaauccucaagcuacuaaaccacaaagaauuaacgaaccucaaagggagccucgaaaaauaccagagugcgaacaaagaagaaacguucuccgacgagcucgagcucaucaaccuccugaacuuagacaacaacagagugacggaagacuucgaacucgaggcaaacgaaauagggaaauuccucgacuucaaugaaaacaaaaucaaggaccguaaggagcugaagaaauucgacaccaacaaaaucuacuucgauggcgagaacauaauaaagcaccgcgcguucuacaacaucaagaaauacggaaugcugaaccuacuggagaaaauagcggacaaagccaaauacaaaaucagucuaaaagaacugaaggaauacaguaauaagaaaaacgaaauagagaagaauuacaccaugcagcaaaaccuacacaggaaauacgccagaccaaagaaagacgaaaaauucaacgacgaggacuauaaagaguaugaaaaagccauaggaaauauucaaaaguauacacaccucaaaaacaaggucgaguucaaugaacuuaaccuacuacaaggccuacucuuaaagauacuccacagacucguaggguacaccuccaucugggaacgcgaccuucgauuccgccuaaaaggagaguuccccgaaaaccacuacauagaagagaucuuuaacuucgacaacagcaagaacgugaaauacaaguccgggcagaucguggaaaaauacaucaacuucuacaaagaacucuacaaagacaacguugaaaagaggagcaucuacagcgauaaaaagguaaagaaacuuaaacaagaaaagaaagaccucuauauccgcaacuacauugcgcacuucaacuauauaccccacgcugaaaucucgcuuuuagaaguccuagaaaaccugcgaaaacuccugagcuacgaccgaaaacuaaagaacgccaucaugaaaaguaucgucgacauacugaaagaauacggcuucguagcaaccuuuaagaucggcgccgacaaaaagaucgaaauccaaacgcucgaauccgagaaaaucguacaccuaaagaacuugaaaaagaagaaacuaaugacagaccggaacagcgaggaacucugcgaauuagugaaagucauguucgaguacaaagcccuagaauaa

SEQ ID NO: 11622 - RNA, 3459 nt, Artificial Sequence
  Cas13a variant__Leptotrichia wadei__WP_021746774.1__Cas13a(G403D)
augaaaguaaccaaaguggacggaaucucacacaagaaauacaucgaagaaggaaagcuagugaagucuacauccgaagaaaaccgaacuagcgaacgacuaucagaacugcucagcauuaggcucgacaucuacaucaaaaacccggacaacgcaucagaggaagaaaaucgcauacgacgggaaaaccucaaaaaguucuuuagcaacaaaguacuacaccugaaagacucuguccuguaccucaagaacagaaaagagaaaaacgccguacaagacaagaacuacucggaagaagauauaagcgaguacgaccucaagaacaagaacucguucagcguucucaagaaaauccugcuaaacgaagaugucaacuccgaggaacuugaaaucuuccgaaaagacguggaggcuaagcuaaauaagaucaacucccucaaauacagcuucgaggagaacaaggccaacuaucagaaaauaaacgaaaacaacgucgagaaggucgggggaaaaaguaaacggaacauaauauaugacuauuauagagaaucggcgaaacggaacgacuacauaaauaacguccaagaagccuucgacaaacuauacaaaaaggaagacaucgaaaaacuuuucuuccugauagaaaacucgaagaaacacgaaaaauacaagauccgcgaguacuaucacaaaauaaucggcaggaagaacgacaaagagaacuucgccaaaaucaucuacgaggaaauacaaaauguaaauaacaucaaagaacucauagagaaaauacccgacaugagcgaacucaagaaaucccaaguauucuacaaauacuaccuagacaaagaagaacuuaaugauaaaaacaucaaauacgcauucugucacuucguugaaauugaaaugagccaacuucucaaaaacuacguauacaagcgccugagcaauaucuccaacgacaaaaucaaacguauauucgaauaccagaaucucaaaaagcuaauagaaaacaagcugcucaacaagcuggacacauacguacgcaauugcgggaaguacaacuauuaucuccaagucggcgagaucgcgacguccgacuucaucgcacggaaccgccaaaacgaggcguucuugcgaaauauaaucggagugaguagcguggcguacuucucgcuccguaacauccuagaaaccgaaaacgagaacgacaucaccggacgcaugcgaggcaaaacggucaagaacaacaagggagaggaaaaauacgucucaggcgaaguagauaaaaucuacaacgagaacaaacaaaaugaaguaaaagaaaaccuaaaaauguucuacuccuacgacuucaacauggauaacaaaaacgagauagaggacuucuucgccaauaucgacgaagccauuucgagcauacggcacggaauuguccacuuuaaccucgaacucgaggggaaagacaucuucgccuucaagaacauagcccccagcgaaauauccaaaaagauguuccaaaacgaaaucaacgagaaaaagcugaaauuaaagaucuucaaacagcucaauagcgcaaacguguuuaacuacuacgaaaaagacguaauaauaaaauaccuuaagaacaccaaguucaacuucgucaacaagaacaucccauucgucccauccuuuaccaagcuguacaacaagauagaagaccuacgaaacacgcuaaaauuuuucuggucagucccuaaagacaaggaagaaaaggacgcccagaucuaucuccucaaaaauaucuauuacggcgaguuccuaaacaaauucgucaaaaacuccaaaguguucuucaaaaucaccaacgaggucaucaaaaucaacaagcagcgcaaccagaaaacgggccacuacaaguaccaaaaguucgaaaacaucgagaaaaccguaccggucgaauaccucgccaucauccaaagccgggagaugauaaacaaccaggauaaagaagagaaaaacaccuacauagacuucauacagcagauauuccugaagggcuucaucgacuaccugaacaaaaacaaccugaaauauaucgaaagcaacaacaacaacgauaacaacgacauauucucaaagauaaaaauaaagaaagacaacaaagaaaaauaugacaagauccugaaaaacuacgaaaagcacaaccgaaacaaagagaucccccacgaaaucaacgaguucguccgagaaauaaaacuaggaaaaauacucaaauacacggaaaaccucaacauguucuaucuaauacugaaacugcuaaaccacaaagaacuaaccaaccuaaagggaucccucgaaaaauaucaguccgccaacaaggaagagacauucagcgacgagcuggaacucauaaaucuccucaaccuggacaacaacagagucacagaagacuuugaacuagaagccaaugagaucgguaaauucuuagacuucaacgagaacaagauaaaggaccgcaaggaacucaagaaauucgacacaaauaaaaucuauuucgauggcgaaaacaucauaaaacacagggcauucuauaacaucaagaaauacgggaugcugaaccugcuggagaaaaucgcagacaaggcuaaguacaaaaucucacucaaagaacucaaagaauacuccaacaaaaagaacgaaauagagaaaaacuacacgaugcagcaaaaccuccaccgcaaauacgcccgucccaaaaaggacgaaaaauucaacgacgaagauuacaaggaauacgaaaaagccaucggaaacauacaaaaguauacccaccugaagaauaaaguagaguucaacgaacugaaccucuugcaaggacuccugcucaaaauacuacaucgcuuaguaggauacaccagcauaugggaacgagaucuccgauuccggcuaaagggagaguuccccgaaaaccacuauaucgaggaaauauucaacuucgacaacagcaaaaacgucaaauacaagucgggccaaauaguggaaaaauauauuaacuucuacaaagagcuauacaaggauaauguugaaaaacguagcaucuacagcgacaagaaggucaaaaagcuaaaacaagaaaagaaagaccucuacauacgaaacuacaucgcgcacuucaacuauaucccgcacgcagaaauaucacuucucgagguacuggagaacuugcgcaaacuauuguccuacgauaggaaacugaagaacgccaucaugaaguccauaguggacauacugaaggaguacggcuucgucgcgacauuuaaaauaggcgcggacaagaagaucgaaauccaaacacuggaguccgaaaagaucguccaccucaagaaucuuaaaaagaagaaacuuaugacagaccgaaacagcgaggagcucugcgaacucgucaaagucauguucgaauauaaagcguuagaauag

SEQ ID NO: 11623 - RNA, 3909 nt, Artificial Sequence
  Cas13a variant__Leptotrichia wadei__WP_021746774.1__6xHis-Tag/Twin-Strep/SUMO_Cas13a(G403D)
augggcagcucucaccaccaccaccaccacuccucugggcuggugccucguggcagccacauggcauccuggagccacccgcaauucgaaaaagguggagggagcggcggcggaagugggggaucagcuuggucccacccccaauucgagaagaugagugacucagaagucaaccaggaagccaaacccgaagucaagccagaaguuaaacccgaaacccauauuaaucuuaaagucuccgacgggagcagcgaaauuuucuucaaaaucaagaaaacaaccccgcuucgacgacuaauggaggcauucgcgaaaagacaagggaaggagauggauucccuacgauuccuguacgauggcauacguauccaagcagaccaaacacccgaagaccuugacauggaagacaacgacaucauagaagcacaccgcgaacagaucggcggauccaugaagguaacaaagguagacggcaucucacacaagaaguacauagaagaagguaaacucguaaaaagcacaagugaagagaaccggacaucagagcgccuaagcgaauugcuauccauacggcucgacauauauaucaaaaaccccgacaaugcaagcgaggaagaaaaccggauacggcgugaaaaccucaaaaaguuuuucagcaacaaaguccuccaucuaaaggacagugugcuuuaccugaaaaacagaaaagagaaaaacgcggugcaggacaaaaacuauuccgaagaagacaucuccgaguacgaccucaaaaacaagaacagcuucagcgugcuuaaaaagauccuccucaacgaagacgucaauuccgaggagcuagaaauuuuccguaaagacguagaggcaaaacucaacaagaucaacagucugaaauacuccuucgaggaaaacaaagccaacuaccagaaaaucaaugaaaauaacguagaaaaagucggaggcaaguccaagcggaacaucaucuacgacuauuaccgagaaagugcaaaaagaaacgacuacauaaacaacguccaagaagcauucgacaagcucuacaagaaagaagacaucgaaaaacuauucuuccucaucgaaaacuccaagaagcacgagaaauacaaaauccgcgaguauuaccacaagauaauaggcaggaaaaacgacaaagagaacuucgcuaaaauaaucuacgaagaaauccaaaacguuaauaacaucaaagagcuuaucgagaaaaucccagacaugucagaacucaagaaaucgcaagucuuuuacaaauacuaccucgacaaagaagaacugaacgauaaaaacauaaaauaugccuuuugccacuucguggagauagagaugagccaacuccuaaagaacuacgucuacaagcgacuuuccaacaucagcaacgacaagaucaaacgcaucuucgaauaccaaaaccuuaagaaacucauagaaaacaaacuucucaacaagcuggacacguacguccguaacugcggcaaauacaacuauuaucuacaggucggcgaaauagccacgagcgauuucauugcucggaaccgccaaaacgaagcauuccugcgcaacauuaucggaguaucaucuguagcauauuucucccuccgcaacauacuagaaacagagaacgagaacgacaucaccggaagaaugcggggcaaaaccgugaaaaacaacaagggcgaagagaaguauguguccggcgaagucgacaagauuuacaacgaaaacaaacagaaugaaguuaaggagaaccugaagauguucuacucauacgacuuuaacauggacaacaaaaacgaaauagaagauuucuucgcaaacauagacgaagccauuagcuccauuagacacggcauuguacacuucaaccucgaacucgaaggcaaagacaucuucgcauucaaaaacauagcacccagcgaaauuagcaaaaagauguuccaaaacgaaaucaacgagaagaaacucaaacucaaaaucuucaagcaacucaacuccgccaacguguucaacuacuacgagaaagacgugaucauaaaauaccuuaagaacaccaaauucaacuucgucaacaaaaacauaccauuuguccccagcuucaccaaacuauacaacaaaauugaagaucuaaggaacacccuaaaauucuucuggaguguacccaaggacaaagaggagaaggacgcccagauauaccuccuuaagaauaucuacuacggcgaguuccucaacaaguucguuaaaaacucuaagguuuucuucaaaauaaccaacgaagucaucaaaaucaacaagcaaagaaaccagaaaaccggccacuacaaauaucaaaaauucgagaacaucgagaagacaguccccguggaauaucuggcaauaauacaaagucgcgaaaugaucaacaaccaagacaaagaggaaaagaacaccuauaucgauuucauacaacagaucuuucucaaggguuuuauagacuaccuaaacaaaaacaaccuaaaauauaucgagaguaacaauaacaacgacaacaacgacaucuucucaaaaaucaagauaaagaaagauaacaaagaaaaauacgacaaaauuuuaaagaacuacgaaaaacauaaccgcaacaaagaaauaccgcacgaaaucaacgaguucguccgcgaaaucaaacuaggaaagauccucaaguacaccgaaaaccucaauauguucuaccucauccucaagcuguugaaccauaaggaacuaacaaaccucaaaggcagcuuagagaaauaccaaucagccaacaaagaggagacauucuccgacgaauuggagcugauaaaccuacucaaucuggacaacaaccgggugaccgaggacuucgaacuagaggccaacgagaucggcaaauuccucgacuuuaaugagaauaagauaaaagaccgcaaggaacuaaagaaauucgacacaaacaaaaucuacuucgacggugagaacaucauaaaacaucgggccuucuacaacaucaaaaaguauggaaugcuaaaccugcucgagaaaauugcagacaaagccaaauacaagaucucccucaaggaacucaaggaguacuccaauaagaaaaacgagauagagaaaaacuacaccaugcagcagaaccuccaccgcaaauacgcacgucccaagaaagacgaaaaauucaacgacgaagacuauaaagaauacgaaaaagccauuggcaacauccagaaauacacccaccugaaaaacaagguggaguucaacgaacuuaaccuccuccaaggccuccugcuaaagauccuccacagacugguaggcuacaccuccauuugggaaagggaccuccguuuccgccuaaaaggcgaguucccagaaaaccauuacaucgaagaaaucuucaacuucgacaacaguaaaaacgucaaauacaaaucagggcagaucguagaaaaguacaucaacuucuacaaggaacuuuacaaagacaacguagaaaaacgauccaucuacuccgacaagaaaguuaagaaacuaaaacaggaaaagaaagaucuguacauacgcaacuacaucgcccauuucaacuacaucccgcacgcagaaaucucacugcuagaaguccucgaaaaucuccgaaaacugcucaguuacgaccgaaaacucaaaaacgccauaaugaaaagcauagucgacauauugaaagaauacggauucgucgcaacguucaagaucggggccgacaagaaaaucgaaauccaaacccuggagagcgagaaaauaguccaccucaaaaaccugaagaaaaagaaacugaugacagaccggaacucagaagaacuaugcgaacuggucaaagugauguucgaauauaaagcccucgaauga

SEQ ID NO: 11624 - RNA, 3459 nt, Artificial Sequence
  Cas13a variant__Leptotrichia wadei__WP_021746774.1__Cas13a(R474A,R1046A)
augaagguuaccaaagucgacggaaucagucauaaaaaguacauagaagagggaaagcucguaaagagcaccagcgaggaaaacaggacguccgaaaggcuuagcgagcuccuuuccauaagacucgacauuuauaucaaaaacccagacaacgccucggaagaggaaaacagaauaagacgcgaaaaccugaagaaauucuuuucaaacaaaguccuacaccuaaaagacagcguccuauaccugaagaaccgaaaagaaaagaaugcagugcaagacaagaacuacucggaggaggauauaagcgaauacgaucucaaaaacaaaaacagcuucucuguccugaagaagauacugcuaaaugaagacguaaauagcgaggaauuagaaaucuuccgaaaagacgucgaagccaaacuaaacaagaucaacucccucaaguacucauucgaagagaacaaagcuaacuaccagaaaauaaacgaaaacaacguugagaaagucggcggcaagagcaagagaaacaucaucuacgacuacuaucgagagagcgccaaacgcaaugacuacaucaacaacguccaagaggcguucgacaaacuauacaagaaagaagacauagagaaacuauucuuccucaucgaaaacagcaagaaacacgagaaauacaaaauuagagaguacuaccacaaaaucauaggccgcaaaaacgacaaagaaaauuucgcaaagaucaucuacgaggagauccagaacgucaauaacaucaaggaacucauagagaaaauacccgacaugagugaacucaagaaaagccaaguauuuuacaaguauuacuuagacaaagaggaacucaacgacaagaacauaaaguaugccuucugccacuucguagaaauagaaaugagccagcuacuuaaaaacuacguguacaaacgccugucuaacaucucgaacgacaagauaaagaggauuuucgaauaccagaaccucaaaaagcucauagaaaacaaacuccuuaacaagcuggacacguacguacgcaacugcggcaaguacaacuacuaccuacaagugggggaaaucgcaacaagcgacuucauagcacguaaccggcagaacgaagcauuccuccguaacaucauaggcgugucgagcguagcauacuucucacuacggaacauccuagagacugaaaacgaaaauggcaucacgggccgcaugcgcgggaaaaccgugaaaaauaacaagggagaagaaaaauacguaagcggggaaguggacaagauauacaacgagaacaagcaaaacgaggucaaggagaaccuaaaaauguucuacucauacgacuuuaacauggacaacaagaacgaaauagaagacuucuucgcgaacaucgacgaagccaucagcuccaucgcacacggaaucguccacuucaaccucgaacuagaaggcaaggauauauucgcauuuaaaaacaucgcccccagcgaaaucagcaaaaagauguuccaaaacgagauaaacgaaaagaaacuuaaacuuaaaaucuucaaacaacucaacucggccaacguauucaacuacuacgaaaaagacguuaucaucaaauaccugaaaaacaccaaauuuaacuucguuaauaaaaacauacccuucguccccagcuuuacgaagcucuacaacaaaauagaagaucuacgaaacacacuaaaguucuuuuggucaguucccaaggauaaagaagagaaagacgcacaaauauaccuucucaaaaauauauacuacggagaguuccucaacaaguucguaaagaacuccaaagucuucuucaagaucaccaacgaagucaucaaaaucaacaaacaaaggaaccaaaagacaggccacuacaaauaccaaaaauucgaaaauauagaaaagacuguccccgucgaauaucucgccaucauccaaucccgggaaaugaucaacaaccaagacaaagaagaaaagaauaccuauauagacuucauccagcaaaucuuccucaagggauucaucgacuaccugaacaaaaacaacuugaaguacauagagaguaacaacaauaacgauaacaacgacauuuucucaaaaauaaaaauuaagaaggacaacaaggaaaaauacgacaaaauccucaaaaacuacgaaaaacacaaccgaaacaaggaaaucccccaugagaucaacgaguucguccgagaaauuaagcuaggcaagauccucaaguacacugagaaccucaacauguucuaccucauacuaaagcuauugaaccacaaggagcuuacaaaccugaagggcucgcucgaaaaauaccaaagcgccaacaaggaggagaccuucagcgacgagcucgaacucauaaacuuacuaaaccuagacaacaaccggguaacggaagacuuugagcucgaggcgaacgaaauaggcaaauuccuggacuucaacgaaaacaagaucaaggacaggaaagaacuaaagaaguucgacaccaacaaaaucuacuuugacggcgagaacaucaucaaacaucgagcauucuacaacaucaaaaaguacggcaugcuaaaccugcuugagaagauagcggacaaagcaaaauacaagauaucacuaaaagaacuuaaagaauacucaaacaagaaaaaugaaauagagaaaaacuacaccaugcaacaaaaccuucaccgcaaguacgcuaggccgaaaaaggacgaaaaauucaacgacgaagacuacaaagaauacgaaaaggccauaggcaauauccaaaaguauacacaccugaagaauaaaguagaguucaacgaacucaacuuacuccagggucuucuacugaagauacugcaccgccuagucggauacaccucgaucugggaaagagacuugagauuccgcuuaaaaggggaguuccccgaaaaucacuacauagaagaaauauucaacuucgacaacucuaaaaacgucaaguacaaaagcggucaaaucgucgagaaauacauaaacuuuuacaaagagcuauacaaggacaacguugagaaacggagcauauauucagauaagaaaguaaagaaguugaaacaagagaaaaaggaccuguacaucgcaaacuacauugcgcacuucaacuacaucccccacgccgaaauauccuuacuagaggugcuggagaaccuucgcaagcuccugagcuacgaccgaaaacucaaaaacgcaaucaugaaauccauagucgauauccucaaagaauacggcuucgucgccaccuuuaagaucggcgcagacaagaaaauugaaauccaaacccuggaguccgagaaaauuguccaccucaaaaaccucaaaaagaagaaauuaaugaccgauaggaacucggaggaacugugcgagcuggucaaaguaauguucgaguacaaggcccucgaauaa

SEQ ID NO: 11625 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggcggcgaaggucuccgcgccucaccgcgacgcaggccccugcugccacuccagccgcgagggugcccccgaggcgaugggugccuccgugggggucgcggccgcgccggguucggguucuggagagugaccggcggcucgcgcgcgagcgcgaaucacgugcacgcguucuucuucuuccuccaguuacuaggcaacgugcucgucaucgugcugagccaccacuucggcaaagaguucgggacagcaggcccgggugcgacgaugaaagugacaaaagucgauggcauaagccacaagaaauacaucgaagaagguaaacugguaaaauccacgucagaagaaaaccguaccagcgaacgccuuagcgaacucuuauccauccgacuugacaucuacaucaaaaaccccgacaacgccucggaggaggaaaacagaauccgacgcgaaaaccucaagaaauucuucuccaacaaaguccuacaccucaaagacagcgugcuguaccuaaagaaccgcaaagagaaaaaugcgguacaagauaaaaacuacuccgaggaggacaucagcgaguacgacuuaaagaacaaaaacagcuucagcguacugaagaaaauucuccuaaacgaagacgugaacucagaagaacuggaaaucuucagaaaagacgucgaagccaaacucaacaaaauaaacucccucaaauacucuuucgaagagaacaaagcaaauuaccagaaaauuaacgagaacaaugucgaaaaagucgggggaaagagcaaacgcaacaucaucuacgacuacuaccgugagucugcgaaacgaaacgacuacaucaacaacgugcaggaagccuucgacaaacucuacaagaaggaggacauagaaaaacucuucuuccuaauagaaaauagcaagaaacacgaaaaauacaagauccgcgaguauuaccacaaaaucauaggacggaaaaacgacaaagagaacuucgccaaaauuauuuacgaagagauacaaaacguuaacaacaucaaggaacuaauagagaaaauacccgacauguccgagcuaaagaaaagccagguguucuauaaauacuaccuggacaaagaagaacuaaacgacaaaaauaucaaauaugcauucugccauuucguggagaucgaaaugucccagcuccucaaaaacuauguuuauaaacgacugucaaauauuucaaacgacaagauaaaacgcaucuucgaauaccaaaaucuaaagaaacuuaucgagaauaaacuacucaacaaguuggacacauacgugaggaacugcggcaaauacaauuacuaccuacaggucggggagauagccaccucggacuuuaucgcgcgcaaccgucagaacgaagccuuccuacgaaauaucaucggcguuagcuccguggcguauuucucccucagaaacauccucgaaaccgaaaacgagaacgggaucacuggccgcaugcggggcaaaacagugaaaaacaacaagggggaggagaaguauguaagcggcgaagucgacaaaaucuacaacgaaaacaagcagaaugaagugaaagagaaccucaaaauguucuacucauacgacuucaacauggauaacaaaaacgaaauagaagacuuuuucgccaacauugacgaggcgaucucgucaauagcccacggaauaguccacuucaaccuagagcuagaagggaaggacaucuucgcauucaaaaacauugcacccucggaaauaagcaaaaagauguuccaaaacgagauuaacgagaagaaacucaaacuaaaaaucuucaaacaguugaacagcgccaacguauucaacuacuacgagaaagacguuaucauaaaauaccucaaaaacaccaaauucaacuucgucaacaagaacauaccguucgugccgagcuucaccaaauuguacaacaaaaucgaagaucuccguaacacccucaaauucuucuggagugucccaaaagauaaagaggagaaagacgcccaaauauaucuccucaaaaacaucuacuacggagaguucuuaaacaaauucgucaagaacagcaagguauucuucaagauaacuaacgagguaaucaaaaucaauaaacaacgaaaccaaaagacaggucacuacaaauaccaaaaauucgaaaacaucgaaaagaccgugcccguggaauaccuggcaauuauccaaagccgugaaaugauuaauaaccaggauaaggaggagaaaaacaccuacaucgacuucauacagcagauauuccuaaaaggguucaucgacuaucugaacaaaaacaaccucaaauacaucgaauccaacaauaauaacgacaacaacgacaucuucaguaagaucaaaaucaagaaagacaacaaggagaaauaugacaagauccuaaagaacuacgagaaacauaaccggaacaaagaaauaccgcacgagaucaacgaguucgugagagagaucaaacuagggaagauccucaaauacacugaaaaccucaacauguucuaccugauacuuaaacuccuaaaccauaaggaacugacuaaccucaaagggucacucgaaaaauaccaauccgcuaacaaagaagaaacauucucagacgaauuggaguuaaucaaccuccuaaaccuagacaacaaccgggugaccgaagauuucgaacuagaagccaacgaaaucgguaaauuccuggacuucaacgagaacaagaucaaggaccgaaaagaacugaaaaaguuugacacaaacaaaauauacuucgacggcgaaaacaucauaaaacacagggcauucuacaacaucaagaaguacggaaugcugaaccuacuagagaagauagcagacaaagcgaaauacaagaucucccucaaagaacuaaaggaauauucuaacaaaaagaacgagauagaaaagaacuacacgaugcagcagaaccuccaucgcaaguacgcgcgccccaagaaagacgaaaaauuuaacgacgaggacuacaaagaguaugaaaaggccaucgguaacauacaaaaguacacacaccucaaaaacaaggucgaguucaacgaacucaaccuccugcagggacugcuccuuaaaauccugcaccgccuggucggcuauacaagcauuugggaacgugaccuacgcuuucgacugaaaggggaauuuccagagaaccacuacaucgaagaaaucuucaacuuugacaacagcaaaaacguaaaauacaaaaguggacaaauagucgaaaaauacaucaacuucuacaaagaauuauacaaggacaacgucgagaaaaggagcaucuauagcgacaaaaagguuaagaagcucaagcaggagaaaaaggaucuauacauagcaaacuacaucgcacauuucaauuacaucccacacgcagagauaaguuuacuggaagugcucgaaaacuuacggaaacuucucagcuacgacagaaagcugaagaaugcaaucaugaaaaguauaguggacauccucaaagaguacggcuucguagcgacguuuaaaauaggcgcugacaagaagauugaaauccagacacuugaaagcgagaaaaucgugcaccucaagaaccucaagaagaagaaacugaugacugaccgaaacagugaagaacucugcgaacuugugaagguuauguucgaauacaaggcccuagaaggcggaggcggcagcggcggagguggcucagggggcgggggaagcgucagcaaaggcgaggaacuuuucaccgggguuguacccauacuugucgaacuagacggagacgucaauggacacaaguuuucggucucaggagagggagagggagacgcaaccuacggaaagcucacucucaaguucaucugcacgacaggaaaacucccaguacccuggcccacccucguaacuacccuuacguauggaguccagugcuucagccgauaucccgaccacaugaaacaacaugacuuuuucaaauccgccaugccggaaggauacguacaagagagaaccaucuucuucaaggaugacggcaacuauaaaacaagggcagaaguaaaguucgagggugauacguuggucaaccgcaucgaacucaaagguauagacuucaaggaggacgggaacauccugggucacaaguuggaauauaacuacaacagccacaacgucuacauaauggccgacaagcagaaaaacggaaucaaggugaauuucaagauacggcacaacauagaggacggauccguacaacucgcggaccacuaccaacaaaacacgcccauaggugacggcccuguccuauuaccagacaaccacuaccucagcacacaauccgcgcucagcaaagauccgaacgagaaaagagaccauaugguccuguuagaguucgucacggcugcgggaaucacgcuaggaauggacgaacuauacucaagaggagcgggagccggcgccggggccggggcgggcagccgcuuccaaugccgcauaugcaugagaaacuucuccgaccgaagcaaucucagccgacacaucaggacccauaccggagaaaagccauucgccugugacauauguggccggaaguucgccauuaguaguaaccucaacagccauacaaagauacacaccggcagucaaaaacccuuccaaugcaggauaugcaugcggaauuucucacgcucagacaaccuugcaagacacauaagaacacacacaggagaaaaacccuucgcaugcgacauaugcggacgcaaguucgccacauccggcaaccugacgaggcacacaaaaauccaccuucggggaucucagcucagcauuguggacgcacccgagcaacgagaaggcgcaagccaggucagugucucggucacauucgaggacgucgcaguacuuuucacgcgggacgaguggaagaaacuugaccucucgcagcgaagccuguacagagagguaaugcucgaaaacuauagcaaccucgccaguauggcuggaucccccaagaagaaacggaaagucuag

SEQ ID NO: 11626 - RNA, 3549 nt, Artificial Sequence
  Cas13a variant__Leptotrichia wadei__ERK53440.1__Cas13a
auguacaugaaaauaaccaaaauagacggaguaagccacuacaagaagcaagauaaaggcauccucaagaagaaauggaaagaucuagacgaacgcaaacaacgagagaaaauagaagcccgcuacaacaaacagauagaaagcaagaucuacaaagaauuuuuccgguugaaaaacaagaaaaggauagaaaaagaagaggaccaaaacauaaaaagccucuacuucuucauaaaggagcuuuaccucaacgagaaaaacgaagaaugggagcucaaaaauauaaaccuggaaauccuggaugacaaggaacgggucaucaaaggguacaaguucaaggaggacgucuacuucuucaaggaaggauacaaagaauacuaccuucggauccuauucaacaacuuaauagaaaaaguacaaaacgaaaaccgcgagaaaguacgcaaaaacaaagaguuccucgacuuaaaggaaaucuucaagaaguacaagaaccgaaagauagaccuacuccuaaaaagcauaaacaacaacaagaucaaccuagaauacaagaaagaaaacguuaacgaagagauauacggaauaaacccgaccaaugaccgggaaaugacauucuacgaacuccuaaaagaaaucaucgagaagaaagaugaacagaaaucgauccuugaagaaaaacucgacaacuucgacauuacuaacuuccuggaaaacaucgagaaaaucuucaacgaagagaccgaaauuaacauaauaaaagguaaaguccugaacgaacuccgcgaguacauaaaagagaaggaagaaaacaacucugacaacaaacucaagcaaauauauaaccuggaacugaagaaauacauugaaaauaacuucucuuacaagaaacagaaaagcaaaaguaaaaacggcaaaaacgacuaucuguaccuuaacuuccugaaaaagauuauguuuaucgaagaagucgacgaaaagaaagaaaucaauaaggagaaauucaaaaauaagaucaacuccaacuucaagaaccuauucguccaacacauccucgacuacggcaagcuacuuuacuacaaggaaaacgacgaguacaucaaaaauaccggacaacucgaaaccaaagaucuagaguacaucaaaacaaaggaaacccuuauuaggaagauggccguacucgucuccuucgcggcaaacagcuacuacaaccuguucgggcggguuucaggggauauacuaggaacagaaguagucaaauccagcaaaacaaacguaaucaagguaggcucucauauauuuaaggagaaaaugcuuaacuacuucuucgacuucgaaaucuucgacgccaacaaaauaguagaaauccuagaguccauaagcuauagcaucuacaauguccggaacgggguaggacacuucaacaaacucauccuaggcaaguacaaaaagaaagacaucaacacaaacaaacgcaucgaagaagaccucaacaacaacgaggagauuaaagguuacuucaucaagaaacgcggagagauagaacgaaaagucaaagaaaaauuucuauccaacaaccuccaauauuacuacucaaaagagaaaaucgaaaauuauuucgaaguguacgaguucgaaauacucaaacgcaaaauacccuucgcaccaaacuucaagcgcauuauaaagaaaggcgaagaccuauucaacaacaaaaauaacaagaaauacgaauacuucaaaaacuucgacaaaaacagcgcggaagagaagaaagaguuccucaaaaccaggaauuuccuacuuaaagaacuguacuacaacaacuuuuacaaagaguuccugagcaagaaagaagaguucgagaaaauaguccuagaaguuaaagaagaaaagaaaucacggggaaacaucaacaauaagaaauccggcguauccuuccaaagcaucgaugacuacgacaccaaaauaaauauaucagauuauaucgccagcauccacaagaaagaaauggaacggguggaaaaauacaacgaggaaaaacaaaaagacaccgccaaauacauacgcgacuucgucgaagagaucuuccucaccgguuucauaaacuaccucgaaaaggacaagcgacuacacuuccucaaagaggaguucucaauccuuugcaacaacaacaacaacguagucgacuucaauaucaacaucaacgaagaaaagauaaaagaguuccuuaaggaaaacgacuccaagacccugaaccucuaucucuucuucaacaugaucgacaguaaacgcaucagugaguuccgaaacgagcuagugaaauacaagcaguucacaaagaagaggcuagacgaagaaaaggaauuucuaggcauaaagaucgaacucuacgaaacacugaucgaguucgucauacucacccgggaaaaauuagauaccaagaaaagcgaagaaaucgacgcauggcuaguagacaagcuauacguaaaagacagcaacgaguacaaggaauaugaagaaauucugaaacucuucguggacgaaaagauacugucuucuaaagaggcacccuacuacgccacagauaacaagacuccaauccuccuguccaacuucgaaaagacgcgcaaguauggaacccaaucguuccuaagcgaaauccagucaaacuacaaguacuccaaggucgaaaaagagaacauagaagacuacaacaaaaaggaggagaucgagcagaagaagaaaucaaacaucgaaaaauugcaggaccucaaagucgaacuacacaaaaagugggagcagaacaaaaucacagagaaggaaaucgaaaaauacaacaacacgacccgaaagauaaacgaauacaacuaccucaagaacaaggaagaacuccaaaacgucuaucuacuccacgagaugcuguccgaccugcuggcccggaacguagcguucuucaacaagugggagcgggacuucaaauucaucguaaucgcaaucaaacaguuucuccgagaaaacgacaaagaaaaagugaacgaguucuugaaucccccggacaacucaaaaggaaagaagguauacuucagcguaagcaaauacaaaaauacgguggaaaacaucgauggcauccacaagaacuuuaugaaccugaucuuccucaacaacaaauucaugaaccgcaaaaucgacaagaugaacugugccauaugggucuacuuccgcaauuacauugcccacuuccuccaccuacacacgaaaaacgagaagauaucccugaucagccaaaugaaccuguuaaucaaacuauuuuccuacgacaaaaagguccaaaaccauauccucaaaucaacgaagacacuacucgaaaaauacaacauccagaucaauuucgagauaagcaacgacaagaacgaggucuucaaauacaagaucaaaaaccgccuguacuccaagaaaggaaaaaugcuggggaaaaacaauaaauucgaaauauuagagaacgaguuccucgaaaacgucaaagccaugcuagaguacucagaauaa

SEQ ID NO: 11627 - RNA, 4158 nt, Artificial Sequence
  Cas13a variant__Clostridium aminophilum__WP_031473346.1__Cas13a
augaaauucaguaaaguugaccacacacgaagcgccguaggcauacaaaaagcgaccgacucaguacacgggaugcuauacacagacccgaagaaacaggaaguuaacgaccucgacaaacguuucgaccaacucaacguuaaagccaaacgacuauacaacguguucaaccaaagcaaagcggaagaagacgacgacgaaaaacgauucggaaaaguggucaagaaacuaaaccgcgaacuaaaagaucuccuuuuucaccgagaaguaucccgcuacaacuccaucgguaaugcgaaguacaacuacuacggaauaaaguccaacccagaagaaaucgucucgaaccuaggaaugguagaaucccuaaaaggugaacgcgacccccaaaaagugaucagcaaacuccuacuauacuaccuccggaagggccuaaaaccaggcaccgacggccugcgaaugauccucgaagcaucgugcggacuccgaaaacuaagcggagacgaaaaagaacucaagguauuccuacaaacacucgacgaggauuucgaaaagaagacauuuaagaaaaacuuaauaagauccaucgaaaaccaaaacauggcgguacagcccuccaacgaaggagacccgauaauaggaaucacacaaggcagauucaacucucagaaaaacgaggagaaaagugcgaucgaacgcaugaugucaauguacgccgaccucaaugaagaccaccgcgaagacguacuacgcaagcuacgcaggcuaaacguacucuacuucaacguagacaccgaaaagaccgaggaacccacccuacccggagaaguagacaccaacccaguguucgaagucuggcacgaccacgaaaaaggcaaagaaaacgaccgacaauucgcaaccuucgcaaagauacucacagaggacagggaaaccagaaagaaagaaaaacuggcggucaaggaggcgcugaacgaccuaaaauccgcaauacgagaccacaacaucauggcauaccgcugcuccaucaaggugacggagcaagacaaagacggccuauucuucgaagaccaacggauuaauagauucuggauccaucacauugagucggcaguggaacgcauccuggcgagcaucaacccggagaaacuuuacaaacuccggauaggauaccuaggagagaaggucuggaaagaccuacucaacuaccuauccaucaaguacaucgcagucgggaaagcagucuuccacuucgcaauggaagacuuaggaaagacaggacaggacaucgaauugggaaagcucuccaacagcgucuccgggggccucaccagcuucgacuacgagcagauacgagccgacgagacauuacaaaggcaacucucuguggaagucgcguucgcugcaaacaaccucuuccgugcaguaguaggccaaacagggaagaaaauagaacagagcaaaagcgaggagaacgaagaagauuuccuccucuggaaagcugagaaaaucgcagaaucgaucaaaaaggaaggcgaaggcaacacguugaaaagcauccugcaguucuucggaggagcaucgagcugggaccucaaccacuucugcgccgccuacggcaaugaaucaucagcccucggguacgagaccaaguucgcagacgaccuucgaaaagcuaucuacucacugcggaaugaaaccuuccacuuuacgacgcugaauaaaggcucauuugacuggaacgccaaacuuauaggcgacauguucucucaugaagcagcuacaggaaucgcaguagaaaggacacgcuucuauucaaauaaccuccccauguucuaccgugaaagcgaccuuaaacggauaauggaccaccucuacaacaccuaccacccgcgagcaagccaaguucccagcuucaacucagucuucguaaggaaaaacuucaggcuguuccucucgaacacacucaacaccaauacuagcuucgacacagaaguauaccagaaaugggagagcggugucuacuacuuauucaaggaaaucuauuacaacucuuuucucccuuccggugacgcgcaucaccuguucuucgaaggguuacgccggauacgaaaagaagccgacaaucuccccaucguagggaaagaggcaaagaaaaggaacgcgguacaggacuucgggcgacgcugcgacgagcucaaaaaccucucccucagcgcuauaugccaaaugauaaugaccgaauacaacgaacaaaacaauggcaaccguaaagucaaaucaaccagggaagacaaacguaaacccgauauauuccaacacuacaaaaugcugcugcuccgaacucuccaggaagcguuugcgauuuacauccgacgggaagaguucaaguucaucuuugaccuacccaagacacuauacgugaugaaacccguggaagaguuccuaccaaacuggaaauccggaauguucgacucccucgucgaacgcgucaagcaaagccccgaccuacagcggugguacguacugugcaaguuccugaacggcaggcuccucaaccaauuauccggaguaaucaggagcuacauccaauucgccggcgacauccagcgccgagccaaggcaaaccacaaccgauuguacauggacaacacucagcgcguugaauacuacucgaacguucuagaggucguggacuucugcauaaaaggcaccucgcgauucagcaaugucuucuccgauuauuucagagacgaagaugcguacgccgacuaucuagacaauuaccugcaauucaaagacgagaaaaucgccgaagucaguuccuucgccgcccuaaaaacuuucuguaacgaagaagaagucaaggcaggaaucuacauggacggcgaaaaccccgucaugcagcgcaacaucgugauggcaaaacuguuuggcccagaugaaguauugaagaacguaguacccaaagucacccgagaggaaauugaggaguauuaccaacuagaaaaacagaucgcccccuaccgccagaacggcuacugcaagucggaagaagaccagaagaaacuacuccgcuuccaacguaucaaaaaccguguagaguuccaaacaauaacggaguucuccgaaauaaucaacgaacugcucgggcaacucaucucuuggucuuuccugcgagaaagggaccugcuguacuuccagcucgguuuucacuacuuaugccuacacaacgacaccgaaaaacccgcagaauacaaagagaucucacgcgaagauggcaccguaauacguaacgcaauacuccaccaaguggccgccauguacgucggcggacuaccuguauauaccuuagcagauaagaagcucgcugccuucgagaagggcgaagcagacugcaaacuaagcaucucaaaggacacagccggcgccggcaaaaagauuaaagacuucuucagauacaguaaauacguacuuauaaaagaccguaugcuuacagaucagaaccaaaaauauacaaucuaccuggccggguuggaacucuucgagaauacugacgaacacgacaacauuaccgacguacgaaaauacguugaccacuucaaauacuacgcaaccucagacgagaacgcaaugagcauacuggaucuguacuccgaaauccacgaccgauucuucacguacgacaugaaauaccagaaaaacgucgcaaacaugcucgagaacauccuccugcgacacuucguacucauccgccccgaguucuucacaggaagcaagaaagugggagaaggcaagaaaauaaccugcaaagcccgugcacaaauagaaaucgcagaaaauggaaugcggagcgaagacuucacuuacaaacucagcgacgggaagaaaaacauaagcacgugcaugaucgccgcgagagaucaaaaauaccucaauacuguggcacggcugcucuacuacccacacgaggccaagaaaagcaucguggacacucgcgagaagaaaaacaacaagaaaacgaaccgaggggacgggacuuucaacaaacaaaaaggaaccgcccgcaaagaaaaagacaaugggccgcgagaguucaacgacaccggauuuagcaacacaccauucgcgggcuucgaccccuuccgaaacagcuga

SEQ ID NO: 11628 - RNA, 4035 nt, Artificial Sequence
  Cas13a variant__Eubacterium rectale__CVRQ01000008.1__Cas13a
augcugcgccgagacaaggaagucaaaaagcuguacaacguauucaaucaaauccaaguaggcaccaaaccaaagaaguggaacaacgacgagaaacuaagcccggaagaaaacgagcgccgcgcccaacagaaaaauauaaaaaugaaaaacuacaaauggagagaagccuguagcaaguauguggaaucaucacaacggaucauuaacgauguaaucuucuacuccuacagaaaagccaagaacaaacuacgauacaugcgcaaaaacgaggacauccucaagaaaaugcaagaagccgagaaacucagcaaauuuagcgguggcaaacucgaagacuucgucgcauacacccugagaaaaucacuggugguauccaaauacgacacgcaagaguucgauucgcuagcggccauggucguuuuccuggaaugcaucgggaaaaacaauauaagcgaccaugagcgcgaaaucgucugcaaacucuuggaacugauccggaaagauuucuccaagcucgaccccaacguuaaaggaagccaaggcgccaacauagugcgcuccgugcgaaaccaaaauaugaucguccagccgcaaggcgauagguucuuauucccgcagguauacgcaaaagaaaacgagacagugacaaacaaaaacguugaaaaagagggacucaacgaguuccugcucaacuacgcaaaccuagaugacgaaaaacgcgcugaaagccugaggaagcuacgucggauccuggacgucuacuucucugcgccuaaccacuacgaaaaggacauggacaucacgcuaucagacaacaucgaaaaggagaaguucaaugugugggaaaaacaugagugcggcaagaaagaaacaggccucuucguagacauacccgacgugcucauggaggccgaagcggagaacaucaaacucgacgccguugucgagaaaagagaaagaaaaguccucaacgacagaguacgaaaacaaaacaucauaugcuaccgcuacacuagggccguggucgaaaaauacaacucuaacgagccacucuucuucgaaaacaacgcaauaaaccaauacuggauucaccacaucgaaaacgccguagagcgcauacucaagaacugcaaagcgggaaaacucuucaaacuacggaaaggcuaucuagcggaaaaggucuggaaagacgccauaaaccucauaagcaucaaguauauagcccuaggcaaggcaguguacaacuucgcccuagacgacauauggaaggacaagaagaacaaagaacugggaaucgucgacgagcggauuagaaacggaauaaccucguucgauuacgagaugaucaaagcgcacgagaaccuacagcgagaacucgccguggacaucgccuuuagcgucaacaaccuagccagagccgugugcgacaugagcaaccucggcaacaaggaaucggacuuccuacucuggaaacgcaacgauauagcggacaaacugaaaaacaaagacgacauggccagcguaucggcaguacuccaauucuuuggaggcaagaguagcugggauauaaacauauucaaggacgccuacaaggggaagaagaaauacaauuacgagguccgguucauagacgaccuacgcaaagcgauauacugugcacgaaaugaaaacuuccauuucaagaccgcccucgugaacgacgagaaauggaacacagaacuuuucggcaaaaucuucgaaagggaaacggaauuuugccuuaauguagaaaaagacagguucuacucgaauaaccuguacauguuuuaccaagucucggagcuccggaacaugcucgaucaccuauacucacgcucgguaucacgcgcagcacagguaccuagcuacaacucgguaaucguucgaacugcauucccggaguauauuaccaacguguuaggauaccagaagcccuccuacgacgcagacacccucggcaaaugguacagcgcauguuacuaccuccuaaaggagaucuacuacaacagcuuccuacaaagugaccgcgcccugcaacucuucgaaaagagcgucaagacccucucgugggacgacaagaaacaacagcgggcuguggacaacuucaaagaucauuuuuccgacauaaaaagcgccugcaccagucucgcccaggucugccagauauacaugacugaauacaaccagcagaacaaccagauaaagaaaguacgcagcagcaacgacaguaucuucgaccaacccguauaccaacacuauaaagugcugcucaagaaagcaauagccaacgcuuuugcagacuaccugaaaaacaacaaagaccucuucggauucaucgggaaaccauucaaggcgaaugagauccgagagauagacaaagagcaguuccugcccgacuggacgagccggaaguacgaagcgcucugcaucgaagucagcggaucccaggagcuacaaaaaugguacaucguuggaaaguuucucaacgcacggucccuaaaccugaugguagguucgaugagaagcuacauacaguacgucaccgacaucaagcggcgggccgcgagcauagggaacgaacugcacguaaguguacacgauguagaaaagguagaaaaguggguccaagucauagaggucuguucccugcucgccagccgcacguccaaccaguucgaagacuacuucaacgacaaagacgacuacgcgagauaccuaaaaagcuacgucgacuucucaaacguggacaugcccucagaauauuccgcucucgucgacuuuagcaacgaagaacaaucugaccucuacguugacccgaaaaacccaaaaguaaaccgaaauaucguacacucaaagcuauucgccgccgaccacauccuuagagacaucgucgagccagugagcaaagacaacauugaagaguucuauagccagaaagcugagaucgcauacugcaaaauuaagggcaaagaaaucacugcggaggaacaaaaagcaguacugaaauaccagaaacucaaaaacagaguugaacuacgggacaucguagaauacggcgaaauaauaaacgaacuacucggacaacuuauaaacugguccuucaugagagagcgcgaucuccucuacuuccaguugggcuuccacuacgacugccuacgaaacgacucgaagaagccagaaggcuacaaaaacaucaaaguggacgagaauagcauaaaagacgcgauacuguaccaaauaaucgggauguacguaaacgggguaacaguauacgcaccugagaaagacggcgacaaacucaaggagcaaugcgucaagggaggcguaggcgucaaagugucagccuuccaucgauacuccaaauaccuaggacuuaacgagaagacccucuacaacgcgggccuggaaaucuucgaagugguggccgaacaugaggacauaaucaaucucagaaacggcauugaccacuucaaauacuaccucggagacuacagaucaaugcucuccaucuacagcgaaguauucgacagauucuucacguacgacauaaaauaccagaaaaacguucuaaaccuccuccaaaacauacuccuacgacacaacguaauuguagagccgaucuuggaguccggcuucaagacaauaggcgaacagacaaagccgggcgcgaaacuaagcaucagaagcaucaaaagugauaccuuccaauacaaaguaaaaggcggaacacugauuacggaugccaaagaugaacgauaccucgaaacgauucggaaaauccucuacuacgcggaaaacgaagaagacaaccugaagaaaucaguggucgugacaaacgccgacaaauacgagaaaaauaaggaauccgaugaucagaacaagcaaaaagagaaaaagaacaaagacaacaaaggcaaaaagaacgaagaaacuaaaucagacgcagagaaaaacaacaaugaacgccuaagcuacaaucccuucgccaaccuaaacuuuaaguugagcaacuga

SEQ ID NO: 11629 - RNA, 3858 nt, Artificial Sequence
  Cas13a variant__Herbinix hemicellulosilytica__CRZ35554.1__Cas13a
augaaacuaacgcgccggagaaucagcggaaacucaguagaccagaaaauaacugccgccuucuaccgcgacaugucacaaggccugcucuacuacgacucagaggacaacgauugcaccgacaaagucauagagagcauggauuucgagcgaucuuggcgaggacgcauucucaaaaacggagaggaugacaaaaaccccuucuacauguuugugaaaggucugguaggaagcaacgacaagaucgucugugaaccaauagacgucgauagcgaccccgacaaccuagacauccuaaucaacaagaaccuaacaggcuucgggcgcaaccucaaagccccggacagcaaugacacccuggagaacuugauccgaaaaauccaagccgggaucccagaggaagagguccuaccagaacugaagaaaauuaaagaaaugauacaaaaagacaucguaaauagaaaagaacaauuacugaaauccaucaaaaacaaccgcauacccuucagccucgaaggauccaaacucgucccgagcacgaagaaaaugaaauggcuauucaaacucauagacguacccaacaaaaccuucaacgagaaaaugcucgaaaaguacugggaaauuuaugacuacgacaaacugaaagcaaacaucacgaaccgccucgacaaaaccgacaagaaggcucgcucaaucagccgcgcaguuucagaagaacuacgagaauaccacaaaaaucuacgcaccaacuacaaccgguuuguuaguggggacagacccgcagcagguuuagacaauggcggcucugcaaaguacaacccagacaaagaagaguuccuucuauuccucaaggaagucgaacaauacuucaagaaauacuuccccgucaaaagcaaacacucaaauaaauccaaagacaaaucccuugucgacaaauacaagaacuacugcuccuacaaaguagucaagaaagaaguaaaccgcucaaucaucaaccaguugguugccggacuaauccagcagggcaaacucuuauacuacuucuacuacaacgauacguggcaagaagauuuccuaaacucauacggccucuccuacauccaaguggaggaggccuucaagaaauccgucaugacgagccucagcugggguauaaaccggcucaccagcuucuucauagacgacucaaacacagucaaauucgaugacaucacgacgaagaaagccaaagaggcgauagaaagcaacuacuucaacaaauuacgcacaugcagccgcaugcaagaucacuucaaagaaaaacucgccuucuucuacccggucuacgucaaagacaagaaagacagaccagacgacgauauugaaaaccuaaucgugcuagugaaaaacgcgauagaauccguauccuacuugcgcaacagaacauuccacuucaaagaauccagccuccuggagcuccucaaagaacucgacgacaaaaacucaggccagaacaaaauugacuacaguguggcggccgaguucauaaaacgggacaucgagaaccuauacgacguuuuucgcgagcaaauccguucacugggcauagccgaauacuacaaggcagacaugauauccgacugcuucaagacaugcggccucgaguucgcgcuauacuccccgaagaacagccucaugccggccuucaagaacgucuacaaacgaggagcaaaccucaacaaagccuacauacgagacaaaggccccaaggaaacaggcgaccaagggcaaaacagcuauaaagcauuagaagaauaccgagaacucacuugguacaucgaaguuaagaacaacgaccaaagcuauaacgccuacaaaaaccuacuacagcuuaucuacuaucacgccuuccucccagaggucagggaaaacgaagcccucaucacugacuucauaaaccguaccaaggaguggaaccggaaagagaccgaggagcgacucaacaccaaaaacaacaagaagcacaagaacuucgaugaaaacgacgacaucacaguaaauaccuaccgguacgaaucaaucccagacuaccaaggcgaaagccucgacgacuaccucaagguacuccaacgcaaacaaauggcccgugccaaagaagucaaugagaaagaagaaggcaacaauaacuacauacaguucauacgagauguagucguuugggccuucggugcguaucucgaaaacaaacucaaaaacuacaaaaacgaacugcagccaccccuuucaaaagagaacauaggccucaacgacacccucaaagaacuauuccccgaagagaaagucaaaagccccuucaacaucaagugcagguucuccauaucaacauuuauagacaacaaagggaaaucgacggacaacaccucggccgaggccgucaagaccgauggaaaagaggacgaaaaagauaagaaaaacaucaagcgaaaagaccuccucuguuuuuaccucuuccugcgccuacucgacgagaacgaaaucugcaaacuacaacaccaauucaucaaguaccggugcagccugaaagaaaggcgauucccgggaaaccgcaccaaacucgagaaggaaaccgaacuauuagcagaacucgaagaacuaauggaacucgucagguucacuaugccguccauccccgagauauccgcuaaggccgagagcggguacgacacuaugaucaagaaauacuuuaaagacuuuaucgaaaagaaagucuucaaaaacccaaaaacaucuaaccuguacuaccacuccgacagcaaaacgcccguuacgaggaaauacauggcccuccucaugcgaucagcaccccuccaccucuacaaagacaucuucaaaggauacuaucuuaucacaaagaaggagugcuuggaauacauaaaacuaucgaacaucauuaaagauuaccagaacucccucaacgaacuacacgaacaacuggaaagaaucaaacucaaauccgagaaacaaaacggaaaagacagucuguacuuagacaaaaaggacuucuacaaagucaaagaguacguggagaaccuagagcaaguagccagauauaaacaucuacaacauaaaauaaacuucgaaucccucuaccgaaucuucagaauacacguagauauugccgcccggauggucggauacacccaggacugggaaagagacaugcacuuccuguucaaagcucuaguauacaacggcguccuugaggagaggcguuucgaagccaucuuuaauaacaacgacgacaacaacgacggcagaauugucaagaaaauacaaaacaaccucaacaauaaaaaccgagaauuagucaguaugcuaugcuggaauaagaagcuaaauaaaaacgaguucggcgccaucaucuggaaacgcaacccgaucgcccaccuuaaccacuucacucaaacggaacaaaacuccaaaucgucccucgagucacucauaaacagucuucgcauccuccuagccuacgaccguaaacgccagaacgccguuacuaagacaauaaacgaccuccuccucaacgauuaccacaucagaauaaagugggaaggccgcguugaugagggccaaauauacuuuaacauaaaagagaaagaggacauagaaaaugagccgaucauacaccugaaacaccuccacaaaaaggacugcuacauauacaaaaacuccuacauguucgacaaacaaaaggaguggauaugcaacggcauaaaagaggaaguuuacgacaaaagcauccuaaagugcauuggcaaccucuucaaauucgacuacgaagacaaaaauaaauccucggcaaacccaaaacacacuuaa

SEQ ID NO: 11630 - RNA, 4314 nt, Artificial Sequence
  Cas13a variant__Lachnospiraceae bacterium__WP_022785443.1__Cas13a
augaaaaucucgaaaguucgcgaagaaaaccgaggggcaaagcuaacggucaaugcgaaaacugccguagugucugaaaaccgcucacaggagggcauccuauacaacgaccccucccgauacggaaagucccgcaagaacgacgaagaccgggaccgguacaucgaaagcagacucaaaucaagcggaaaacuauaccgaauauucaacgaggauaaaaacaaaagagaaaccgacgaauugcaaugguuccuguccgaaauugugaagaaaaucaaccgacggaacggauuggugcucuccgacaugcugagcguggacgaucgcgcauucgaaaaggcguucgaaaaguacgcagaacucuccuacaccaaccggagaaacaagguaagcggguccccagcauucgaaaccugcggcguggaugccgccaccgcugaacgacuuaagggaaucaucagcgaaacgaacuucaucaaucgcaucaagaacaacauagacaacaagguaagcgaggacaucauugaccgaaucaucgcgaaguacuugaaaaagagccuaugccgcgaacgagucaaaagaggccucaaaaagcuccucaugaacgccuuugacuuaccauacucagacccugauaucgacguacaacgugacuucauagacuacguucuggaggacuucuaccacgucagagcuaaaucucaagucagccgaucaaucaagaacaugaacaugccgguccagcccgaaggugauggaaaauucgccaucaccgucucgaaaggcggcacggaaagcgggaauaagcgcuccgcggaaaaagaagccuuuaagaaauuccuauccgacuacgcuagccuugacgaacgcguccgugacgacaugcugcgccgcaugaggcgacucgucguccuauacuucuacgggagcgacgacuccaaacuauccgacgucaacgagaaauucgacgucugggaagaccacgccgcaaggcgcguugacaaccgggaguucauaaagcugccacuagaaaacaaacuugcgaacgggaagaccgacaaagacgcagaacggauacguaaaaacacgguaaaggaacuguacagaaaccaaaacauaggguguuaccggcaagccgugaaggccgucgaggaagacaacaacggucgcuacuucgacgacaaaaugcuaaauauguucuucauccaccgaaucgaauacggaguugagaaaaucuaugccaaucuaaaacaggugacggaauuuaaagcccgcaccggcuaccugagcgagaaaauauggaaagaccuaaucaacuacauaucaauuaaauacauagccaugggaaaggcggucuacaacuacgccauggacgaacugaacgccagcgacaagaaagaaaucgaacuaggcaaaaucuccgaagaauaucuauccgggaucucaucauucgacuacgaacugauuaaagcggaagaaaugcuucagcgcgaaaccgcaguguacguggccuucgcagcgcgccaccuguccucacaaaccgucgaacucgacucugaaaauagugacuuccugcuucugaagccaaagggcacgauggauaagaacgacaagaacaaacucgcaucaaacaauauccugaacuuccugaaagacaaggagacccuccgcgacaccauccugcaguacuuuggaggccacagucucuggacagauuuuccauuugauaaauacuuagccgggggaaaggacgacgucgauuuccuaacggaccucaaagacguuauauauagcaugcggaaugacucauuccacuacgccacggaaaaucacaacaacggcaaauggaacaaggaacuaauaagcgcgauguucgagcaugagaccgaacgcaugaccguaguaaugaaagacaaauucuauucaaacaaccuucccauguucuacaaaaacgacgaccucaagaaacuacucaucgaucuauauaaggacaacgucgagagagcaagccaagucccgaguuuuaauaaggucuucguccgcaaaaacuuccccgcucucguaagagacaaggacaaccuaggaaucgaacucgaccucaaggcagacgccgauaaaggcgaaaaugaacugaaauucuacaacgcgcuauauuacauguucaaagaaauauacuacaacgcguuccuaaaugacaagaacgugcgcgagagguuuauaacgaaggcaaccaagguugccgauaacuacgaucggaacaaagaacgcaaccuaaaagaucguauaaaaagcgcaggaagcgacgagaaaaagaaacucagggaacagcugcaaaacuacauagcggaaaacgacuucggacagagaaucaaaaacaucguacaaguaaaccccgacuacacccuggcucagaucugccaacuuauaaugacagaguauaaucaacaaaacaacggaugcaugcagaagaaguccgccgcccguaaagauaucaauaaagacucauaccaacacuacaagaugcuacuacucguuaaccucaggaaagccuuccuggaguucaucaaagaaaacuacgcauucguccugaaaccauauaaacacgaccuaugcgacaaagcggacuuugucccagacuucgccaaguacgucaagccuuaugcaggucugauaagccgcgucgccgggagcuccgagcuacaaaagugguacaucgucagccgauuccucaguccugcccaggccaaccacaugcuaggauucuuacacagcuacaaacaguaugugugggacaucuaccgucgagcgagugaaaccgguacagaaaucaaccauucaaucgccgaagacaaaauugccggggucgauaucaccgacguugacgcaguaaucgaccucuccguaaaacugugcggaaccauaucuagugagaucagcgacuacuucaaagacgacgagguuuacgccgaauacauaagcucauaccuagacuucgaguacgacggcggaaacuacaaagacucgcucaaccgguucugcaauagcgacgccguaaacgaccaaaaagucgcacuauauuacgacggagagcaccccaagcucaacagaaacaucauacugagcaagcucuacggcgagagacgauuucucgagaaaaucaccgaccgagucagccgcucagacauuguugaguacuacaaacucaagaaagaaacaagccaauaccaaacaaaaggaauauucgacuccgaagacgaacaaaagaacaucaagaaauuccaggaaaugaaaaacaucguagaauuuagagaccuaauggacuacuccgagauagccgacgaacuccaagggcaacuaaucaacuggauuuaccuacgcgagcgcgaccucaugaacuuccagcucgguuaucauuacgcaugccucaacaacgacucaaacaaacaagcgacauacgucacccuggacuaccaaggaaagaaaaaccggaagauaaauggcgcgauccuauaccaaauaugcgccauguacaucaacggccuaccgcuguacuacguagacaaagacucaagcgaauggacgguguccgacggaaaagaaucuaccggagcaaaaauaggcgaguucuaccguuacgccaagagcuuugaaaacacaucggacugcuacgcauccggucuagaaauauucgaaaacauaagugaacacgacaacauaacagaauugcgcaacuacaucgaacacuuccgguacuacagcucauucgaucgcagcuuccuggggauauacucagaggucuucgaccgauucuuuacauacgaccugaaguaccgcaaaaacguaccaacaauuuuguacaacauccuccuacaacacuucguaaauguccgcuucgaguucguaagcggcaagaaaaugauaggaaucgacaagaaagacaggaaaaucgccaaagaaaaagagugcgcccgcauaaccauccgggagaaaaacgggguauacagcgaacaguuuaccuacaaacucaaaaacggcacagucuacguagacgccagagacaagagauaccuacagagcaucauacgccuacucuucuaccccgaaaaagucaacauggacgaaaugauugaagucaaggagaagaagaaaccgagcgauaacaacacgggaaaagguuauuccaaacgcgaccgacaacaagaccgaaaggaauacgacaaauacaaggagaagaagaagaaagaaggcaacuuucuguccggcauggguggaaacaucaacugggaugaaauaaacgcacagcugaaaaacuga

SEQ ID NO: 11631 - RNA, 3156 nt, Artificial Sequence
  Cas13a variant__Listeria newyorkensis__WP_036091002.1__Cas13a
augaaaauuaccaaaaugcgcgucgacggucggaccauagucauggaacgcacuagcaaagaaggccaacucggguacgaaggcaucgacgggaacaaaacaaccgaaauaaucuucgacaaaaagaaagaaucauucuacaaauccauacuuaauaaaaccguaagaaagcccgaugagaaagaaaagaaccggcggaagcaagcaaucaacaaagccauaaacaaagaaaucacggaacucaugcucgccguccugcaccaggaaguuccaucgcagaaacuccauaaccuaaaaagccucaacaccgagucgcuuacgaaacuauucaagccaaaguuccaaaacaugaucuccuacccaccaucaaagggugccgagcacgugcaauucugccugaccgacauagcaguaccagcaaucagggaccuagacgaaaucaaacccgacugggguauauucuuugagaaacuaaagcccuacacugacugggccgaaucauacauacacuauaagcagaccaccauccaaaaguccaucgagcaaaacaaaauccaaucaccggacucaccccgaaagcuaguccugcagaaauacgugaccgcguuccuaaauggagaaccccuuggccucgaccuagucgcgaaaaaguacaaacucgcggaccuggcagaauccuucaagcuaguagaccugaacgaggauaaaucggccaacuacaaaaucaaggcaugccugcagcaacaucaacgaaacauccuagacgaacugaaggaggacccugagcuaaaccaauauggcaucgaagucaagaaauacauccaacgauacuucccgaucaaacgagccccgaaccgcagcaaacacgcccgggccgacuuccuaaagaaagagcucauugagagcacggucgaacaacaauucaaaaacgccguguaccacuacgugcucgagcaaggcaaaauggaggccuaugaacuaacagaucccaaaacaaaagaccuccaagauauccgguccggagaggcuuuuagcuucaaauucaucaaugccugcgccuucgccaguaacaaccuaaaaaugauccuaaacccagaaugcgaaaaagacauacucggcaaaggcaacuucaagaaaaaccuccccaacuccaccacccgguccgaugucgucaagaaaaugaucccguucuucagugacgaacuccaaaacgucaauuucgacgaagcaauaugggccauccguggauccauccagcaaauccgaaacgagguauaccacugcaaaaagcacucauggaaaagcauccuaaagaucaagggguuugaguucgagccaaacaacaugaaauacgccgacuccgacaugcaaaagcucauggauaaagacauagcuaaaauacccgaguucaucgaagaaaaguuaaaaucuuccggcgucguccgcuucuaccgacacgacgaacuccaaucaauuugggaaaugaaacaaggguucagccuccuaaccaccaacgccccguucgugcccucauucaaacguguauacgcaaaagggcacgacuaccaaaccuccaaaaaccgcuacuauaaccuggaccucaccaccuucgacauacuggaguacggagaggaggacuuccgagcccgcuacuuccuaacaaaacucguauacuaucaacaauucaugcccugguucacggccgacaacaacgcuuuccgcgacgcagcgaacuucguacuacgccucaacaaaaacagacaacaggacgcgaaagcauucaucaacauccgggaaguagaggaaggggagaugccucgggacuacaugggguacguccagggacaaaucgccauacacgaagacuccaucgaagacacccccaaccacuucgaaaaauucauaagccaaguauuuaucaaaggauucgacaggcacaugagguccgccaaccugaaguucauuaaaaacccacgcaaccaaggacuggaacagagugagauugaagaaaugucauucgacauaaaagucgaaccuagcuuucucaaaaacaaagacgacuacauugcauucuggaucuucugcaaaaugcuagaugcccgccaccuaagcgagcuccgcaacgagaugaucaaauacgacggccaccugacuggugaacaagaaauaaucggccucgcccuccuaggcgucgacagccgcgaaaacgacuggaagcaauucuucuccucagagagggaauacgaaaagauaaugaaaggcuacgucgucgaggagcuauaccaacgggaaccauaucgccaaucugacggaaagacaccaauccuauuccgcggcgucgaacaggcccgaaaauacggaaccgagaccgugauccagcgacucuucgacgcaaaccccgaguucaaagucucaaagugcaaccuagccgaaugggaacgccaaaaagaaacaauagaagaaaccaucaaacggaggaaagaacuacacaacgaaugggccaaaaacccaaagaagccacaaaacaacgcauuuuucaaagaauacaaagaauguugcgacgccauagacgccuacaacuggcacaaaaacaaaacaacccuagccuacguaaacgaacuccaccaccuucuuaucgagauccugggacgcuacgucggauacgucgcaaucgcugaccgcgacuuccaauguauggcgaaccaguacuuuaaacacaguggaaucacugaacgaguagaauacuggggugacaacagacuaaaaagcaucaagaaacucgacaccuuccuaaagaaagaggggcuuuucguauccgagaaaaacgcccgcaaccacaucgcccaccucaacuaccugagccucaaaagcgaaugcacccuacucuaucucucugaacggcuccgggaaaucuucaaauacgaccgaaaacucaaaaacgcagugagcaaaucccucauagacauccucgaccgccacggaaugagugucguguucgccaaccuaaaggaaaauaaacaccggcuagucaucaaaucacucgaacccaagaagcuacggcaccugggcgggaagaaaaucgacggaggguauaucgagaccaaccaagucuccgaagaauauugcgggauaguaaaacggcuacuagagauguga

SEQ ID NO: 11632 - RNA, 3363 nt, Artificial Sequence
  Cas13a variant__Listeria seeligeri__WP_012985477.1__Cas13a
auguggaucuccaucaaaacgcuuauccaccaccuagguguccuguucuucugcgacuacauguacaacagacgcgagaagaagauuaucgaaguuaaaacgaugcgaaucacaaaggucgaagucgaucgcaagaaaguguuaauaagcagagacaaaaacggcggaaaacugguguacgaaaacgagaugcaagacaacaccgaacagauaaugcaccacaagaaauccaguuucuacaaaucagucguaaacaaaacaaucugccgcccagagcagaaacaaaugaagaaacucguccacggcuuacugcaagaaaacagccaggagaaaaucaaaguaucagacguuaccaaacucaacaucucaaacuuccuaaaccacagauucaagaaaagccuuuacuauuucccggagaacucgccagacaaauccgaggaauaccgcaucgaaauaaaccuaucacaacuccuagaggacucccugaagaaacaacagggcaccuucaucugcugggagagcuucuccaaagacauggaacuuuacaucaacugggccgagaacuacauaucaucaaaaaccaaacucauaaagaaaucuauucggaacaaccgcauucaguccacggaaucccguagcggacaacucauggaccgcuacaugaaagacauucucaacaaaaauaaacccuucgauauucaguccgucagcgaaaaauaccaacuagaaaaacucaccagcgcacugaaagccaccuucaaagaagccaagaaaaaugacaaagaaaucaacuauaaacucaaguccaccuuacaaaaccacgaacgacaaauaaucgaggaacuaaaggaaaacagcgagcucaaccaauucaacauugaaaucagaaagcaccucgaaaccuacuucccaauaaagaaaaccaaccgaaaagucggcgacauacgaaaccuagaaauaggcgaaauccagaaaauagucaaccaucgacucaaaaacaaaauuguacaacggauccuucaagagggcaaacuagccuccuacgagauagagagcaccgucaacuccaacucccuccagaaaaucaaaaucgaggaggccuuugcgcugaaauucaucaacgccugccucuucgccucaaacaacuuacgaaacauggucuacccggucugcaagaaagacauucugaugaucggugaguucaaaaacagcuuuaaggaaaucaaacacaagaaauucaucagacaguggucgcaauucuucagccaggaaaucacgguagacgacauagaacucgccucauggggccugagaggcgcgaucgcgccuauccggaacgaaaucauccaccugaagaaacacagcuggaagaaauucuucaacaaccccacguucaaagucaagaaaucaaaaauaaucaacggaaaaaccaaggacguaacuagcgaguucuuauacaaggaaacacucuucaaagacuacuucuauagcgagcucgacuccguaccagaguuaauaaucaacaaaauggaguccagcaaaauacuagacuacuacagcagcgaccagcuuaaccaggucuucacaauaccgaacuucgaacuuucucugcuaaccuccgcuguccccuucgcaccaucauucaaacgcguauaccuaaaaggcuucgacuaccaaaaucaagacgaggcgcaaccggauuacaaccucaagcuaaacaucuacaacgagaaagcauucaacuccgaggccuuccaagcccaguacucccuguucaaaauggucuacuaucaagucuuccucccucaguucaccaccaacaacgaccucuucaaaucaucaguggacuucauucugacccucaacaaagagcggaaaggcuacgccaaagcauuccaagacauucgcaagaugaacaaagacgaaaagccaucggaauauaugucauauauucaaagccaacucaugcuuuaccagaagaaacaagaagagaaagagaaaauaaaccacuucgaaaaauuuauaaaccagguauuuaucaagggauuuaacagcuucauagagaaaaaccgccuaacguacaucugccacccaaccaaaaacacuguccccgaaaacgacaauaucgaaauccccuuucacacagacauggacgauucaaacauagccuucuggcuaaugugcaaacuucucgacgccaaacaguugucggaacuacgaaacgagaugauaaaguucuccugcucccuccaaucuacggaagaaaucagcaccuucacgaaagcccgcgaagucaucggcuuggcucuuuuaaauggugaaaagggaugcaacgacuggaaagaacucuucgacgacaaagaagcguggaagaaaaacauguccuuauacgugucggaggaacuccuacaaucccuccccuacacucaagaagacggccagacaccagugauuaaccguucaauugaccucgucaagaaauacggaacggagaccauacuggaaaaacuauucagcuccuccgacgacuacaaaguuucagccaaagauaucgccaaacuccacgaauacgacgucaccgagaaaauagcccagcaagaguccuuacacaaacaauggaucgaaaagcccggguuagcccgcgacuccgccuggaccaagaaauaccaaaacgucaucaacgacauaucgaacuaccaaugggcaaagacaaaggucgaacugacacaaguccgccaccuccaucaauuaaccaucgaccuccugucccgauuagccggcuacauguccaucgcagacagggacuuccaguucagcuccaacuacauccucgagcgagaaaacuccgaauaccgaguaacaaguuggauccuacugucagagaauaaaaacaaaaacaaauacaacgauuacgaacuauacaaucuuaaaaacgccagcaucaaggucagcucgaaaaaugacccccagcugaaagucgaccucaaacaacuacgccucacccuugaauaucuagaguuauucgacaaccgacucaaagaaaaacgcaauaacaucagccauuucaacuaccucaacggccaacucggcaacucuauccucgaacucuucgacgacgccagagacguauugucauacgaccgcaaacuaaagaacgcuguaagcaaaagccucaaagaaauucucaguagccacggaauggaagucaccuucaaaccccuauaccagacgaaccaccaccuuaaaaucgauaagcuccagccgaaaaagauacaccaccucggggagaaauccacgguaucaucaaaccaagugagcaacgaauacugccaacucguacgcacacuacucaccaugaaauga

SEQ ID NO: 11633 - RNA, 3465 nt, Artificial Sequence
  Cas13a variant__Paludibacter propionicigenes__WP_013443710.1__Cas13a
augcgugucuccaaagucaagguaaaagaugggggaaaggacaagaugguacucguccaccgaaagacgaccggcgcacaauugguuuacagcggccaaccugucagcaacgaaacauccaacauucuccccgaaaagaaacgacaauccuucgaccuaucgacccucaauaagaccauuaucaaauucgacacggccaagaaacaaaaacucaacgucgaccaauacaaaauaguagagaaaaucuucaaguaccccaaacaagagcuuccaaaacagaucaaggcugaggagauucugcccuuccucaaccacaaauuccaagaaccugucaaguauuggaaaaacggcaaagaagaaucauucaacuuaacacuccuaaucguagaggccgugcaagcccaagacaaacgaaaacuucagcccuauuacgacuggaaaacaugguacauacagaccaaaagcgacuuacucaagaaaagcauugaaaacaaccgcauagaccuuacugaaaaccucuccaagcgaaagaaagcacuccucgcuugggagacugaguucacggcgucgggauccaucgacuuaacccauuaccacaaaguauacaugaccgauguccucuguaaaaugcuucaagaugucaaacccuuaaccgacgacaaaggcaaaaucaacacaaacgccuaccaccgaggucuaaagaaagcccuccaaaaccaccaacccgccaucuuuggaacccgcgaaguacccaacgaagcuaaccgggcugacaaccaacuaucaaucuaucaccuugaggucgucaaauaucuagagcauuacuucccaauaaaaaccucaaaacgaagaaacaccgcggacgacauagcccacuaccucaaagcgcaaacgcugaaaacaaccaucgaaaagcaacucguaaaugccauacgggccaacauuauacaacaaggcaaaacgaaccaccacgaacucaaagcggauaccaccagcaacgaucuaaucaggauaaaaacaaacgaagccuucguucucaaccuaaccggaaccugcgcauucgcugccaacaacauacgcaacaugguggacaacgaacaaacaaaugacauccucggcaaaggcgacuucaucaagucccucuuaaaagacaacaccaacucccaacucuauuccuuuuucuucggagaaggauuauccaccaacaaagcggagaaagagacacaacucuggggcaucagaggcgcuguacagcagauccgaaauaacguaaaccacuacaagaaagacgcucucaaaacugucuucaacauaucgaacuucgagaaucccaccaucacggacccaaaacaacaaaccaauuacgcagacaccauauacaaagcucgauucaucaacgaacuugagaaaauccccgaggcuuuugcccaacaacucaagacgggcggcgcaguauccuacuauacgauagaaaaccucaaaucccuccuuaccacauuccaguucucucucugucggagcacgauacccuucgccccaggcuucaagaaagucuucaacggcggaaucaacuaccaaaacgccaaacaagacgagagcuucuaugagcuuaugcuagaacaauaccuucgaaaagagaacuucgccgaagaauccuacaacgcgcgcuacuucaugcucaaacucaucuacaacaaccucuuccugccuggguucacuacagaccgcaaagcauucgcagacagcgugggcuucguccagaugcagaauaaaaagcaagcggagaaagugaacccccgcaagaaagaggcguacgccuucgaggccguucgacccaugacggcugcggacucgaucgccgacuauauggcguacguccaaucagaacuaaugcaagaacaaaacaagaaagaggaaaaaguugcagaagagacccgaauaaacuucgaaaaauucguccuccaggucuucaucaaaggauucgacagcuuccuacgcgcaaaagaguucgacuuuguccaaaugccgcaaccccagcucacagccacggcaaguaaccagcaaaaagccgacaaacucaaccaacuggaggccagcauaaccgcugacuguaaacuaacaccacaauaugcaaaggcggacgacgcgacccauauagccuucuacguauucugcaaacuccucgacgcggcacaccucucgaacuugcgcaacgaauuaauaaaauuccgagaaucggucaacgaguucaaauuccaccaucugcucgaaaucauagaaaucugccuacucagugccgacgucgucccgaccgacuaccgcgaccuuuacuccuccgaagccgacugcuuagcccggcuccgcccauucaucgaacaaggggccgacaucaccaacuggagcgaccuauucguacaaagcgacaaacacucacccgucauucacgcaaacaucgaacucagcguuaaauauggaaccacaaaacugcucgaacagaucaucaacaaagacacacaauucaagacgacagaagcuaacuucacagccuggaacaccgcacaaaaaucgaucgaacaacuaaucaaacaacgugaagaccaccacgaacaaugggucaaagccaagaacgccgacgacaaggagaaacaggaacgcaaacgggaaaagagcaacuucgcacagaaguucaucgagaaacacggagacgauuaccuugacaucugcgacuacauaaauacauacaacuggcucgacaacaaaaugcacuucguccacuuaaaccgacuccacggccuaaccaucgaacugcucggccgaauggcgggcuucguagcgcuguucgacagggacuuccaauucuucgacgaacagcagaucgccgaugaguucaaacuccacgguuuuguaaaccuccacucuauugacaagaaacucaacgaaguccccaccaagaaaauuaaagaaaucuacgacauccggaacaaaauaauccaaaucaacgggaacaaaaucaacgaaagcguacgugcgaaccucauccaguucaucucaucaaaacgcaacuacuauaacaaugcauuccuccacgucagcaacgacgaaaucaaggagaagcaaauguacgacauccgcaaccacaucgcccauuucaacuaccugaccaaggacgcagcagacuucagccuaaucgaccucauaaacgaacuucgggaacuccuucacuacgaccgcaaacugaaaaacgccguaagcaaagcauucauugacuuguucgacaaacacggaaugauucucaaacucaaacugaacgcugaccacaaguugaaaguugaaagucucgaacccaagaaaaucuaccaccucgggagcagcgcaaaggacaaaccagaguaccaauacugcaccaaucaggucaugauggcauacugcaacaugugccgcagucuacucgaaaugaaaaaguga

SEQ ID NO: 11634 - RNA, 3858 nt, Artificial Sequence
  Cas13a variant__Rhodobacter capsulatus__ETD76934.1__Cas13a
augcagaucgguaagguacaaggacgaacgaucagugaguucggagacccggccggaggacuaaaacgaaaaauuagcacagacgggaagaacagaaaagagcucccugcacaccucagcagcgaccccaaggcauugauagggcaauggaucagcggcaucgacaaaaucuaccguaaacccgacagcaggaaaucagacggaaaagccauacacucgccaaccccgaguaaaaugcaauucgaugcaagagacgaccucggagaagcguucuggaaacugguaagcgaggcaggccuagcucaagacagugauuacgaucaauucaaaagaaggcuucaucccuauggcgauaaauuccagccggccgacagcggagcaaagcuaaaguucgaagccgauccacccgagccccaggcauuccacggcagaugguacggcgcgaugagcaaacgagggaacgacgcaaaggaacucgcagccgcccuguaugaacaccuacacgucgaugaaaaacgaaucgacgggcagccgaagcgaaaucccaaaacagacaaguucgcacccggccuggucgucgcgcgagcgcugggaauugaaucaucagucuuaccuagaggcauggcacgccucgccagaaacuggggagaggaagaaauacaaaccuacuucgucguagacguggcggcaagcgugaaagaagucgccaaagcggccguaagugcagcacaagcauucgacccgccacgacaagugucugggaggucacugagccccaaagucggcuucgcacuagcagaacaccuugaaaggguaacaggcucuaaacggugcagcuucgacccagcggccggaccuucaguccuggcacuccacgacgaaguuaagaaaaccuauaaacgacucugcgcaaggggcaagaacgcagcaagagcauucccagccgacaaaaccgaauuacuggcacuuaugaggcacacgcacgaaaaccguguacguaaccaaaugguacgaaugggacgaguaagcgaauaccgaggacaacaagcgggcgaccucgcacaaucccauuacuggacaagcgcaggacaaacagaaaucaaagagagcgaaauauucguacgacuaugggucggcgcauuugcgcuagcaggcagguccaugaaagccuggaucgacccaaugggaaaaauagucaacacggagaagaacgaccgagaucuaacagcggcugucaacauacgacaggugauaucaaacaaggagaugguugcugaagcaauggcgagacgcggcauauacuuuggagaaacccccgaacuagaccgccucggugccgaaggaaacgaaggguucguauucgcacugcucagauaccuaagaggaugcagaaaccagacauuccaccucggagcccgagcaggauuccucaaagaaauuaggaaagaacuggagaaaacacgcuggggcaaggcaaaagaagccgaacacgucgugcuuaccgauaagaccguagcagccauaagagcaauaauagauaacgaugcaaaggcccugggcgcacgauuacucgcagaccuguccggcgcauucgucgcacacuacgcgagcaaggaacacuucaguacacucuacagcgaaaucgucaaagccgucaaggacgccccggaagugucuagcggacucccccgacuuaagcuccuacugaaacgcgcagacggcguacgagguuacguccaugggcugagggauacaagaaagcacgcauucgcuaccaaauuacccccaccgccagccccgagagaacucgacgacccggccaccaaagcucguuacauagcgcuacuaagacucuacgacggccccuuucgugccuacgcauccggcauuacgggcacagcacucgcaggucccgcagcacgagcaaaagaggccgcaacugcccuagcccaaucggugaacgucacgaaagcauacagcgacgucauggaaggccggagcagccgacuaagacccccgaacgacggcgaaacucuaagagaauaccucagcgcacucacaggcgaaaccgcaacagaauuucgaguccagaucggguacgagucggacucugaaaacgcacggaaacaagcugaguucaucgaaaacuaccgacgagauaugcucgcguucauguucgaagacuacaucagagccaaaggcuucgauuggauacuaaaaauagagccaggagcgacagcuaugaccagagcacccgugcuacccgaacccaucgacacuaggggccaguaugagcauuggcaagcagcauuauaccucguaaugcacuuuguaccggccucagacguaucuaaccugcuacaccaacuccgcaaaugggaggcucuacaagggaaauacgagcucguacaagacggcgaugcaacagaucaggccgacgcacggagagaagcccuugaccuagucaaacgauuucgugauguccuuguccuauuccuaaagacaggcgaagcacgcuucgaaggcagagcagccccauucgaccuaaaacccuuucgagcccuauucgccaacccugcgacauuugaccgccucuucauggcgacaccaacaaccgcaagaccggcagaagacgaccccgaaggagauggagcgagugagccagaacuacgaguagcccgcaccuugcgagggcuaaggcaaaucgccagguacaaccauauggccgugcuaucggaccuauucgcgaaacacaaaguacgagaugaagaaguagcacgccuagccgaaaucgaagacgaaacccaagaaaaaucacaaauagucgccgcacaggaacucagaaccgaccugcacgacaaaguaaugaaaugccacccaaagaccaucucuccggaagaaagacaaagcuaugccgcagcgauuaaaacaauagaagaacacagauuccuugucgguagaguauaccucggcgaccaccuccgacugcacagacucaugauggacgucauaggccgacuuauagacuacgcaggagcguacgaaagagauacagggacguuccugaucaacgcgucgaaacagcugggggcgggcgcagacugggcaguaacaaucgcaggagccgcaaacacagacgcgagaacccaaaccaggaaagaccucgcccacuucaacguacucgacagagcagacgguacacccgaccuuacagcacugguaaaccgugcacgagaaaugauggcauaugaccgaaagcggaaaaacgcaguacccagaagcauccuagacauguuggcacgacuaggccuaacccugaaauggcaaaugaaagaccacuuacuacaagacgccacaaucacccaagcggcaaucaaacaccuagacaaggucaggcucacagugggagggccagccgcagugaccgaagcacgguucucacaagacuaccuucaaauggucgcugccgucuucaacggguccguacagaacccaaaaccaagaagacgagaugacggggacgccuggcauaaaccaccaaaaccagcaaccgcacagagccaaccagaccaaaaaccacccaacaaagcgcccagcgccgguucacgucuacccccaccccaaguaggcgagguauacgaaggcguaguagugaaagucaucgacacaggcucacucggauuccucgcaguagaagguguugccggaaacauagggcuacauauaucccgauuaagacgaaucagggaagacgccauaauaguaggccgacgcuacagauuccgcguagaaauauacgugcccccaaagaguaacaccagcaaacuaaacgccgccgaccugguacgcauagacuaa

SEQ ID NO: 11635 - RNA, 1578 nt, Artificial Sequence
  Cas13a variant__Corynebacterium ulcerans__WP_038617242.1__Cas13
augcccaaauauugccucaccgcaagauucccccucggcgucuaccucggccacacaggcgacgcaaacagagacgcuuacccagaccccgcccgccuccacgcggcccucaugaacgcagcagcccaaggcguccacgccgaagaagaccccaacgaacaccaacuacgacccucccagcaaucgcuacaagcacuacaauggcucgaagcccacccacccacaggacucgccaugcccgaacaacaauggcucucccccgacaccucccgcaugauguacagaaacguaggauccgucaaaauagacaaaaccggcgucacccgcgcuaccgaaaaccgagccgucucagacggcgucagcguaaacggagccuacggcuacaucugggacgagaugcccguagacauagccgaagccauaacagcccuccuccccgacgucgcaugccucggagaagccuccucucucgucguccucgaacaacaagaaaucgaagccacccucacacuagacccccaggcaaccgccuucucaacagagagaguacaaguacgaauugcacuccccggccggacacaacaccuucgcgaagucuuccacgcccgguacggcaagaaacccccaucuaagaaagccgauaaauuucucaaagacgacccaauacacgacccacccaucccgaaagaccaccuaggcaccgcccgauaccuacgagucaaugccgcagacaaagagugcgucacccccuggacaaaagucauacuuuuagaaguacacggaaaacaacuaggugcaaaagaacaaguccgugcagccgucgcacuccaccgcgcacuaaucgcccgcauacgcaccgacguauccccugucauaaccggccgcuacgcugcaggcgcacaacgccccgcaaacaaccuagccauccaauacaucccucaccgacaccucgaagcccuaggccugaaaaccucagcauucgcacuacucguuccccaagacgcagacuccacagucuacgaacaacucaaccaagcccucacaggaccauucccacuaagaucaggcggcaaacuacucugucaacucaaauacaacggccacgucuuucgcggcgacgcauucuggcccgcaccacaaccagguaccauacgcaugugggagccacuuaacguauucauccccgaaucaagaccccacaacaaacaacaaggcguccuauggcgccucgcagacgccggccuacucuccguagccuucgucuggcgcgacaacuuccccaccaaagagaccggacccgcaagauaugucgaacuccgagacgccgccuacaacgccgacguacgcauuuuccacgaccaccccguaucccguaacacgcgacgcuucguacaccgaaccaaccgcucucuaacaauccagcccuggagaggccuaguccaccucggaucccuccaacaagaucgcgcaauaauagcgcucggccaauccagacacuuaggcggaggccuucucauccccgucgacaucccucgaucagaguucgaaaccaugaccuccgaaaugacccacgccuaa

SEQ ID NO: 11636 - RNA, 3675 nt, Artificial Sequence
  Cas13b variant__Bergeyella zoohelcum__WP_002664492.1__Cas13b
auggaaaauaagacuagccugggcaacaacauauacuacaacccauucaaaccccaagacaaaagcuacuucgcaggcuacuuuaacgcugcgauggagaacacggacucggucuuccgcgaacuaggcaaacgcuugaaagguaaagaauauaccucagagaacuucuuugacgccauauucaaagaaaacaucagccucguggaguacgaacgcuacgucaagcuccuguccgacuacuucccaauggcccggcuccuagacaagaaagagguccccauaaaagagaggaaggaaaauuucaagaaaaacuucaaaggaaucaucaaagcagugcgagaccugcgaaacuucuacacacauaaagaacacggcgaggucgagaucaccgacgagaucuucggcgugcucgacgaaaugcuaaaaucaacgguacucacggucaagaaaaagaaaguaaaaacagacaagacgaaggaaauccuaaagaaaagcaucgagaaacaacuagacauacugugccagaagaaacucgaguaccuccgcgauacagcacgcaaaaucgaggaaaaacggcggaaccagcgggaaagaggagaaaaagagcucgucgccccguuuaaguacagcgacaaacgagacgaccuaauagcggccauuuacaacgacgcauucgacguauacauagacaagaagaaagacucccugaaggaaagcucaaaggccaaauacaauaccaagagcgacccgcagcaggaagaaggcgaucucaaaauacccaucucuaaaaacggagucgucuuccugcugucacuuuuccucacgaaacaggagauacacgccuucaaaucaaaaaucgccggcuucaaagcaaccgucaucgacgaagcgacaguaagcgaggcaacagucucccacgggaaaaacuccaucugcuucauggccacacacgagauuuucagccaccuagcauacaagaagcugaaacggaaaguacgcacagccgagaucaacuacggagaggccgaaaacgccgagcaauuauccgucuacgcaaaagaaacacucaugaugcagaugcucgacgaacucuccaaaguacccgauguaguauaccaaaaccuuucugaggacguacaaaagacauucaucgaagacuggaacgaauaccucaaagagaacaacggagacgugggaaccauggaggaagaacaggucauccaccccgucauccggaagcgguacgaagacaaguucaacuauuucgcaauccgauuccuggacgaguucgcacaauucccuacacuacgcuuccaagugcaccucggcaacuaucuccacgacucccgaccgaaggaaaaccuaaucagcgaccgaaggaucaaagagaaaaucacaguguucggccggcucuccgaacucgaacacaagaaagcccuauuuaucaaaaacacagaaacaaacgaagaccgugagcacuacugggaaauauuccccaacccuaacuacgacuucccgaaagaaaacaucagcguaaacgacaaagacuucccaaucgcaggcucgauccuagaccgagagaagcaacccguggcaggaaagauaggaaucaaggucaaacuucucaaccaacaguacgugagcgaagucgacaaagcagucaaagcacaccaacucaaacagcgcaaagcuagcaaacccaguauccaaaacauaaucgaggagaucgucccaaucaacgaaagcaaccccaaggaagccauaguuuucgggggccagcccacagcguaccucucaaugaacgauauacacuccauccuguacgaguucuucgacaagugggagaaaaagaaagagaaacuagaaaagaaaggugagaaagaacuacgcaaggagaucggcaaggagcuggaaaagaaaaucgucggcaaaauacaagcacaaauccaacaaaucaucgacaaagacacgaacgcgaagauccucaagcccuaccaagacggcaacuccacagcaaucgacaaggaaaaacugauaaaagaccuaaaacaggaacagaauauacuccaaaagcuaaaagacgagcaaacaguuagagagaaagaauacaacgacuucauagcauaccaggacaagaaccgcgaaaucaauaaaguccgugaccgcaaccacaaacaguaccugaaggacaaccucaaacgcaaauacccagaagcccccgcucgcaaggagguccuguacuacagggaaaagggcaaagucgcagucugguuagccaaugacaucaagcgcuucaugcccacagacuucaaaaacgaguggaaaggcgagcaacacagucuccugcaaaagucauuggcguacuacgagcagugcaaagaggaacucaaaaaccuacuccccgaaaaaguauuucaacaccuuccauuuaaacuaggaggguacuuccaacaaaaguaccuauaccaguucuacacaugcuaccucgacaaaaggcuagaguacaucucgggccuagugcagcaggcagaaaacuuuaagucagaaaacaaggucuucaaaaagguggaaaaugagugcuucaaguuccuaaagaaacaaaacuacacccacaaagaacucgacgcacgcguacagagcauacuaggauaccccaucuuucuagagcggggauucauggacgagaaacccaccauaauaaaagggaaaacguucaaaggcaacgaagcucuuuucgccgacugguucagauauuacaaagaauaccaaaacuuccaaacauucuacgacacagaaaauuacccgcuggucgaguuagagaaaaagcaggcagaccggaagagaaagaccaagaucuaccagcagaagaaaaacgacguauucacccugcuuauggccaaacacaucuucaagagugucuuuaaacaggacuccaucgaccaguucucccuagaagaucucuaccagagcagagaagaacgccucggaaaccaagaacgagcccgccagacaggagaacgcaacaccaacuacaucuggaacaagacggucgaccucaaauuaugcgacggaaaaaucaccguagaaaacgugaaacuuaaaaacgugggcgacuuuauaaaauacgaauacgaccaaaggguccaagcguuccuaaaguacgaagaaaauauugaguggcaagcauuccucaucaaggaaucgaaagaagaagagaacuaccccuacguagucgaacgggagaucgagcaauaugaaaaagugcgccgggaagaacuacugaaggaagugcacuuaauagaagaauacauacuagaaaagguaaaagacaaggaaauccucaaaaagggcgacaaccaaaacuucaaguacuacauucuaaacggucuccucaagcaacugaaaaacgaagacgucgaaagcuacaagguauucaacuugaacaccgaacccgaggacgucaauauaaaccagcucaaacaggaagcaacggaccucgagcaaaaggcuuucguccucacauacauaagaaacaaauucgcccacaaccaacuacccaagaaagaauuuugggacuacugccaagaaaaguacgggaaaauagaaaaggagaaaacauacgcggaauacuucgccgagguguuuaagaaagagaaagaagcacucauaaaauaa

SEQ ID NO: 11637 - RNA, 3675 nt, Artificial Sequence
  Cas13b variant__Bergeyella zoohelcum__WP_002664492.1 modified__Cas13b(R116A,H121A,R1177A,H1182A)
auggaaaacaagacaucccucggcaauaacaucuacuacaacccauucaaaccccaggacaagucguauuucgcgggcuacuucaacgcggccauggaaaacacagacaguguauuccgggaacucggaaaacggcucaaggggaaagaauacaccuccgagaacuucuucgaugcaaucuuuaaagaaaacauaucccuaguagaguacgagcgcuacguaaaauuacucagcgacuacuuccccauggcgcggcuccucgacaaaaaggaagucccaaucaaagagcgaaaggaaaacuucaagaagaacuucaaagggauaauaaaggcggucagggaccucgcaaacuucuacaccgcgaaggaacacggcgaagucgagauaacagacgaaaucuucggcguccuggacgaaauguugaaaagcaccguacugacaguaaagaaaaagaaagugaaaaccgacaagacaaaagaaauccucaaaaagagcauagaaaaacagcuagacauccuaugccaaaagaagcuagaguaccugagagauaccgcacguaaaaucgaagagaagaggcggaaucagcgagaacgcggcgagaaggagcuaguagcgccauucaaauacagugauaaaagggaugaucugaucgccgccaucuacaacgaugcauucgaugucuacaucgacaagaagaaagacucauugaaagaaagcagcaaagcaaaguacaacacgaaaucagacccacaacaggaagagggggaccucaaaauaccgauauccaaaaauggagucgucuuccugcucucacucuuccucaccaagcaagagauacacgcguucaagucaaagauagccggcuucaaggccaccgugaucgaugaagcgacaguaagcgaagcgacggucucccacggcaagaacagcauaugcuuuauggcgacacacgaaauauucucccaccuggcguacaagaaacucaaaagaaaaguccgcacggcggagaucaacuauggggaggccgaaaacgccgaacaacucuccgucuacgcaaaagaaacgcuaaugaugcaaaugcuagacgagcuguccaaagucccagacguaguguaucaaaaccuaagcgaagacguacagaaaacauucaucgaagauuggaaugaguaccuaaaagaaaacaacggagauguuggcacaauggaggaagaacaagugauccacccgguuauacggaaacgguaugaagauaaauucaacuacuucgccauccgcuucuuggacgaguucgcgcaauucccuacacucagauuccaaguccaccuagggaauuaccuacacgacagccgacccaaggagaaucuaauaucggaccggcgaauaaaggaaaagaucaccguguucggacgacugagcgaacuagagcacaagaaagcacucuucaucaaaaacacggaaacuaacgaagaccgggaacacuacugggaaauauuccccaacccgaacuacgacuucccaaaagaaaacauauccgucaacgacaaagacuucccuauagcgggcuccauccuggacagggaaaagcagcccguagccgggaagaucggaauaaaagugaaacuacucaaucaacaguacgucuccgaaguagacaaggcagugaaggcgcaccaacucaaacaacgcaaagccagcaaacccuccauccaaaacaucaucgaagagaucgugcccaucaacgaaagcaaccccaaggaggcaaucguguucggcggccaacccaccgcguaucucagcaugaacgacauacauagcauacuauacgaguucuucgauaaaugggagaaaaagaaggagaaacuagagaagaaaggcgagaaggaacuccgcaaagaaauaggaaaggagcuggagaagaaaaucgugggcaaaauccaagcccagauacagcaaauaaucgacaaagacaccaacgccaaaauccucaaaccauaccaggacggcaacagcacagccauugacaaggagaaguugauaaaagauuuaaaacaagaacagaacauacuccaaaagcugaaagacgaacagacugugcgagaaaaggaguauaacgacuucaucgccuaucaagacaaaaaccgagaaauaaacaaaguccgcgaccgaaaccacaaacaguauuuaaaggacaaccucaagcggaaguacccagaagccccugcacgaaaagaaguacuguacuaccgagaaaaaggcaaagucgccgucuggcuggcaaaugacaucaagagauucaugcccaccgacuucaagaacgaauggaaaggagagcaacacagcuuacuccagaaaagccuagcauacuacgagcaaugcaaggaggaacucaaaaaucuacuaccagaaaaggucuuccaacaccucccauucaaacuaggcggcuacuuccaacaaaaauaccuguaccaauuuuauaccugcuaccuagauaaacggcucgaguacauuucaggguugguccaacaagcggagaacuucaaaagcgagaacaagguauuuaaaaaggucgagaacgagugcuucaaguuccuuaaaaagcagaacuacacccacaaagagcuagacgcccggguacaaagcauccuaggauacccaauauuccucgagagaggguucauggacgagaagcccacaauaaucaagggcaaaacguucaaaggcaacgaagcccucuuugcggauugguuccgauacuacaaggaauaccaaaacuuccaaacauucuacgacacggaaaacuacccucuaguugaacuggaaaagaaacaagcagaccgcaaacgcaaaaccaaaaucuaucagcaaaagaagaacgacguauucacgcuccuaauggccaagcacauauucaagagcguguucaaacaggacucaaucgaccaauucagccuagaagaccuguaccagucacgggaggagcggcucggcaaccaagaaagagcccgccaaacaggugaaagaaacaccaacuacaucuggaacaagacaguugaccuaaaacugugcgacggaaaaaucacagucgaaaacguaaaacucaagaacgucggcgacuucauaaaauacgaauacgaccaacggguacaagcauuccuaaaauacgaagaaaacauagaauggcaagcguucuuaaucaaggaaaguaaggaagaagaaaauuaccccuaugugguggagcgagagaucgaacaauacgaaaaggugcggcgcgaggaacugcuaaaggaaguacaccuaauagaagaguacauccuggaaaaagucaaagacaaggaaauacuuaagaaaggcgacaaccaaaacuucaaauacuacauccugaauggccucuuaaaacaacuaaagaacgaagacgucgagagcuacaaagucuucaaccugaacacagagccugaagacgucaauauaaaccagcucaaacaagaagcaacagaucucgaacaaaaggcauuuguccugacguacauugccaacaaauucgccgcaaaucagcugcccaaaaaggaguucugggacuacugccaggaaaaauacgggaagauagaaaaagagaaaacguaugccgaauacuucgccgagguguucaagaaagaaaaagaggcccuaauaaaauaa

SEQ ID NO: 11638 - RNA, 3384 nt, Artificial Sequence
  Cas13b variant__Prevotella buccae__WP_004343973.1__Cas13b
augcagaaacaagauaaacuuuuuguagaccggaagaaaaacgccaucuucgccuucccaaaauacaucaccauaauggagaacaaggaaaagcccgagcccaucuacuacgaacuaacagacaagcacuucugggccgcauuucugaaucucgccagacacaacgucuacaccaccauaaaccacaucaaccgacgacuugaaaucgcugagcucaaggacgacggauacaugaugggcauuaagggcucguggaacgagcaagcaaagaaacuagacaagaaaguacgacuacgggacuuaaucaugaaacacuucccguuucucgaagccgcagccuacgaaaugacgaacagcaaaagccccaacaauaaagaacaacgcgaaaaagaacaaagcgaggcccucucgcucaacaaccucaaaaacguccuauucauuuuccuagaaaaacuccagguucuacgcaacuauuacucccacuacaaauauagcgaagagucuccuaaaccgauuuucgaaaccucccuacucaaaaacauguacaaagucuucgacgccaacguccgcuuaguaaagcgcgacuacaugcaccaugaaaauaucgacaugcaaagagauuucacacaccucaauagaaagaaacaaguuggcaggaccaaaaacauaaucgacucaccaaacuuccacuaccacuucgcagauaaagaaggaaacaugacaauagcaggacuccucuucuucguuucgcuauuucuggacaagaaagaugcaaucuggaugcaaaagaaacuaaaaggcuucaaagacggaaggaaccuacgggaacagaugaccaacgaagucuucugcaggagcagaaucucccucccgaaacucaaacucgagaauguccaaaccaaggacuggaugcagcuagacaugcuaaacgaacucguacgcugccccaagagccucuacgagagauuacgagaaaaagaccgggaauccuuuaaaguacccuucgacaucuucucggaugacuacaacgcagaagaggagccauucaaaaacacccucguccgccaccaagaccgcuucccauacuucguccuucgcuauuucgaccucaacgaaauauucgaacagcugcguuuccaaaucgaccucggaacauaucauuucagcaucuacaacaagcgcauaggcgacgaagacgaagugcgccaccucacgcaccaccucuacggauucgcacgcauucaagacuucgcgccccaaaaucaacccgaagaauggcggaagcucgucaaagaccucgaccacuucgaaacaucgcaggaaccauacaucucaaaaaccgcgccccacuaccaccucgaaaacgagaaaaucgguaucaaauucugcagcgcccacaacaaccucuucccuagccuccaaaccgacaaaaccugcaauggacgaucgaaauucaaccucggaacccaguucacagccgaagccuucuuauccguucacgaacuacuacccaugauguucuauuaccuccuucuaaccaaagauuacucacgaaaggaauccgccgauaaagucgaagggaucauacgcaaggagaucagcaacaucuacgcgaucuacgacgcguucgccaacaacgaaaucaacucaaucgccgaccucacacgucgacuacagaacacuaacauacuccagggccaucuccccaaacaaaugauauccauacucaagggacgacaaaaagacaugggaaaggaggcagaacgcaaaaucggggaaaugaucgacgacacccaaagacgccuggaccuccucuguaaacaaaccaaccagaaaauccgcauaggcaaacgaaacgccggccuucucaaauccgggaaaaucgccgacuggcuggucaacgacaugaugcgcuuccaacccguccaaaaggaucaaaacaacauccccauaaacaacucaaaagcaaauucuacggaauaccgaaugcugcaacgcgcccuagcacuuuucggcuccgaaaauuuccgacugaaggcauacuuuaaccagaugaaucuagucggcaacgacaacccgcacccauuccucgccgaaacccagugggaacaccagaccaauauccucagcuucuaccgcaacuaccucgaggcccgcaagaaauaccuaaaagggcucaaaccgcaaaauuggaagcaguaccaacacuuucuaauacucaagguccagaaaacaaaccgcaacacccuagucacaggcuggaaaaacagcuuuaaucucccacgcggaaucuucacacaaccgauacgcgagugguucgaaaagcacaacaacuccaagcgcauauacgaccaaauacugucguucgacagagucggcuucgucgcaaaagcaauaccccucuacuucgccgaggaauacaaagacaacguccaacccuucuacgacuaccccuucaacaucggcaacagacugaaaccgaagaaacgacaauuccucgacaagaaagaacgcgucgaacuauggcagaaaaauaaagaacucuucaaaaauuaucccuccgaaaagaagaaaacagaccuagcguaccuagauuuccucuccuggaagaaauucgaacgggagcuccgccugaucaaaaaccaagacaucguaaccuggcucauguucaaagagcucuuuaacauggcaacagucgaaggacucaaaauaggcgagauccaccuccgagacauagacacgaacacagcgaacgaagaaagcaacaacauacugaaccgaauaaugcccaugaaacucccaguaaaaacauacgaaacugacaauaaaggcaacauccucaaagaacgcccacucgccaccuucuacaucgaagaaaccgagacuaagguccuuaaacagggcaacuucaaagcccuaguuaaggaccgccgccuuaacggacucuucucauucgcggagacgacggaccuaaaccuugaggagcaccccaucucuaaacuaucaguggaucucgagcugauaaaauaccaaaccacccgcauauccaucuucgaaaugaccuuaggccucgaaaagaaacucauagacaaauacucaacacuccccacugacucguuccgaaacaugcucgagcgcuggcuccaaugcaaagccaaccggcccgaacucaaaaauuacgucaacagccuaaucgcaguacgaaacgcauucagccacaaccaauaccccauguacgaugcuacgcuuuucgccgagguaaagaaauucacccuuuuccccagcguagauacaaagaaaaucgagcuaaacaucgccccacaacuccuggagauagucgguaaagccaucaaagaaaucgaaaaauccgaaaacaaaaacuag

SEQ ID NO: 11639 - RNA, 3273 nt, Artificial Sequence
  Cas13b variant__Prevotella sp.__WP_044065294__Cas13b
augaacauccccgcccuagucgaaaaccaaaagaaguacuucggcaccuacagugugauggccaugcucaacgcacaaaccguccucgaccacauacaaaaaguggccgacaucgaaggcgaacaaaacgaaaacaacgaaaaccuuugguuccaccccgucaugucccacuuauacaaugccaaaaacggauacgacaaacaaccagaaaagaccauguuuauaaucgaacgacuacaaucauacuuccccuuccuaaaaaucauggcugaaaaccaaagggaauauuccaacgggaaauacaaacagaacagagucgaggugaacagcaacgacaucuucgaaguucuaaaaagggccuuuggcguccugaagauguaucgcgaccucaccaaccacuacaaaacauacgaggaaaaacucaacgacggcugcgaguuccuuaccucaaccgaacagccacucuccggaaugauaaacaacuacuacaccgucgcacuacgcaacaugaacgaacgcuacgguuacaaaacagaggaccucgccuucauccaagacaaacgguucaaauuugucaaggacgccuacgggaaaaagaaaagccaagucaauaccggguucuuccucucgcuccaagacuacaacggcgacacacagaaaaagcuacaucucuccggaguaggcauagcccuccucaucugccuauuccucgacaaacaauacauaaacaucuuccuauccagacuccccauauucucguccuacaacgcacaaagugaggagcgacgcauaauaauacgaucauucggaauuaacuccauaaaacucccaaaagacagaauccacucugaaaaaucaaacaaaucuguagccauggacaugcucaaugaagucaagcgcugccccgacgaauuauucacuacccucucggccgaaaaacagucccgcuuccgcaucauauccgaugaccacaacgaaguacucaugaaacgaagcucagauagguucgucccccuacuacuacaguacauagacuacggcaaacucuucgaccacauacgcuuccacguaaacaugggcaaacuacgcuaccuccuaaaggccgacaaaaccugcauagacggacaaacgcgcguccgaguaaucgaacagccgcucaauggcuuuggccgacuggaagaagccgaaaccaugcgcaaacaagagaacggcacauucggaaacaguggcauccgaauccgagacuucgaaaacaugaagcgcgaugacgcgaaccccgccaauuacccuuacaucgucgacacguauacccacuacauacuggagaacaacaaagucgaaauguucauaaacgacaaagaagacuccgcaccccugcuaccagucauagaggacgaccgauacgucgucaaaaccauccccucgugcagaauguccacccuugaaauccccgcgauggcauuccauauguucuuguucggcuccaagaaaacagagaaacugaucgucgacguccacaaccgauacaaacggcuguuccaggccaugcagaaagaggaaguaacagcggagaacauagcgagcuucgggaucgcagagagcgacuuaccccaaaagauacucgaccucaucucuggaaaugcccacggcaaggauguagacgcguuuauccgguuaaccguagacgacaugcugacggacacggaacggcgcaucaaacgcuuuaaagacgaccggaaaucgaucagaagcgccgacaacaaaauggggaaacgcggcuucaagcaaaucagcacagguaaacuagccgacuuccucgcgaaggacauuguacucuuccagccguccgugaaugacggagaaaacaagauaacaggacucaacuaccgaauaaugcaguccgcaauagccguguacgacucaggagacgacuacgaagcgaagcaacaguucaagcucauguucgagaaagcccgucuaaucggcaaaggaaccaccgaaccgcaccccuuccuuuacaaaguauucgcccgcucaaucccagccaaugccguggaguucuacgaacgcuaccucaucgaacgcaaauucuaccucaccggccuaucaaacgaaaucaagaaaggaaaccgagucgacgugccguucauccgcagggaccagaauaaauggaagaccccagcgaugaagacccucggccgcauauacuccgaagaccuccccgucgaacucccccgccaaauguucgauaaugagauaaaaagccacuuaaaaucucuaccgcaaauggaaggcauugacuuuaacaacgccaacgucaccuaucuaauagccgaauauaugaagagaguacuagacgacgacuuccaaacauucuaccaauggaaccgaaacuacagauacauggacaugcugaagggagaauacgaucggaaaggaagucuccaacacugcuuuaccuccguugaagaacgcgaaggccuuuggaaagaacgagccagucgaaccgaacgauaccgaaaacaagccagcaacaagauccgaagcaaccgccagaugcgcaacgccuccucagaagaaauagagaccauccuugacaagcgacuguccaacucccgcaacgaguaucaaaaaucugaaaaagucauccggagauacagaguccaagacgcccuacucuuccuccucgccaaaaagaccuuaaccgaacucgcagacuucgacggggaacgguucaagcucaaagaaauaaugccagacgcagaaaaaggcauccugagcgaaauaaugcccauguccuucacauuugaaaagggcgggaagaaauauaccaucaccagcgaaggcaugaaacugaaaaacuacggcgauuucuucguacuagccucggacaaacgcauaggcaaucugcuagaacucgucggcucugauauugucucaaaagaagacauaauggaagaguucaacaaauacgaccagugccgcccagaaauauccagcaucguguucaaccuagaaaaaugggcguucgacaccuacccggaacugucggcccgcguagaccgugaagaaaaaguagacuucaaauccauacucaagauacugcucaauaacaaaaacaucaacaaagaacaauccgacauacuccgcaagauacgcaaugcguucgaccacaacaacuacccagauaaaggagucguugagauaaaagcauuacccgagaucgccaugagcaucaagaaagcauucggcgaguacgccaucaugaaauga

SEQ ID NO: 11640 - RNA, 4152 nt, Artificial Sequence
  Cas13b variant__Artificial____PspCas13b-GS-HsADAR2DD(E488Q,del984-1090)
augaacauuccggcacucguggaaaaccaaaagaaauacuucggaacauacagcgucauggcuaugcucaacgcgcaaaccguacuggaucacauccaaaaaguagcggauauagaaggagaacagaaugaaaacaacgaaaaccucugguuccaccccgucaugucccaccuauauaacgccaagaacggcuacgacaagcagccagagaaaacaauguucaucaucgaacgccuccaauccuauuuuccguuccucaaaaucauggcagaaaaucaaagagaauauuccaacgggaaauauaaacaaaaccgcgucgaagucaacagcaacgacaucuucgaaguacucaagcgcgccuucgggguucucaagauguaccgggaccuaaccaacgcguacaaaaccuacgaagaaaaacuaaacgauggaugcgaguuccuuacaagcacagaacagccccuaucuggaaugaucaacaauuacuauaccgucgcccuacgcaacaugaaugaaagauacggguacaaaacggaagaccucgccuucauccaggacaaaagguucaaauucgucaaagacgcauacggcaagaagaaaucacagguaaacacgggguuuuuccucucgcugcaggacuacaacggggacacccaaaagaaacuacaccucaguggcgugggaauagcgcuacugauaugccucuuccuggacaaacaguacauaaacauauuccuaucacgccuuccgauauucuccagcuacaacgcccaaagcgaagaacggcggauuaucauccggagcuucggcaucaauucaaucaaacuccccaaagaccguauccacuccgaaaaauccaacaaaagcguugccauggacaugcuuaacgaagucaaaagaugcccggacgaacuguucacaacccugagcgcggaaaaacaaagccguuuccgcauaauaucugacgaucacaacgaaguccucaugaaaagaucauccgaccguuucguaccccugcuacuccaauacaucgacuacggaaaacucuucgaccacauacgcuuccaugucaacaugggcaaacuccgguaccuccucaaagccgacaaaacaugcaucgacggacaaacgcgaguacgcgucaucgaacaaccccugaacggcuucggacgacuagaggaagcggagacaaugcggaaacaagaaaacggaacauucggcaacucaggcauccguaucagagacuucgaaaacaugaaaagagacgacgccaaccccgcgaacuacccuuauaucguagacacauacacccacuacauccucgaaaacaacaaaguugaaauguucaucaaugauaaagaagacucggcuccacugcugcccgucaucgaagacgacagguacguagugaaaacuaucccguccugccgcauguccacccuagaaauccccgcaauggccuuccacauguuccuauucggcagcaagaaaacugagaaguuaauugucgacguccacaacagauacaagcgccucuuucaagcaaugcagaaagaagagguaaccgccgaaaacauugcguccuucggcauagccgaauccgaucucccacagaaaauacucgaccuaaucuccggcaacgcgcacggaaaagacgucgacgcguucauucgccuuacaguugacgacaugcuaacugacaccgagcgcagaauaaagcgcuucaaggacgaccgaaaaucgauaagaagcgccgacaacaagaugggaaaaagaggcuucaaacaaaucucaaccggcaagcuagcagacuuccucgccaaggacauuguacucuuucaacccuccgucaaugacggggagaacaaaaucaccgggcuaaauuaccgcaucaugcaguccgccauagcagucuacgacuccggcgacgacuacgaagcaaaacaacaauuuaaacuuauguucgaaaaagcacgccuaauuggcaaaggcaccacagagccccacccguuucucuacaaaguuuucgcucgaucuauaccugccaacgcaguagaguucuacgaaagguaccuaaucgaacgaaaguucuacuuaacgggccucucgaacgaaaucaagaaaggaaacagaguggauguacccuuuauacgacgagaccaaaauaaauggaaaaccccagcaaugaaaacucucggccggaucuauucugaagaccuccccguggaguuaccccgucaaauguucgauaacgaaauaaaaucccaucuaaaaucucugccccagauggaaggaauagacuucaauaaugccaacgucacguacuuaauagccgaauacaugaaacgaguucucgacgacgacuuccaaaccuucuaccaauggaaucggaauuacagauauauggacaugcucaaaggugaguacgaucggaaaggcucccuacaacacugcuucacgucuguggaggaacgcgagggacucuggaaagagcgcgccucccggaccgaaagauaccgaaaacaggcgagcaacaaaaucaggucaaaccggcaaaugcgcaacgccagcagcgaagaaauagaaacaauucuugacaaacgccuaucgaacucucgcaacgaauaccaaaagagcgaaaaagugauaaggcgcuacagagugcaagacgcccuucucuuccuguuagccaagaaaacauuaaccgaacucgcagacuucgauggcgaacgauucaaacugaaagaaauaaugcccgacgcagaaaaaggcauccuaucggaaaucaugccaaugagcuucacuuucgaaaaaggaggcaagaaauacacaaucaccucggaaggcaugaaacugaaaaacuauggcgacuucuucguacuagcaucagacaagcguaucggcaacuugcuugaauuaguugguagcgacaucgucuccaaagaagacggcucccugcaacucccgccacuugaacgucuuacccuaggcucucaacuccaccuaccgcaaguccuggcagacgccguaagccgacuuguccuaggcaaguucggcgaccuaaccgacaacuucucgagcccccaugcgcggcgaaaaguccucgcaggcguugugaugaccaccggcaccgacguuaaggacgccaaaguaauauccguaucuaccggaacgaaaugcaucaauggugaauacaugucagaccgcgggcuagcccucaacgacugucacgcagaaauaauaagucgucggagccuucuccgcuuccuauacacccaacucgaacucuaucuaaacaacaaagacgaucaaaagcgaucaauauuucagaaaagugagcgcggcggcuuuagacuuaaagagaacguccaauuucaccuuuauaucuccacaucgccaugcggcgacgccagaauauuuagcccacacgagcccauccuggaagaaccagcagaccgccacccaaaccguaaagcccgaggccaacugagaacaaaaaucgagucgggccaaggcaccaucccaguccgcagcaacgcguccauacagaccugggauggcguccuccaaggcgagcgccuccucaccaugucgugcucagauaaaaucgcuagauggaacguagucggaauccaagguagccuccucuccauauucgucgagccuauauacuucuccagcaucauccugggcucacuauaucacggagaccaccugucgcgcgcaauguaccaacgaaucuccaacaucgaagaccucccgccacuauacacacugaacaaaccacugcuaucgggcauaucaaacgcugaggcccgucaacccgguaaagcccccaacuucagugucaacuggaccgucggcgauucugccaucgagguaaucaacgcuacaaccgguaaggacgaacucgggagagcuuccaggcuaugcaagcacgcauuguacuguagguggaugagaguucacggaaaggucccuagccaucuccuacggagcaaaauaacaaaacccaacgucuaccacgaauccaagcuagccgcaaaagaguaccaagccgcgaaagcacgacucuucacugcguucauuaaagccggacucggcgcauggguagagaaaccuacugagcaagaccaguucagucucaccuaa

SEQ ID NO: 11641 - RNA, 4152 nt, Artificial Sequence
  Cas13b variant__Artificial____PspCas13b-GS-HsADAR2DD(E488Q,T375G,del984- 1090)
augaacaucccugcgcucgucgaaaaccaaaagaaauauuucggcaccuauuccguaauggcaaugcucaacgcucaaaccgugcucgaccacauccaaaaaguggccgacaucgaaggcgagcaaaacgaaaacaacgagaaccuaugguuccacccagucaugucccaccuauacaacgcuaaaaauggauacgacaagcaaccugaaaagacgauguuuaucauugaacgacuccaauccuacuucccuuuucucaaaaucauggcggagaaccagcgagaauacucgaacggcaaauacaagcaaaacagagucgaagucaauucuaacgacaucuucgaaguccugaagagagccuucggcguccucaagauguaccgcgaucugaccaacgcguacaaaacauaugaagagaaacuaaacgacgguugugaguuccuaacaucgaccgaacagccccucuccggcaugauaaacaacuacuacacggucgcccuccgcaacaugaacgaacgauacggcuauaaaaccgaagaccuugccuucauucaggacaagagguuuaaguucgugaaggacgccuacggcaaaaagaaaagucaaguaaacacuggauucuuccucucacuacaagacuacaacggcgacacccaaaagaaauuacacuugagcggcgucggcaucgcccuccuuaucugccucuuccucgacaaacaauacaucaacaucuuccuuucacgucugccgaucuucucaagcuacaacgcccagucggaggagagacguaucauuauucgcucauuuggcaucaacucaaucaaacugccuaaagaucgcauucacagcgagaaaucuaacaaauccgucgccauggacaugcuaaacgaagucaaaagaugcccagacgaacuuuucacuacucuuagcgccgaaaagcaaucucgauuccgcaucauaucagaugaccacaaugaaguauuaaugaaacguuccagugaccgcuuuguaccgcuacuccuacaauauauugacuacggcaaacuguucgaccacauacguuuucacgucaacaugggcaaacuccgcuaccuccuaaaggccgacaagaccugcauagacggacagacccgugugagagucauagaacaacccuuaaacggcuucggacgccucgaggaagcagaaaccaugcgcaagcaggagaacggcaccuucgguaauagcggaauccgcauccgggacuuugaaaacaugaagcgcgacgaugccaacccugcaaauuacccuuacaucguagacacguacacccacuacauacuugagaauaacaagguagaaauguucaucaacgacaaagaagacucugccccacuccucccuguaauugaagaugaccgauacguagucaaaacaauucccuccugccgcaugucaacacuagaaauucccgcgauggccuuccacauguucuuguucggaagcaagaaaaccgaaaaauugaucgucgacguccauaacagauacaaacgccucuuccaagcaaugcaaaaagaggaaguuacggccgaaaacaucgcgucuuucgguauugcggaauccgaccuuccucagaaaauacucgacuuaaucucggggaacgcacacgguaaagaugucgacgcauucauucgccuuacgguagaugacaugcuuaccgacaccgaacgcagaaucaaaagauucaaggacgacagaaagaguauacguagcgcggacaacaagaugggaaaacguggauucaaacaaaucagcaccggcaaacuagcggacuuccucgcuaaagacauaguacucuuucaacccucuguaaacgacggagaaaacaagauaacaggacucaacuaucguaucaugcaaagcgccaucgcaguauacgauagcggggacgacuacgaggcaaagcagcaguucaaacucauguuugaaaaggcgcgacuaaucggaaaaggaaccacagaaccccacccauuccuauacaaagucuucgcccguagcauacccgcaaacgccgucgaauuuuacgagagauaccugauagaacgaaaauucuaccuaaccggccuguccaacgaaaucaagaaagggaaccgggucgauguaccauucaucaggagagaccaaaacaaauggaaaacccccgccaugaaaacccucggccggaucuacuccgaagaccuacccguagaacucccaagacaaauguucgacaacgaaaucaaaagccaccucaaaucccuaccccaaauggaggggaucgacuucaacaacgccaacgucaccuaccuaaucgccgaguauaugaaacgaguacucgacgacgacuuccagaccuucuaccaguggaaccgaaacuacagauacauggauaugcuaaaaggcgaauacgauagaaagggcucacuacagcacugcuucacauccguggaggaacgcgaaggccuauggaaagagcgcgcgagccgaacagagagauaccgaaaacaagcgagcaacaaaauccgcagcaacagacaaaugcgaaacgcgagcagugaagaaauagaaacgauccuugacaagcgauugucaaacagccgaaacgaauaccaaaagucggaaaaaguuaucagaagauaccgaguccaggacgcccuccuauuccuccuagcuaaaaagacgcucaccgaacucgcagacuucgacggcgaacgguucaagcuaaaagagaucaugcccgacgcagagaaaggaaucuuaagcgagaucaugccgaugucauucacauucgaaaaaggcgggaagaaauacacuauaacaucagagggaaugaaacuuaaaaacuacggcgacuucuuuguacuagccuccgacaaacgaaucggcaaccuacuagaacucgugggguccgacaucgucuccaaagaggacggaagccuacaacugccgccacucgaacgacucacucuggguagccaacuccaucugccacaagugcucgccgacgcagucucccgacucguacucggcaaguucggggaccucaccgacaacuucucuuccccacacgccagaagaaaaguacuugccggaguugugaugacgacuggcaccgacgucaaggacgccaaagucaucuccguaagcacgggcggaaagugcaucaacggcgaauacauguccgaccgaggccucgcccucaacgacugucacgcggaaauuaucucacgccgcucacuguuacgauuccuauacacacaacuagagcucuaccuuaacaacaaagacgaccagaaacgauccauauuccagaaaagcgagcguggcggguucagauuaaaagagaauguccaauuccaccuuuacauaucaacgagccccugcggagaugcccgcauauucuccccacacgaaccgauacucgaggagccugcugaccgccacccaaaucgcaaggcccgcggacaacugcgcacuaagauugagucaggccagggcacaauaccuguaagauccaacgccuccauccaaaccugggacggcguccuacaaggugaaaggcuacucacaaugagcuguagcgacaaaauagcgagauggaacguagucgguauccagggcucgcuccugagcauauucguagaaccaaucuacuucaguucgauaauacucggaucacuauaccacggcgaccaccugagucgcgccauguaccaacgcaucuccaacaucgaagaccuacccccacuguacacacucaacaaaccccuucuaaguggcaucucaaacgccgaagcccgucaacccggaaaagcaccuaacuucuccgucaauuggacaguaggagacucggcgauagaagucauaaaugcaaccacgggaaaggacgaacucgggcgcgccucccgacuaugcaagcacgcccucuacugcagauggaugcgcguacacggcaaagugccaucccaucugcuacgcagcaagaucacgaaaccaaacguauaccacgaauccaaacucgcugcuaaagaauaccaagcagcuaaggcccgcuuauucacugcguuuauaaaagccggacugggcgccuggguggaaaaacccacagaacaagaccaguucucccuaacauga

SEQ ID NO: 11642 - RNA, 2862 nt, Artificial Sequence
  Cas13b variant__Alistipes sp.__WP_047447901.1__Cas13b
augagcaacgaaaucggggcguuucgcgaacaccaguucgccuacgcacccggaaacgaaaaacaagaagaagcaaccuucgcaacauacuucaaucucgcccuaucaaacguagaagggaugauguucggagagguagaauccaacccagacaaaaucgagaaaagucuagacacacugccacccgcaauucuacggcagaucgcgucauucaucuggcucagcaaagaggaucauccggacaaagccuacagcacagaagaaguaaaaguaaucguaacagaccucgugaggcgccucugcuucuaccgaaacuacuuuucccauugcuucuaccucgacacccaauacuucuacucagacgaacugguagauaccaccgcgauaggcgaaaaacuccccuacaacuuccaccacuucauuaccaaccgacuguuccgcuacucacuccccgaaaucacacucuuccgguggaacgaaggagaacgcaaauacgagauccuuagagacggccucaucuucuucugcugccuauuccucaaaagaggacaggcggagagauuucucaaugaacuccgauucuucaaacggacagacgaagaaggucgaauuaaacggacgaucuucaccaaauacugcacacgcgaaucccacaaacacauaggcaucgaagaacaggacuuccuaaucuuccaagauaucaucggcgaccuaaacagaguuccaaaggucugcgacggggugguggaccuuagcaaagagaacgagcgcuacaucaaaaaccgcgaaacgagcaacgagucagacgaaaauaaagccagguaccgacugcuaauacgcgaaaaagacaaauuccccuacuaccuaaugcgcuacauagucgacuucggaguccucccauguauaaccuucaaacaaaacgacuacuccacaaaagaaggucgaggccaauuccauuaccaagacgccgccguggcacaagaggaacgaugcuacaacuucgucguccgcaacggaaacgucuacuacuccuacaugccgcaggcccagaacguagucagaauaucggaacuccagggcaccaucuccguggaagaacuaagaaauauggucuacgcaagcauaaauggcaaagacguaaacaaaagcgucgagcaauaccuguaucaccuccaucugcucuacgagaaaauacugacaaucucgggccagacgauaaaagaagggcgaguagacgucgaagacuaccgcccacuccuagacaaacuacuccuccgaccggcaucgaacggagaagaacuccggcgcgaacucagaaaacuacuucccaaacgcgucugcgaccuccuuuccaaccgcuucgacuguucggaaggaguauccgcagucgaaaaacgacuaaaagccauccuacuacgccacgaacaacuccuacucucccaaaacccggcccuccacauagacaaaaucaaaagcguaaucgacuaccucuacuuguucuucagcgacgacgaaaaauuccgccaacaaccaacggaaaaggcccacagaggccuuaaagaugaggaguuccaaauguaccauuaucucguuggcgacuacgacagccacccgcucgcgcuuuggaaagaacucgaagcaagcgggagacucaaacccgaaaugcgcaaacuaaccagcgcaacaagccuccacggccuauacaugcugugccuaaaagggaccguagaguggugucgaaaacagcuaauguccaucggcaaaggcacugccaaagucgaagcgauagccgaccgcguugggcucaaacuauacgacaaacucaaagaauacacccccgaacaacuagaacgcgaagucaaacugguaguaaugcacggcuacgcagccgcagccacaccgaagccgaaagcucaagccgccaucccgucgaagcuaaccgaacuaagauuuuacagcuuccucggcaaacgagaaaugagcuucgcagccuuuauacgucaagacaaaaaggcccaaaaacucuggcugcgcaacuucuacacaguggaaaacaucaagacccuacagaaacgacaggcagcggccgacgcagccugcaagaaacuauacaaccucgucggagaaguagaacguguccauaccaacgacaaaguccucguccuggucgcgcaacgcuaccgagaacgacuccuaaacguaggcuccaaaugcgccguaacacucgacaauccagaacgacagcaaaaacucgcagacguguacgagguacaaaaugccuggcucagcauacgcuuugacgacuuagacuucacacuaacccacgugaaccucucaaaccuccgcaaagcauacaaccuaauaccucgaaaacacauccucgcauucaaggaauaccuagacaaccgcgucaaacaaaagcucugcgaggagugccgaaacguccgacgcaaagaagaccucugcacaugcugcagcccccgcuacucaaaucugacaagcuggcucaaagagaaccacagcgaaucauccauugagcgcgaagccgccacaaugaugcugcuagacgucgaacgcaaacuccucucguuccugcucgaugaacgcaggaaagccauaauagaauacgggaaauucauucccuucuccgcacucguaaaagaaugcagacucgccgacgcagggcuauguggcauacgcaacgacguucuacacgacaauguaaucucauaugcagacgccauuggcaaacugucagcauacuuccccaaagaagccagcgaagcaguggaauacauacggcgcaccaaagaaguccgcgagcaacggcgcgaagaacuaauggcaaauuccagccaauaa

SEQ ID NO: 11643 - RNA, 3348 nt, Artificial Sequence
  Cas13b variant__Bacteroides pyogenes__ERI81700.1__Cas13b
auggaaucaaucaaaaacucccagaaaucaacaggcaaaacgcuucaaaaggacccaccauacuucggccucuaccugaauauggcccuccugaacgucagaaagguagaaaaccacauacggaaauggcuaggagaugucgcucugcucccggaaaagagcggcuuccacagccuccucaccacagacaaccuaagcagcgcaaaauggaccagguucuacuacaagagcagaaaguuccuccccuuccuagaaauguucgacuccgacaagaaaagcuacgaaaaccgacgagagacaacagagugccuggacaccauagaccgccagaaaaucagcagccuguuaaaagaagucuacggcaaacuacaagacaucagaaacgcauucagccauuaccacaucgacgaccagagcgucaaacacacagcccugauaauaagcagugaaaugcaccgcuucaucgaaaaugcauacuccuuugcacuucagaaaaccagggcacgcuucaccggcguauucgucgaaacugacuuccugcaagcugaggaaaagggcgacaacaagaaauucuucgcgauaggaggaaacgaaggcaucaaacuaaaggauaacgcacucauauuccucaucugccuauuucuagaccgugaagaggcauucaaauucuuaagccgagccacgggcuuuaagucgaccaaagagaaaggauuccuagccguccgcgaaaccuucugcgcccucugcugccgccaaccacacgaaaggcugcugucugugaacccgagagaagcacuacuaauggacaugcugaacgaacuaaacagaugcccagacauucucuucgaaaugcucgacgaaaaggaccaaaaaucauuccucccacuccucggcgaggaagaacaagcgcacauacucgagaacucccuuaacgacgagcugugcgaagcaaucgacgacccguucgagaugauagcaucccuauccaaacguguucgcuacaaaaaccgguucccauaccuaaugcuccgcuacauagaagagaaaaaucuacuacccuucauacgauuccgcauagaucucggcugccuagagcucgcaaguuaccccaagaaaaugggcgaagagaacaacuacgagagauccgugaccgaccacgccauggcauucggccgacucaccgacuuccauaacgaagacgccguccuacagcaaauuaccaaaggaauaaccgacgaaguccgauucagccuauaugcaccccgcuacgcaauauauaacaacaaaauaggcuucgucagaaccgggggcagcgacaaaauauccuucccaacccucaagaagaaaggcggggaagggcacugcgucgcauauaccuuacagaacaccaaaucauucggguucaucagcaucuacgaccuacggaaaauacuccuccucagcuuccucgacaaagacaaagccaaaaacaucguaagcgggcuccuagagcaaugcgaaaagcacuggaaagaucuaucagagaaccucuucgacgcaaucagaaccgaacuacaaaaggaguuccccgucccccuaauaagauauacacuucccaggagcaaagggggcaaacuggugagcagcaaacucgcggacaagcaagaaaaauacgaaucugaguuugaacgccgaaaagaaaaacuaacagaaauacucucagaaaaagacuucgaccugagccagauaccccgacgaaugauagacgagugguuaaacguccugccaaccucgcgcgaaaagaaacucaaaggauauguagaaacacugaaacuagacugccgcgagcgacuucgcgucuuugaaaaacgcgagaaaggggagcacccugucccgccccgaauaggcgaaauggccaccgaccuagcaaaagacaucauacgaauggucaucgaccaaggaguaaaacaacgcaucaccuccgccuacuauagcgagauccaacgcugccuagcccaguacgccggagacgauaaccgaagacaucucgacucgaucauccgagagcucagacucaaggacacgaagaauggacaccccuuccuaggaaagguacuacgacccggacucggccacacggagaaacuguaccagcgguacuucgaagagaagaaggaguggcucgaagcgaccuucuacccggccgcgagcccaaaacggguaccacgguuuguaaacccacccacagggaagcagaaagaacuaccacuuaucauacgcaauuugaugaaagagcgccccgaauggcgugacuggaagcagcgcaaaaacagccacccaaucgaccuacccagccaacucuucgaaaaugaaauaugucgacuucugaaagacaagaucggaaaggagccaagcggcaaacucaaauggaacgaaauguucaaacuguacugggacaaagaguucccaaacgggaugcagcgauucuauagaugcaaacgccgaguggaagucuucgacaaggugguagaauacgaauacagcgaagaaggcggcaacuacaaaaaguacuacgaggcccuaaucgacgaaguagucagacagaaaauaagcagcucaaaggagaagucgaaacuacaaguggaagaccuaacgcugucaguccgccgcgucuucaagcgagccauaaacgaaaaggaauaccaacuaagacuccuaugcgaagacgacagacuacuguucauggcaguaagagaucucuacgacuggaaggaagcccaauuagaccuugacaaaauagacaacaugcuaggagaaccaguuuccgucucacaagugauccaacucgaaggcgggcagccggaugcggucaucaaagccgaaugcaaauuaaaggacguaucgaaacuaaugcgauacugcuacgacggaagagugaaaggccucaugccguacuucgcuaaucacgaggccacccaagaacaggucgaaauggagcuacgccacuaugaagaccacaggagacgaguguucaacugggucuucgcccuagaaaagagcguccucaaaaacgaaaaacuucgacgauucuacgaagagucccaagggggaugcgagcaccgcagaugcauagaugcccuccguaaagcaagccucgucuccgaagaagaguacgaguuccucguacacauccgcaacaaaagugcccacaaccaauucccggaccuagaaauugggaaacuaccacccaacgucaccucgggauucugcgaaugcaucugguccaaguacaaggcaaucaucugccgcaucauaccauucauagacccggaacgccgauucuucggcaaacuccuggaacaaaaauaa

SEQ ID NO: 11644 - RNA, 3348 nt, Artificial Sequence
  Cas13b variant__Bacteroides pyogenes__WP_034542281.1__Cas13b
auggaaucaaucaaaaacucacagaaaagcacaggcaagacacuccaaaaagacccacccuacuuugggcucuaccucaacauggcucuccucaacguccgaaaggucgaaaaccacauccgcaaaugguugggagacguggcacucuuaccagaaaagucaggauuucacagccuccucaccaccgauaaccuaucaagcgcaaaauggacacgcuucuacuacaaaagccgaaaauuucucccguuccucgaaauguuugacucugauaaaaagucauacgaaaaucggcgggaaacagcugaaugccucgacaccaucgaccgacagaaaaucuccagccuacuaaaagaaguuuacggaaagcuccaagauauccgcaacgcauucagucacuaccacaucgacgaccaaagcgucaaacauacggcgcuuaucauaucguccgaaaugcaucgcuuuaucgaaaacgccuacagcuucgcccuucagaaaacccgcgcucgauucacaggggucuucguagaaaccgauuuccugcaagcagaggaaaaaggcgacaacaaaaaguucuucgccaucggcggcaacgaggggaucaagcucaaagacaacgcacuaaucuuccuaaucugccuguuccucgacagagaagaagccuucaaauuccugucaagggccacaggcuuuaaaucaaccaaagaaaaaggauuccuggccguccgagaaacguucugcgcacucugcugccgccaaccgcaugaacgucugcucucagucaacccaagagaagcccugcuuauggacaugcugaacgaacuaaacagaugcccagacauccuuuucgagaugcucgacgaaaaagaccaaaaaucauuccuuccccuccucggcgaagaggaacaagcacacauucucgaaaauucucuaaaugacgaacuaugcgaggcaauagacgacccauucgaaaugaucgcaucccucagcaaacguguccgcuacaagaaccgcuucccauaccucaugcucagauacauagaagaaaagaaccuuuugcccuuuauacgcuuccgcauagacuuaggcugccucgaacucgccucauaucccaaaaagaugggggaggagaacaacuacgaacgcagcgucaccgaccacgcuauggccuucggacgccugacagacuuccacaaugaagacgcaguacuccaacagauaacaaaaggcaucaccgacgaagugcgauucucacucuacgccccacgguacgcaauauauaacaacaaaauuggguucgucagaacaucuggauccgacaaaauauccuuccccacgcucaagaagaaaggaggugaaggccacugcguggcauacacgcuccaaaacacaaagagcuucggcuucauuucaauauacgaccuacguaaaauacuccucuuauccuuccucgacaaagacaaagcuaaaaauaucgugucaggacuccuugaacaaugcgaaaaacacuggaaagaccuuucagaaaaccuguuugacgcuauacgaaccgaacugcaaaaagaguuccccgucccacugaucagauacacccucccccgcuccaaaggcggcaaacuugugucgucaaaacucgcggacaagcaagaaaaguacgaaucagaguucgaacgacgaaaagaaaagcucaccgaaauccugucugaaaaagacuucgaccugagccagaucccccgccgcaugaucgacgaauggcucaacguacuccccaccagcagagaaaagaagcucaaaggcuacguggagacccucaaacucgacugccgcgagcgccuccgcguguucgaaaagcgggagaagggcgaacacccccuacccccacguaucggagaaauggcaaccgaccucgcgaaagauaucauucgaauggucaucgaccaagggguaaaacaacgaaucaccagcgccuacuacagugaaauacaacgcugccucgcccaguacgcaggcgacgauaaccggcgccaccuagacucuauuaucagagaacucaggcuaaaagacaccaaaaacggacauccauuccuaggaaaaguucuaaggcccggacuagggcacacggagaaacuguaccaacgguacuucgaagaaaagaaagaauggcucgaggccacauucuaccccgcagcauccccaaaacgagucccccgauucgucaacccacccacaggaaaacagaaagagcucccacugauaauacgaaaucuaaugaaggaacgacccgaauggcgcgacuggaaacagaggaagaacucccaccccauagaucugcccucccaacucuucgagaacgagaucugucggcuucucaaagacaaaaucggcaaagaacccucuggaaagcuaaaguggaacgaaauguucaaacuauacugggacaaggaauuuccuaacgggaugcagcgauucuaccggugcaagcgccgcgucgaaguuuucgauaaagucgucgaauacgaguacucagaagagggcgggaauuacaaaaaguacuaugaggcccucaucgacgaagucguccgacaaaagaucucuucgagcaaagaaaagagcaaacuucaaguggaggaccugacgcucucgguccgucgagucuucaaacgcgccauaaacgaaaaagaguaccagcuccgacuccucugcgaggacgacagacugcuauucauggcaguacgagaccuguacgacuggaaagaagcacaacucgaccucgacaaaaucgauaacaugcugggagaacccgucucggugucccaagucauccaacucgaaggcggacagcccgacgcugucauaaaagccgaaugcaagcucaaagacguaagcaagcucaugcgcuacugcuacgacggccgaguuaaaggucuaaugcccuacuucgccaaccacgaagcuacccaagaacaagucgaaauggagcuacgacacuacgaggaccaccgccgaaggguauucaacugggucuucgcgcuggaaaaauccgucuuaaagaacgaaaaguuacgacgcuucuacgaggaaagccaagggggcugcgaacaccgccgcuguaucgacgcccuccgcaaagcaucccuugucagcgaagaagaauacgaguuccucguacacauacgcaacaaguccgcccacaaccaguuccccgaccucgaaauaggaaagcugccaccaaacgucaccuccggcuucugcgagugcauauggagcaaauacaaagccaucaucugccgcaucauuccuuucaucgaccccgagcgcagauucuucgggaaacuucuagaacagaaauaa

SEQ ID NO: 11645 - RNA, 3675 nt, Artificial Sequence
  Cas13b variant__Bergeyella zoohelcum__WP_002664492.1__Cas13b
auggaaaacaaaacgucgcucggcaacaacauauacuacaacccauuuaaaccccaagacaaguccuacuucgcaggcuacuucaacgcagcuauggaaaacacagacucggucuuccgcgaguuaggcaaacgacucaagggaaaggaauacaccagugaaaacuucuucgacgcaauauucaaagaaaacaucucccuagucgaauacgaacgguacgucaaacuccucagcgacuacuuccccauggcgcggcuacuggacaagaaagagguaccgauaaaggaacgaaaagagaacuuuaaaaagaacuuuaaggggaucauuaaggcaguccgcgaucuucgcaacuucuacacccacaaagagcacggcgaaguugaaauaacagacgaaauauucgggguccuggacgaaaugcuaaagagcaccgugcucaccgugaaaaagaaaaaggugaaaacugauaaaacaaaagaaauccugaaaaagagcaucgaaaaacagcuggacauccugugccaaaagaaacucgaguaccuaagagacaccgcccgaaaaaucgaggagaaaaggaggaaccagcgagaacgcggagagaaagagcuagucgcaccauucaaauacagugacaaacgcgaugaccuaaucgcagcaaucuacaacgaugccuucgacgucuacaucgauaagaagaaagacagccucaaagaaucgagcaaggcaaaauacaacacgaaauccgacccccagcaagaagaaggcgacuuaaaaaucccaauaagcaaaaauggcguagucuuccuccuuagccuauuccugaccaaacaagaaauacacgccuucaaaucaaagaucgcgggcuucaaagccacagucaucgaugaagccaccgucucagaagcaacaguaucccauggcaaaaauuccaucugcuucauggccacgcacgaaaucuuuagccaccuggccuacaagaaacuuaaaagaaagguacgcacagcagaaauaaacuauggugaggccgaaaacgccgagcaacucuccgucuacgccaaagaaacgcugaugaugcaaaugcucgacgaacucagcaaagucccagacguaguguaccaaaaccucuccgaagacguccagaagaccuucauagaagacuggaacgaguaucucaaggagaacaacggcgacguaggcaccauggaagaggagcaagucauacaccccgugauccgaaagcgauacgaggacaaauucaacuauuucgcgauacgcuuccucgacgaguucgcacaguucccaacacuacgguuucaggugcaccuugggaacuacuuacacgacucgaggccaaaggaaaaucugaucuccgaccggcgaaucaaagagaaaauaaccguguucggccgguuauccgaacuagaacacaagaaagcccucuucaucaaaaacaccgagacaaacgaggauagagaacacuacugggaaaucuuccccaaucccaacuacgauuucccaaaagagaauaucagcgugaacgacaaagacuuccccaucgcgggcucuauccuagaccgcgaaaagcaaccgguugcaggcaaaauuggcaucaaaguaaaacuccucaaccaacaguacgugucagaagucgacaaagccgugaaagcccaucaacucaaacaacgaaaagcauccaagcccaguauucaaaacaucauagaagaaaucgucccgaucaacgaaucaaacccaaaggaggcgauaguauucggcggacaaccaacggcguaccuaucaaugaacgacauccacagcauacuauacgaauuuuucgacaagugggagaagaaaaaggagaaacucgagaagaagggcgaaaaagagcugagaaaagagaucgguaaagaacucgaaaagaaaaucgugggaaaaauacaggcgcaaauccaacagauaaucgauaaagacacaaacgcgaaaauccucaaaccauaccaggacggaaacucuaccgcaaucgauaaagagaaacuaauaaaagaccuaaaacaagaacagaacauccuacaaaagcuaaaagacgagcagaccgugagagagaaagaauacaacgacuucaucgccuaccaggacaaaaaccgugagaucaacaaagugcgcgaccggaaccacaagcaauaccucaaagacaaccugaagcgaaaauacccagaagcacccgcuagaaaagaggugcucuacuaccgcgaaaagggaaaaguagccgucuggcucgccaacgacauaaagcguuucaugcccacagacuucaaaaacgaauggaagggagaacaacacagccuacuccaaaagagccuagcguacuaugaacaaugcaaagaagaguugaaaaaccuacugccagaaaaagucuuccagcacuuaccauucaaacucgggggcuacuuucagcaaaaauaccuguaccaauucuauacaugcuacuuagacaaacgauuagaauacaucucaggccuuguccaacaagcggaaaacuucaaaagcgagaacaaaguguucaaaaaggucgaaaacgaaugcuucaaguuccucaaaaagcaaaacuacacgcacaaggaacucgacgcaaggguacagagcauucucgguuaccccauauuccuagaacgagguuucauggacgaaaagccaacaauuaucaagggaaaaaccuucaagggcaacgaggcuuuguucgcagacugguuccgcuacuauaaggaauaccaaaacuuccaaaccuucuacgacacagaaaacuacccccucgucgaauuggagaagaaacaagccgaccgaaaacggaagaccaaaaucuaccaacaaaagaaaaacgauguauucacccuacuaauggcaaaacacauuuucaaauccgucuuuaaacaagacuccauagaccaauucagccuagaagaccucuaccaaagccgugaggaacgccucggcaaccaggaaagagcgagacagaccggcgagaggaacacaaacuacauauggaacaaaacagucgaccuaaagcugugcgacggcaaaaucaccguggaaaacguaaagcuaaagaacgugggagacuucaucaaauacgaguacgaccagcgcguacaagccuuccuaaaguacgaagaaaacauagaauggcaagccuuccuaaucaaagaaagcaaagaagaagaaaacuaucccuacgugguagaacgcgagaucgaacaauacgaaaaaguacgccgagaggagcuccuaaaagaaguccacuuaauagaggaguacauccucgaaaaagucaaggacaaagaaauccucaagaaaggagacaaccagaacuuuaaauacuauauccucaauggccuccugaagcaacugaaaaacgaggacguggagucguacaaaguauucaaccuaaauacagaaccggaggaugucaacauaaaccagcucaaacaggaagccaccgaccucgagcaaaaagccuucguccugaccuacauaagaaacaaauucgcccauaaccagcuaccgaagaaggaguucugggacuacugccaagaaaaguauggaaagauagaaaaagaaaagacauacgccgaguacuucgccgaaguauucaagaaagagaaagaagcgcugauaaaauaa

SEQ ID NO: 11646 - RNA, 3600 nt, Artificial Sequence
  Cas13b variant__Capnocytophaga canimorsus__WP_013997271.1__Cas13b
augaagaauauccaacgacugggcaaaggcaacgaguucagcccuuucaagaaagaagacaaauucuacuucggcggcuuccuaaaccuagccaacaacaacauagaagacuucuuuaaagaaaucaucacaagguuuggcauagucaucaccgacgaaaacaagaaacccaaagagaccuucggagagaagauccuuaacgaaauauucaagaaagacauauccaucguugacuacgaaaaaugggucaacauauuugcugacuacuucccguucacaaaauaccucagccuauaccuagaggaaaugcaguucaaaaaccgagugauaugcuuccgugacguaaugaaagagcuccugaaaaccguggaagcacucagaaacuucuacacccacuacgaccacgaaccgaucaagaucgaagaccgcguuuucuacuuccuggauaaaguacucuuagacgucagccuaacagugaaaaacaaauaccucaaaacggacaaaaccaaagaguuccucaaccaacacauaggggaagaacugaaggaacucugcaaacaacgcaaagacuaccuaguaggcaaaggaaaacgcauagacaaggaaucggaaaucauaaacggcauauacaacaacgccuucaaagacuucaucugcaaaagggagaagcaggacgacaaagagaaccacaacuccguggagaaaauuuuaugcaacaaagaaccacagaacaagaaacagaaaucaagcgccacgguuugggagcuaugcuccaaaagcagcuccaaauacaccgaaaagagcuucccaaacagagagaacgacaaacauugccucgagguccccauaucccagaaaggaaucguauuccuacuaucguucuuccucaacaaaggggagaucuacgcccugaccuccaauaucaaaggauucaaagccaaaaucaccaaggaagaacccguaacauacgacaagaacagcauccgcuauauggcgacacaucggauguucagcuuccucgcguacaagggacuaaagcgcaaaauccgcaccucggagauuaacuacaacgaagacggccaggcaagcagcacauacgaaaaagaaaccuugaugcuacaaaugcuagacgagcuaaacaaaguuccugacguggucuaccagaaccuaucagaagacguccagaaaaccuucaucgaggacuggaacgaauaccucaaagaaaauaauggcgacgucggaaccauggaggaagaacaagugauccacccugugauacgcaaacgguacgaagacaaauucaacuacuucgcaauccgauuccucgacgaauuugcgcaauuuccaacacuccgcuuucaaguccaccucggaaauuaccuaugcgacaaacggacgaaacaaaucugcgauacaacuacagaacgagaagucaagaagaaaauaaccguguucggcagacuaucagaacucgagaauaagaaagcgaucuuccuaaacgaacgcgaagagaucaaagggugggaagucuucccgaaccccagcuacgauuuccccaaagaaaacaucuccgucaacuacaaagacuucccaauagucggcucaauccuggacagggagaaacagcccguuuccaacaaaaucgggauccgagugaaaaucgcugacgaacuccaaagagagaucgacaaggccaucaaagagaaaaagcuccgcaaccccaaaaaccggaaagccaaucaagacgaaaagcaaaaagaacgccuagucaacgagaucguaagcaccaacagcaaugagcaaggggaacccgucgucuucaucggccaacccaccgcauaucuguccaugaaugacauacacagcguacucuaugaguuccugauaaacaagaucuccggugaggcccucgagacaaaaaucguagagaaaauagagacgcagaucaagcagauaaucgguaaagaugcaacgacgaaaauacucaagccguacaccaacgccaacagcaauucgaucaacagagaaaaauugcuccgagaccuagaacaagaacaacaaauccuaaagacucuacucgaggaacagcaacaacgagagaaagacaagaaagacaagaaauccaaaaggaaacacgaacuauaccccagcgagaaaggcaagguagccgucuggcuugcaaaugacauuaagagguucaugccuaaagccuucaaagaacaguggcggggcuaccaccacagccugcuccaaaaauaccucgccuacuaugagcaaagcaaagaggagcucaaaaacuuacucccaaaggaagucuucaaacacuuccccuucaaacugaaaggauauuuccagcaacaauaccugaaccaauucuacaccgauuaucucaagcgcagacuaucauacgucaacgaacuacugcucaacauccaaaacuucaagaaugacaaagaugcccuaaaagcuacugaaaaagaaugcuucaaauucuucagaaagcaaaacuacaucaucaauccaaucaacauccagauccaaagcauucugguuuacccaauauuccuaaaacgaggcuuccuagacgaaaagccaacuaugauugacagagaaaaauucaaggaaaacaaagacaccgagcucgccgauugguuuaugcauuacaaaaacuacaaagaagacaacuaccaaaaguucuaugccuacccacucgagaaagucgaagagaaggaaaaauucaaaagaaacaaacagaucaacaagcagaagaaaaacgacguauacacucucaugauggucgaguacauuauacagaagaucuucggagauaaauucguagaagaaaacccccuuguccugaaaggaaucuuccaaucgaaagcugaaaggcaacagaacaacacgcacgccgcgacaacccaagagcgaaaccugaacggaauacucaaccaaccaaaagacaucaaaauccaaggaaagaucaccguuaaaggcgugaaacucaaagauaucggaaacuucagaaaguacgagaucgaccagcgagucaauacguucuuagacuacgagcccaggaaagaguggauggcauaccuccccaacgacuggaaggagaaggagaaacaaggccagcuaccacccaacaacgucauugaccgacaaaucucgaaauacgaaacuguccgcucaaagauccuucugaaggacguccaagaacucgagaagauuaucagcgacgagaucaaggaggaacaucgccacgaccucaaacaaggcaaguacuacaacuucaaguacuacauccucaacgggcuccuccgacaacugaaaaacgagaacguagaaaacuacaaggucuucaagcucaacaccaauccggagaaagugaacaucacacagcugaagcaagaggcgaccgaccuagagcaaaaagccuucguguuaaccuacauccgcaacaaauucgcucacaaccaacugcccaagaaagaauuuugggacuacugccaggaaaaauacggcaagaucgagaaagagaagacguacgcagaauacuucgcugaaguauucaagcgagagaaagaggcacucaucaaguaa

SEQ ID NO: 11647 - RNA, 3657 nt, Artificial Sequence
  Cas13b variant__Capnocytophaga cynodegmi__WP_041989581.1__Cas13b
auggagaacaaaacaagccugggcaacaacaucuacuacaaccccuuuaaaccacaggacaaaaguuacuuugcagguuaccuaaacgcagccauggaaaacaucgacagugucuuccgagaacucggaaaacgacuaaagggaaaagaauacacauccgagaacuucuucgacgccaucuucaaggaaaauaucucccuaguagaauacgagcgauacgucaaacuccuaucagacuacuucccuauggcccgccuccucgacaagaaagagguacccauaaaagaacgcaaagagaacuuuaagaaaaacuuccggggcaucaucaaagcggugagagaccuaagaaacuucuacacccacaaggaacacggagagguagaaauuaccgacgagaucuucggggugcuggaugagaugcugaaaucaaccguccucacagucaaaaagaagaaaaucaagaccgacaaaacaaaagaaauccucaaaaagagcaucgagaagcaacucgacauccuuugccaaaagaaacuggaguaccugaaagacaccgcacgcaagaucgaagagaaacgccgcaaccagagagaacgaggggagaagaaacucguaccccgauucgaauacagcgacagaagagacgaccuaaucgcagccauauacaacgacgcguucgacguauauaucgacaaaaagaaagacucacugaaagaaaguucaaaaaccaaguacaacacagagucauauccacaacaggaggaaggugaccucaaaaucccaaucuccaaaaacggaguaguauuccuacucucacuguuccucagcaaacaagagguccaugccuucaaaagcaagaucgccggcuuuaaagccacgguaaucgacgaagccacagucagccaccgcaaaaacagcaucuguuucauggcuacacacgaaauauucucccaucucgcauacaagaaacucaagcguaaaguccggaccgcggagauaaacuacagugaagcagagaacgcggagcaacugagcaucuacgcaaaggagacccuaaugaugcagaugcuugacgagcuauccaaaguacccgacguuguguaccaaaaucucagugaggacgugcaaaagacauucaucgaagauuggaaugaauaccucaaagagaacaacggagacguaggcacgauggaggaagaacagguuauccacccgguaauacgaaagagguacgaggacaaauucaacuacuucgcaauaagguuccuagacgaauuugcccaguuccccacccuaagauuccaaguccaccugggcaacuacuugcaugacagcagacccaaagaacaccuaauaagcgaccgccguauuaaggagaaaaucaccgucuucgggaggcuaagcgaacuggagcacaagaaagcccucuucauaaagaacacggaaacaaacgaggaccggaaacacuacugggaagucuucccgaacccgaacuacgacuuccccaaggaaaacaucucggucaaugacaaggacuuccccauugccggcagcauccucgaccgagaaaaacaacccaccgccggcaaaaucggcaucaaagugaaccugcuaaaccaaaaauauaucucagaggucgacaaagccguuaaagcucaccagcugaagcaaagaaacaacaagcccagcauccaaaacauaaucgaggaaaucgucccaauaaacggcagcaaccccaaggagaucaucguauucggcggccaaccgacggcauaccucagcaugaacgacauacauuccauacucuacgaguucuucgacaaaugggaaaagaagaaagaaaaacuagagaaaaagggagaaaaagaacugcgcaaagagaucggcaaggagcucgaagagaaaaucgugggaaagauccaaacccaaauacaacagauaauagacaaagacauaaaugcgaaaauccuaaagccauaucaggacgacgacuccacggcaauugacaaggaaaagcucaucaaagaccuaaaacaggaacagaaaauacuccaaaaauugaagaacgaacaaaccgcucgcgagaaggaguaccaagaaugcaucgccuaccaggaggaaucacgcaagauuaaacgaucagacaagagccgccaaaaauaccuaagaaaccagcuaaagcgcaaguaccccgagguacccacgagaaaggaaauccucuauuaccaagaaaagggcaagguugccgucuggcuggcuaaugacaucaaacgcuucaugcccaccgacuucaaaaacgaguggaaaggcgagcagcacuccuuauuacagaaaucucucgcauacuacgaacagugcaaagaggaacugaagaaccuccucccccaacaaaagguuuucaaacaccuaccauucgaacucggagggcauuuccaacagaaauaucuauaccaguucuacacccgcuaccucgacaaacgacuggaacacaucucgggccucguccaacaagccgaaaauuucaaaaacgagaacaaaguauucaaaaagguagaaaacgagugcuucaaauuccugaagaaacagaacuacacccacaaaggccuugacgcccaggcccaauccguccuaggguacccaaucuuccuagaaagaggcuucauggaugaaaaaccaacuaucaucaaagguaagacauuuaagggcaaugagagucuguucacugacugguuccgguauuacaaagaauaucagaacuuccagaccuucuaugacaccgagaacuacccccugguggaacuagaaaagaaacaagccgauagaaagcgggaaacgaaaaucuaccagcagaagaagaaugacgucuucacacuacucauggcuaaacacaucuucaaaagcgucuucaagcaggacuccaucgaccgcuucagucucgaagaccuuuaucaauccagagaggaacgacuagagaaccaagagaaagcgaagcagacgggcgagcgcaacacaaauuacauuuggaacaaaacggucgaccucaacuuaugcgacggcaaagucacagucgagaacgugaaacugaaaaacgucggaaacuucauaaaauacgaguacgaccaacguguccaaacauuccuaaaauacgaagaaaacaucaaguggcaggcauuucuaauaaaggagagcaaggaagaggaaaacuacccauacauaguagaacgagagauagaacaauacgaaaaaguccgccgagaagaacuccuuaaggagguccaucuaaucgaggaauacauccucgaaaaggugaaagauaaggaaauccuaaagaaaggcgacaaccaaaacuucaaauacuacauccucaacgggcuacucaagcagcuuaagaacgaagacgucgaaagcuacaaaguauucaaccuaaauaccaaaccagaagacgugaacauaaaccaacugaaacaagaagcgaccgaccuagaacaaaaggccuucguccuaaccuacauacggaacaaauucgcccacaaccaacuaccgaagaaggaguucugggacuacugccaagaaaaauacggcaaaaucgaaaaggaaaagaccuacgcagaauacuucgcugaaguauuuaagcgcgaaaaggaggcgcuaaugaaguga

SEQ ID NO: 11648 - RNA, 3438 nt, Artificial Sequence
  Cas13b variant__Chryseobacterium sp.__WP_047431796.1__Cas13b
auggaaacccaaacaauaggccaugggaucgccuaugaccacucuaaaauccaagacaagcacuucuucggcggcuuccuuaaccuggcggaaaacaacauaaaggccgugcucaaggcguucuccgaaaaauucaaugugggcaacgucgacgucaagcaauucgcggauguaucccucaaggacaaccucccugacaacgauuuccagaagcgcgucagcuuccucaaaauguauuuucccguaguagacuucauaaacauaccaaacaaccgggccaaauuccgaagcgaucucacgacgcuuuucaagucggucgaccaacuccgaaacuucuauacccacuacuaccacaagccucucgauuucgacgcaucccucuucauccuucucgacgacaucuucgcgcgcacugccaaagaaguacgggaccagaaaaugaaggacgacaagacccggcagcuccuauccaagucacuauccgaggaacugcaaaaaggcuacgaacuacaacuggaaagacucaaggaacuaaacagacucggcaagaaagucaacauacacgaccaacuugggaucaaaaacggaguccugaacaacgcuuucaaccaccucauauacaaagacggggaaucuuucaaaacuaaacucacauacucaagcgcccucaccagcuucgaaagugccgaaaacggaaucgaaaucucccaaucugggcuccucuuccuccucucuauguucuuaaaacgaaaggaaauagaagaucugaaaaauagaaauaaaggcuucaaggccaaagucgugauagacgaagauggcaaagucaauggacugaaauucauggccacccacuggguguucagcuaccuaugcuucaaaggccugaaaucuaaacugagcacggaguuccacgaagaaacccuacucauacaaaucaucgacgaacuaagcaaggucccggacgaacuguacugcgcauucgacaaggaaacaagggacaaguuuaucgaagacauaaacgaauacgucaaagagggccaccaagacuucagccuugaggacgccaaggucauacauccggucauccguaaacgauacgaaaacaaauucaacuauuucgcuauacgguuccucgacgaguucgucaaguucccuucauuacgauuucagguccacgucgguaacuaugugcaugaccggcgcaucaaaaacaucgacggcaccacauucgaaaccgaacgaguaguuaaggaucggaucaagguguucggccgccucuccgaaaucuccagcuacaaggcgcaguaccucagcagcgucucagacaaacacgacgaaaccggcugggagauauuccccaacccauccuacguauuuaucaacaacaacauccccauacacauauccguggacaccucauucaagaaagaaaucgcagacuucaagaaacugcgacgcgcccaaguaccggacgagcucaaaauacgcggcgcagaaaagaaacgcaaauuugaaaucacccaaaugauagguaguaaauccguacugaaccaggaggagccuauagcccugcucucacugaacgaaaucccggcgcuacuuuacgaaauccuuaucaacggaaaggaaccagccgaaauagaaagaaucaucaaggacaaacugaacgaacgacaagacguaaucaaaaauuacaacccugaaaacuggcugcccgcgucccaaauaagccgccggcuccggucgaacaaaggcgagcgaaucauaaacaccgacaagcuccuacaguuagucaccaaagaacugcuugucaccgagcaaaaacucaaaaucauauccgauaaccgcgaggcgcucaaacagaagaaagagggcaaauacauccggaaauucaucuucaccaacucggaacuaggccgagaagccaucuggcuagcagacgacaucaaacgcuucaugccggccgacguccgaaaagaauggaaaggauaccagcacucacaacuacaacagucccucgccuucuacaauagccggcccaaagaagcucuggcaauacuagaaagcagcuggaauuuaaaagacgagaaaaucaucuggaacgaauggauccugaaaucauucacacaaaacaaauucuucgacgcauucuauaacgaguaccugaaaggccgcaaaaaguacuucgcauuccuaagcgagcauauaguacaauauacaaguaaugccaagaaccuccaaaaauucaucaagcaacaaaugcccaaggacuuguucgaaaagcgacacuacaucauagaggaccuccaaacggaaaagaacaagauacuaagcaaaccauucauauucccacgcggcaucuucgacaaaaagccaacauucaucaaagggguaaagguggaagacuccccagagagcuucgccaacugguaccaauacggcuaccaaaaggaccaucaguuccagaaauucuacgacuggaagcgcgacuacagcgacgucuuccucgaacaccuuggcaagccguuuauaaacaacggagaccgacgcacccucggaauggaggagcuaaaggaacgcauaaucaucaaacaagaccucaaaauaaagaagaucaaaauccaagaccucuuccuacgccugaucgcagaaaauuuguuccaaaaagucuucaaguacuccgcaaaacugccauugagcgacuucuaccuaacucaagaagagagaauggaaaaggaaaauauggccgcacuccagaacguaagggaagaaggcgauaaguccccaaacauuauaaaggauaacuucaucuggagcaaaaugaucccauacaaaaagggacaaaucauugaaaacgccguaaaguugaaggacauaggcaaacucaacguccuaagccucgacgacaaagugcaaacccuucuauccuacgacgacgcaaaacccuggucgaaaaucgcacucgagaacgaguucagcaucggagaaaacucuuacgaaguaauacgccgggaaaagcuauucaaagagauacaacaauucgaauccgagauacucuucagauccggcugggacggcaucaaucacccggcccaacuggaagacaaccgcaaccccaaguucaaaauguacauaguuaacgguauacuacgaaaguccgcaggccucuacucgcaaggcgaagauaucugguucgaauacaacgccgacuucaacaaccuagacgcagacguccuagaaacgaaaucagaauuaguccaauuagcguuccuugucaccgccauacgcaacaaguucgcgcacaaucaacuaccggcaaaagaguuuuauuucuacaucagggccaaguacgguuucgccgaugaaccguccguugcccuagucuacuugaacuucaccaaguacgccaucaacgaguucaagaaggucaugauauaa

SEQ ID NO: 11649 - RNA, 3453 nt, Artificial Sequence
  Cas13b variant__Flavobacterium branchiophilum__WP_014084666.1__Cas13b
auggagaacuuaaacaaaauccuggacaaggaaaaugagaucugcaucucuaaaaucuucaacacuaagggcaucgccgccccuauaacggagaaagcucuugacaacauaaaguccaaacagaaaaacgaccuaaauaaagaagcacgccuccacuauuucaguaucggccacuccuucaagcaaaucgacaccaagaaaguguucgacuaugugcuaaucgaagaacugaaagaugaaaagccgcugaaauuuaucaccuuacaaaaagacuuuuucacaaaagaguucagcaucaaacuccaaaaacucaucaacucaauacgaaauaucaauaaccacuacguccacaacuucaacgacaucaaccuuaacaagaucgacucgaacgucuuccacuuccuaaaagagagcuucgaauuggcaauaauagaaaaauauuacaagguaaacaaaaaguacccccuugacaacgaaaucguccuauuccugaaagaacuguucaucaaagacgaaaacaccgcauuauuaaacuauuucacgaaccucucaaaagacgaagcaaucgaauacauacucaccuucaccaucacugaaaacaaaaucuggaacaucaacaacgagcauaacauacugaacaucgagaaagguaaguaccucacuuucgaggccaugcuuuuucugauaacaauuuuccuauacaagaacgaagccaaccaucugcuccccaagcuauaugacuucaagaacaacaaaucgaagcaggaacuauucaccuucuucuccaagaaauuuaccucccaggacaucgacgcagaggaaggccaccucaucaaauuccgcgacaugauacaauaccuaaaccacuacccaacggcguggaacaacgaccugaaacucgaaucugaaaacaaaaacaaaaucaugacgacaaagcucaucgacucaauuauugaguucgaacugaacuccaacuacccuucauucgccaccgacauccaauuuaagaaggaagcaaaagccuuucuguucgccucaaacaagaaaagaaaccagacuucauucucaaacaaaucauacaacgaagagauccgccacaacccacacaucaaacaauaucgcgacgaaaucgccagcgcacugacuccuauuucuuucaacgucaaagaggacaaauucaaaauauucgucaagaaacacguccucgaagaauacuuccccaacucuaucggcuacgagaaauuccuugaguacaacgauuucacagaaaaagaaaaagaagacuucggccucaaacuauauucgaacccaaaaacgaacaaacucaucgaacgcaucgacaaccacaaacucgugaaaagccacggccgcaaucaagaccgcuucauggauuuuuccaugcgguuccuagccgaaaacaauuacuuuggaaaagacgccuucuuuaagugcuauaaauucuacgacacccaagaacaggacgaguuccuacaaucgaacgaaaacaacgaugacguaaaauuccacaagggcaaggucacgaccuacaucaaauacgaagaacacuuaaagaacuacuccuacugggacugcccguucguagaggaaaauaacuccaugagcgucaaaaucagcauuggaucagaggagaaaauacuaaaaauucagcguaaccucaugauauacuucuuagagaacgcacuauacaacgagaacgucgaaaaccaaggcuacaagcucgugaacaacuacuaccgcgaacucaagaaagauguugaagaaaguaucgccagccucgaccugauaaaaucaaacccggacuucaaauccaaauacaaaaagauacuaccgaagcgccuucuucacaacuacgcucccgccaaacaggacaaagccccagaaaacgccuucgaaacacuacuuaagaaagcugacuucagagaggaacaauacaagaaacugcucaagaaagccgagcacgagaaaaauaaagaagacuucguaaaacgcaauaaaggcaaacaauuuaaacuacacuucauccgcaaggcaugccaaaugauguacuuuaaggaaaaguacaacacacucaaagaaggcaacgccgccuucgagaaaaaggaccccgugaucgaaaaacgcaaaaacaaagaacacgaguucggccaccacaagaacuugaacauaaccagagaagaauuuaacgauuacugcaaguggauguucgccuucaacggaaacgacagcuacaagaaauaucuccgugaccucuucuccgaaaaacauuucuucgauaaucaagaauacaagaaccuauucgaaucuuccgucaaccuugaagcauucuacgcgaaaacgaaagagcucuuuaagaaauggaucgaaaccaauaaaccgaccaacaacgaaaaccgcuacacauuagaaaauuacaaaaaccugauccuccaaaaacaagucuucauaaacguguaccacuucuccaaauaccucauugacaaaaaccuccucaacagcgaaaacaacgucauccaguauaaaucucuagagaacgucgaguaccugaucucagacuuuuacuuccagagcaaacucuccaucgaccaguacaaaaccugcggaaagcuauucaauaaacucaaaagcaauaagcucgaagacugccuccuguaugagauagcguacaacuacaucgacaagaaaaauguccacaaaaucgacauccagaaaauacucacauccaaaaucauccucaccauaaacgacgcaaacacccccuacaaaaucucagucccauucaacaaacucgaacgauauacagaaaugaucgcaaucaagaaccaaaacaaccuaaaagcucgcuuccugaucgaucucccgcuauaccucuccaaaaacaaaaucaagaagggcaaagacucagcuggguacgaaaucaucauuaagaacgaccucgaaaucgaagacauaaacaccaucaacaacaaaaucauaaaugacucaguaaaauucaccgaggugcuuauggaacuagagaaauauuucauccucaaagacaaaugcauccucuccaaaaacuacaucgauaacucagaaauaccuucacucaaacaauucuccaaggucuggaucaaagaaaacgaaaaugaaaucaucaacuaccgcaacauugcaugccauuuccaccuaccacuacucgagaccuuugacaaucuccuccuuaacguggaacaaaaguucauuaaggaggagcuacaaaacguaagcacgaucaacgacuuauccaaaccucaagaguaucugauacuccuauucauuaaauuuaaacacaacaacuucuaccucaaucuauucaacaagaaugagucgaaaaccaucaaaaaugacaaggaagucaaaaagaaccgaguacuacagaaguucaucaaccaaguuauccucaaaaagaaguga

SEQ ID NO: 11650 - RNA, 3642 nt, Artificial Sequence
  Cas13b variant__Flavobacterium columnare__WP_060381855.1__Cas13b
augucauccaaaaacgaaucauacaacaaacagaagacguucaaccacuacaaacaagaagacaaauauuucuucggcggcuuccuaaacaaugccgacgacaaccugagacaaguaggcaaagaguucaaaacgcgcauuaacuuuaaccauaacaacaacgaacuggcgucaguauucaaagacuauuucaacaaggagaagucaguugccaaacgcgagcacgcccugaaccugcuaucgaacuacuucccaguccuggaacgaauacaaaaacauacuaaccacaacuucgaacaaacgagagaaaucuucgaauuacucuuagacaccaucaaaaagcuacgcgacuauuacacccaccauuaccauaagccgauaaccaucaaccccaaaguguacgacuuuuuggaugacacgcuacuagacguccuaaucacuaucaaaaagaagaaagucaaaaacgacacaucacgcgaacugcuaaaagagaaauuccgacccgaacuaacccaacucaaaaaccagaaacgcgaggaacuaaucaagaaaggaaagaaacuccucgaagaaaaccuggaaaacgcggucuucaaccacugccuacggcccuuccuagaagagaacaaaaccgacgauaaacagaacaaaaccgucagucuacgcaaauaccgcaaaagcaagccaaacgaagaaacuagcauaacccuaacgcaaucaggacucguguuccuaaucuccuucuuucuccaccgcaaagaguuccaaguguucaccuccggcuuggaagguuucaaggccaaaguuaauaccaucaaagaagaagaaaucagccuaaacaaaaacaacaucguauacaugauaacccacuggucguacucguacuacaacuucaaagggcucaagcacaggaucaaaaccgaccagggcgucuccacgcuggaacagaauaacaccacccacagccucacgaacaccaacaccaaggaggcccuccuaacacagaucguagacuaccucuccaagguacccaaugaaaucuacgagacucucagcgaaaagcaacaaaaggaguucgaagaagauaucaacgaauacaugagggaaaaucccgaaaacgaagacagcacauucagcuccaucgugucccacaaggucauccgcaaacgguacgaaaauaaauucaacuauuucgccaugcgguuccuugacgaauacgccgaacuccccacccuccgauucaugguuaacuucggcgacuacauaaaagacaggcagaaaaagauccucgaaagcauccaguucgacagcgaacguaucaucaagaaagaaauccaccucuucgaaaaacuaggacucguaacagaguacaaaaagaacguauaccucaaggagaccuccaacauagaccuaucaagauucccccucuuccccuccccgucguacgucauggcaaacaacaauauccccuucuauauagacucccggagcaacaaccuugaugaauaccucaaccagaaaaagaaggcgcaaucacaaaaccggaagagaaaccucaccuuugaaaaauauaacaaggagcaaucgaaagaugcgauaauugccaugcuccaaaaggaaauuggcgucaaggaccuccaacaaagaucaacuaucggauugcuaagcugcaaugaacuuccuucuaugcucuacgagguaaucgugaaggacaucaaaggggccgaacuagagaauaagauagcccagaaaauacgugagcaauaccaaagcauccgagacuuuacccuggacagcccccaaaaagacaacauucccaccacccugaccaaaaccaucuccacugacaccucggucacuuucgagaaccaaccaaucgacaucccccgcuugaaaaacgcucuacaaaaagaacugacccuaacccaagaaaaacucuuaaacgugaaacagcaugaaauagaaguugauaacuacaaccguaacaaaaacaccuacaaauucaaaaaccagccaaaggacaaaguagacgacaacaaacuucaaagaaaauauguuuucuaccggaacgaaauuggccaagaagcaaauuggcuagcauccgaccuuauccacuucaugaagaacaaaucccuauggaaagguuacaugcacaacgaacuccagagcuucuuagcuuucuucgaggacaagaaaaacgacugcauagcgcuucuggagaccgucuucaaccucaaagaagacugcauacuaaccaaagaucugaaaaaucuauuccuuaagcacggaaacuuuaucgacuuuuacaaagaauaccucaagcucaaagaagacuuccuuaacaccgaguccacauuuuuagaaaacggauucauaggccucccaccaaaaauccuuaagaaggagcucuccaaaaggcuaaacuacauauucaucguguuccaaaagcgacaauucaucaucaaagagcucgaggaaaagaaaaacaaccucuacgccgacgccauaaaccucucgcggggcauauucgacgaaaaaccaacgaugaucccuuucaaaaagcccaacccugacgaguucgccucaugguucgucgccuccuaccaauacaacaacuaccagagcuucuacgaacuaacucccgacaaaaucgagaacgacaaaaagaagaaauacaaaaaccucagagcaaucaacaaagugaaaauccaagauuacuaccucaaacuaauggucgacacccuuuaccaagaccuuuucaaccaaccccuggacaaaucccucucagacuucuacguuuccaaaaccgacagagagaaaaucaaagccgacgcaaaagcauaccaaaaacgcaacgacucguuccuauggaauaaaguaauccaccugagccuccaaaacaacaggauaacagcaaacccgaaacucaaagacauuggcaaguacaaacgagcccuccaagacgagaaaauagccacccuccuuacauacgacgaccgcaccuggaccuacgcacuccaaaagcccgaaaaggaaaacgaaaacgacuacaaggaacuccacuacacagcacuaaacauggaacugcaagaauaugaaaaaguccgcuccaagaaacugcuaaagcagguccaagagcuugagaaacaaauacuagacaaauucuacgacuucuccaacaacgcaacccaccccgaagaccucgaaauagaagacaagaaaggcaaacgacaccccaacuucaaacucuacaucacaaaggcccuacugaagaacgaaagugaaaucaucaaccuagagaacauagauaucgaaauacuuaucaaauacuacgacuacaacacagaaaaacucaaagaaaagaucaagaauauggacgaagacgaaaaggccaaaaucgucaacacaaaggaaaacuacaacaaaauuacaaacgugcucaucaagaaagcccucguccucauaauuauccggaacaaaauggcccacaaucaauacccgccuaaauucauauaugaccuagcaacgcgguucguaccaaagaaagaggaagaauauuuugccugcuacuucaaccgcguguucgaaaccaucaccaccgagcucugggaaaauaagaaaaaggcgaaagaaaucguguag

SEQ ID NO: 11651 - RNA, 3540 nt, Artificial Sequence
  Cas13b variant__Flavobacterium columnare__WP_014165541.1__Cas13b
augucaucuaaaaacgaguccuacaacaaacagaaaaccuucaaccacuacaaacaagaggacaaauacuucuuuggcggcuuccucaacaaugcagacgacaaccuccgccaagugggcaaggaguucaaaacccgcauaaacuucaaccacaauaauaaugaacucgccagcguuuucaaagacuacuuuaacaaggaaaaaucgguagcgaagcgcgagcacgcacucaaccugcuuuccaacuacuuccccguauuggaacgcauccaaaaacacacaaaucacaacuucgagcagacccgcgaaaucuucgagcuacuccuagacaccauaaagaaacuucgcgauuacuacacacaccacuaucacaaacccaucacaaucaaccccaagaucuacgauuuccuugacgauacauuacucgacgugcucaucaccauuaagaaaaagaaagugaaaaacgauacaucccgcgagcuucuuaaagagaaacucaggcccgaacuuacacagcuuaaaaaccagaaacgagaagaacucaucaagaaaggcaagaaacuacucgaagaaaaccuagagaaugccguguuuaaccacugccuccgacccuuccuggaagaaaacaaaacagacgacaaacagaacaaaacagucucucuacgaaaauacagaaaguccaagccaaacgaagaaaccuccaucacccucacucaguccggccucgucuuucuuauguccuuuuuccuacaccgcaaagaguuccaaguguucaccucaggccucgagggcuucaaggccaaagucaacaccaucaaggaagaggagauuucccuaaacaagaauaacaucgucuacaugauaacccacuggucguacucuuacuacaacuucaaagggcucaagcaccggauaaagaccgaccaaggaguuuccacacuugaacaaaacaacaccacccacagccugaccaacacaaacaccaaagaagcgcuccucacccaaauaguagacuaccuaucgaaaguaccgaacgaaauuuacgaaacacucucagagaagcagcaaaaagaguucgaagaagacauuaacgaauacaugcgagaaaaucccgaaaacgaagacuccacauucucaucaaucguaucccacaaagucauccggaaacgauacgaaaacaaauucaacuacuuugccaugagauuccucgacgaauacgccgaauugcccacacuacguuucaugguaaauuucggcgacuauaucaaagaucgccagaagaaaauacucgaauccauccaauucgacagcgaacgaaucaucaagaaagaaauccaccucuuugaaaaacugagccuaguuacagaauauaagaaaaacguguaccugaaagaaaccucaaauaucgacuuaagccgcuucccacuguucccaaacccaucauacgucauggcuaacaacaacauucccuucuacaucgacagccgaagcaacaaccucgacgaauaucugaaccaaaagaagaaagcgcagucgcagaacaagaaacgcaaccucacguuugaaaaauacaauaaagagcaaagcaaagacgccaucaucgcuaugcuccagaaggaaaucggcguaaaggaccuccagcaacguucuacaauaggacuacuuagcugcaacgaacucccaucgaugcuauacgaagucauagucaaagacaucaagggcgcagaacuugaaaacaaaauugcccagaaaauccgcgaacaauaccaaaguauaagagacuuuacauuggacucaccccaaaaagauaacaucccgaccacccuaauaaaaaccaucaacaccgacuccuccgucacauucgaaaaucaaccaaucgacaucccccgacugaagaaugccauucaaaaggaacuuacccuuacccaagaaaaacuccucaacgucaaagagcacgaaaucgaagucgacaauuacaaccgcaacaaaaacacguacaaguucaaaaaccagcccaagaauaaaguggacgacaaaaagcuccagcgaaaauacguauuuuaccgcaacgaaauccgccaagaagccaacuggcucgccagcgaccucauacacuucaugaaaaacaaaucccucuggaagggcuacaugcacaacgaacuacaauccuuccucgcauucuucgaggacaaaaagaacgacugcauagcccuccuagaaacagucuucaauuuaaaagaagacugcauacucaccaaaggccuuaaaaaccuguuccucaaacauggcaacuucaucgacuucuacaaggaauaccucaaauuaaaagaagacuuccugaacaccgagucaaccuuccucgaaaacgggcucauaggacuacccccaaagauccuuaaaaaggaacuaucgaagcgguucaaauacauauucauaguguuccagaaacgucaguucauaaucaaagagcuagaagagaaaaagaauaacuuauaugccgacgccaucaacuuaucccgcggcauauucgacgaaaaacccaccaugaucccauucaagaaaccaaacccagacgaguucgccagcugguuugucgcaagcuaccaguacaauaacuaccaauccuuuuacgaacuuaccccggacaucguagaacgagacaaaaagaagaaauacaaaaaccuacgcgccauuaauaaaguuaaaauccaagacuacuaucucaaacucaugguggacacccucuaccaagaccucuuuaaccaaccacucgacaaaucgcuauccgacuucuaugucagcaaagcggaacgcgagaaaaucaaagcagacgcaaaggcauaccagaaaaggaacgacagcucccuauggaacaaggucauccaucuaucccuccaaaacaaucgaaucacagcgaacccaaagcuaaaagacaucggaaaauacaagcgcgcccuucaagacgagaaaaucgcuacacuccuaaccuaugacgaccggaccuggaccuacgcacuccagaagcccgaaaaagaaaacgaaaacgacuacaaagaacuccacuauaccgccuuaaacauggagcugcaggaguacgagaaggucaggucaaaagaacuucugaaacaaguacaggagcuggagaaacaaauccuggaggaguacaccgacuuccucuccacacaaauccaccccgccgauuucgagcgcgaaggaaaccccaacuucaagaaauaccuggcacacucgauccuagaaaacgaagacgaccuagacaaauugccggagaaaguagaagcaaugagggaacuagacgaaaccauuacuaaccccaucaucaagaaagccaucguccucaucaucauacguaacaaaauggcccacaaccaauacccacccaaauucauauaugaccuugcaaaccgcuuuguccccaagaaagaagaagaauacuucgccacuuacuucaaucgcguuuucgagacaaucacgaaagaacugugggaaaacaaagaaaagaaagacaaaacccaaguguaa

SEQ ID NO: 11652 - RNA, 3642 nt, Artificial Sequence
  Cas13b variant__Flavobacterium columnare__WP_063744070.1__Cas13b
augucgucuaaaaacgaguccuacaacaaacagaaaacguuuaaccacuacaaacaggaggacaaauacuucuucggaggcuuucucaauaaugccgacgacaaccuccgccaggucggcaaagaguucaagacccgcauaaacuucaaucacaauaacaacgaacuggccucggucuucaaagacuacuucaacaaggaaaagucagucgccaaaagagaacacgcacucaaccugcuaagcaacuacuuccccguucucgaacgcauccaaaagcacacaaaccacaauuucgaacaaacucgggaaaucuuugagcuacugcuagacaccaucaagaaacuacgcgacuacuacacgcaccacuaccacaaacccaucaccaucaacccaaagaucuacgacuuccuagacgauacccuccucgacguccugauaaccaucaagaaaaagaaagucaaaaacgacaccuccagggaacugcucaaagagaaacuucggccggaacuaacacaacucaaaaaccagaaaagagaagaacugaucaagaaagguaagaaacuacucgaagaaaaccuagagaacgcaguguucaaccacugucuccguccuuuccucgaggaaaacaaaacggacgauaaacagaacaaaacagucucccucaggaaauaccggaaaagcaagcccaacgaagaaacgucaauaacccucacgcaaucagggcuugucuuucugaugucguucuuccuucacagaaaggaguuucaggucuucaccuccggucuagagggcuuuaaagcaaaggucaacacgauaaaagaggagaagauuucauuaaacaaaaacaacauaguauacaugaucacacacuggucauacagcuauuacaauuuuaagggacucaagcaccggauaaagacagaccaaggcgucucuacucucgaacaaaacaacaccacgcacucuuuaaccaacaccaacaccaaagaggcccuacucacccaaaucgucgacuaucucuccaaaguuccgaacgaaaucuacgagacgcucuccgaaaaacaacaaaaagaauuugaggaagacauaaacgaauauaugcgcgaaaaccccgagaacgaagacucgacuuucuccuccaucguaucccacaaggucauccgaaaacgcuacgagaauaaauucaacuacuucgcuaugcgcuuccucgacgaguacgccgaacugccuacccuccgauucaugguuaacuucggcgacuacaucaaagacagacagaaaaagauccucgagagcauacaguuugacuccgaacgcaucaucaaaaaggaaauacaccucuucgaaaaacucggccuugucacugaauacaagaaaaacgucuaccuaaaagaaaccuccaacaucgaccucucccgguucccucuguucccguccccuagcuacguaauggcaaacaacaacaucccguucuacaucgacucccgaagcaacaaccucgacgaauaccuaaaccagaaaaagaaagcccaaucucaaaaccgcaagcggaaccucacauucgagaaguacaacaaagagcaaucgaaagacgcuaucaucgccaugcuacaaaaggagaucggcgucaaagaccugcagcaacgaucaacuauuggccuacucucaugcaacgaacucccauccaugcucuacgaggucauagucaaggauaucaagggagcagaauuagagaacaaaaucgcacagaaaauccgcgagcaguaccaaucaauccgagacuucacacucaacucgccacaaaaagacaacauccccacaacccucauuaaaaccauaucaaccgacaccucggucaccuucgagaaccagcccaucgacaucccacggcuuaaaaacgccauccagaaggaauuggcccucacccaagaaaaacugcuaaaugucaaacagcacgaaaucgaagucaacaacuacaaccggaacaagaacacguauaaguucaagaaccaacccaaggacaaaguugacgacaacaagcuccaacgcaaauacgucuucuaccgcaacgaaauaggacaagaagcgaacuggcuggccuccgaccuaauacacuucaugaagaacaaaucccucuggaaaggguacaugcacaacgagcugcagagcuuucucgcauucuucgaagacaagaaaaacgacugcaucgcacuucuagaaaccgucuucaaccuaaaagaggacugcauauuaaccaaagaccucaaaaaccuauuucuaaagcaugggaacuucauagacuucuauaaagaauaccucaaacucaaagaagacuuccuaaacaccgaguccaccuuccucgaaaacggcuucauugggcuacccccuaagauacuaaagaaagaacuaagcaaacggcuaaacuacauauucaucgucuuucaaaaacggcaauucauaauaaaagaauuagaagaaaagaaaaacaauuuauacgcugacgcaaucaaccuaagccgcggcaucuuugacgaaaaacccacaaugauccccuucaagaaacccaaccccgacgaauuugccagcugguucgucgccuccuaccaauacaauaacuaccaaucauucuacgaacucaccccagacaaaauagaaaacgacaagaagaagaaauacaaaaacuuacgugccaucaacaaagucaaaauucaagauuauuaccucaaacucauggucgauacgcuauaccaagaccucuucaaucagccacuagacaaaagucucagcgacuucuacgucuccaaaaccgaccgcgagaaaaucaaagcggaugcaaaagccuaccaaaaacgcaacgacucauuccuauggaacaaaguaauucaccucagccuccagaacaaccggauaaccgcaaacccuaaacuaaaggacauagggaaauacaagagggcccugcaagacgagaagaucgccacgcuauugacauaugacgacagaacauggaccuacgcccuccaaaaaccagaaaaagaaaacgaaaacgauuauaaggagcuccacuauaccgcacucaauauggaacuccaggaauaugaaaaaguccggagcaagaagcuccugaaacaaguacaagaacuugaaaaacaaauccuagacaaauuuuacgacuucaguaacaacgcgacacaccccgaggaccucgaaaucgaagacaaaaaggggaaacgucaccccaauuucaaacucuacauaacgaaagcccuccucaaaaacgaaagcgaaaucauaaaccucgaaaacaucgacauagaaauccuaaucaaguauuaugacuacaacaccgagaaacuuaaagagaaaaucaaaaauauggaugaagacgagaaagcgaaaauagucaacaccaaggagaacuacaacaagaucaccaacguacucaucaagaaagcccucguacucaucaucauacguaacaaaauggcacauaaccaguauccaccaaaauucaucuacgaccuagccacccgcuucguaccgaagaaagaagaagaauacuucgccugcuacuucaaccgugucuucgaaacuauaaccacagaacucugggaaaauaaaaagaaagccaaagaaaucguauaa

SEQ ID NO: 11653 - RNA, 3645 nt, Artificial Sequence
  Cas13b variant__Flavobacterium columnare__WP_065213424.1__Cas13b
augucgagcaaaaacgaguccuacaacaaacagaaaaccuucaaccauuacaagcaagaagacaaguacuucuucggggguuuccuaaacaacgccgacgacaaccuaagacaaguaggaaaagaauuuaaaacacgcaucaacuucaaccacaacaacaaugaacucgccagcguguuuaaggacuacuucaacaaggagaaaucagucgcgaaaagagagcacgcacugaacuuacuauccaauuauuuccccguucuggaaagaauccaaaaacacacaaaucacaacuuugagcaaacccgggagaucuucgagcugcuacuagacacaaucaagaaacuacgcgauuacuacacccaccacuaccacaaacccaucaccauaaaccccaaaauauacgacuuccucgacgacacgcuacuagacguacugauaacgaucaagaagaaaaagguuaaaaacgacacaagccgcgagcuucucaaagaaaagcuacgccccgagcucacacaacuuaaaaaccaaaaacgcgaggaacuaaucaagaagggcaagaaacuccuggaggagaaccuagagaaugcaguauucaaccacugccugauccccuuccucgaggaaaacaaaacggacgauaaacagaacaagaccguaucacucagaaaguaccgcaaaagcaagccaaacgaagagaccagcauaacacucacacagucaggacuggucuuccuaauguccuucuuccuucaccgcaaagaguuccaaguuuucacuucuggacucgaacgcuucaaggccaaggucaacaccaucaaggaagaagaaaucucucuaaacaaaaacaauaucguauacaugaucacccacugguccuacucauacuacaacuucaaaggccucaaacaccgcauuaagacagaccaaggagucucaacacuugaacagaacaacacaacgcacucccucacgaauacaaacacaaaggaagcccuucuuacacaaauagucgacuaccuaagcaagguccccaaugagaucuacgaaacccuaucagaaaaacaacagaaagaguucgaagaggauaucaacgaauacaugagggaaaaucccgaaaacgaagacuccacguucuccagcauagucagccacaaggugauccgcaagagguacgaaaauaaauucaacuacuucgcaaugcgcuuccucgaugaauaugccgaacucccgacacugcgcuucauggucaacuucggcgacuacauaaaggaccggcaaaagaagauccuagaguccauccaguucgacucagagcggaucauuaaaaaggagauacaccucuucgagaaacuuucccuaguaacagaguacaagaagaacguuuaccuuaaggaaacaucaaacauagaccuaucccgguuccccuuauucccuaacccauccuacgucauggcaaauaacaacauccccuucuacauagacagucgcuccaacaaccucgacgaguaccuaaaccaaaagaagaaagcccaaucacaaaauaagaaacgaaaccucacauuugaaaaauauaacaaagagcaaagcaaagacgccaucauugcgaugcuucagaaagaaauaggggucaaagaccugcaacagcgaagcacaaucggccuccucucaugcaaugaguuaccauccaugcucuacgagguaauuguaaaagacauaaaaggcgccgaacuugagaacaaaauagcccagaagauucgagagcaauaccaaagcauacgcgacuucacucucgacagcccccaaaaagacaacauccccacgacgcuaaucaaaacaaucaacacugacagcucugucacauuugagaaccaacccaucgauaucccccgccuaaagaacgccuuacagaaggaacuaacacucacccaagaaaaacuacucaacguaaaagagcacgaaauugaagucgacaacuacaaccgaaauaagaacaccuacaaguucaagaaccaacccaaaaacaagguggacgacaagaaacuccaacgaaaauacguauucuaccggaacgaaauuaggcaggaagcgaacuggcuugccuccgaccucauacauuuuaugaagaacaaaucgcucuggaaagguuacaugcauaacgagcuacaaucuuuccuggcguucuucgaagacaagaaaaacgacugcauugcgcuccuugagacagucuucaaccucaaagaggacuguauccuaaccaaaggccucaagaaccuauuccucaagcacggcaacuucaucgauuucuacaaagaauaccucaaacucaaagaagacuuucuauccaccgaguccaccuuccuggaaaacggcuucaucggccucccacccaagauccucaagaaagagcuaaguaaaagacucaaauacauauucaucguuuuccagaaaagacaauucauaaucaaggagcucgaagaaaagaaaaacaaccucuacgcagaugccauuaaccuaagcaggggaaucuucgacgaaaaaccaacgaugauacccuucaagaagccaaacccagacgaguucgcaucaugguucgucgccucguaccaauacaacaacuaccagagcuucuacgaacucacgcccgauaucguagaacgcgacaagaagaagaaauacaaaaaccuccgagcaaucaacaaagucaaaauccaagacuacuaccuaaaacuuauggucgacacccuauaccaagacuuauucaaccaaccccuggacaaaagccuuuccgacuucuacgucucgaaggccgaacgcgagaagaucaaagcagacgcaaaggccuaccaaaaacuuaacgauuccucccucuggaacaaggucauacaccuuucccuccaaaauaaccgaaucaccgcgaacccuaagcucaaggacauaggaaaauacaaacgagcccuccaagacgagaagaucgccacacucuuaacguacgacgcccgaacauggaccuaugcgcuucaaaaaccugaaaaggagaacgagaacgacuacaaggaacuccacuauacagcgcucaacauggagcuccaggaauacgaaaaaguccggagcaaagaauuacugaaacagguucaggaauuggagaagaaaauacucgacaaauucuacgacuucuccaacaacgcaucacacccagaagacuuagagauugaagacaagaaagggaaacgccacccuaauuucaaacucuauaucacuaaagcucuccugaaaaacgaaagcgagaucauuaaccuagagaacaucgacauugagauauugcugaaauacuacgauuacaacacagaggaacucaaagagaaaauaaagaacauggaugaagaugaaaaagcaaagaucauaaacacaaaagaaaacuacaacaaaauuaccaauguucugaucaaaaaggcucugguccugauaauaauacgcaacaagauggcgcacaaccaauacccaccaaaauucauuuaugaccuggcuaaucgguucguccccaagaaagaagaggaguacuucgcgaccuacuucaacagaguguucgagaccaucacaaaagagcucugggaaaacaaagaaaagaaagacaaaacccaggucuag

SEQ ID NO: 11654 - RNA, 3468 nt, Artificial Sequence
  Cas13b variant__Flavobacterium sp.__WP_045968377.1__Cas13b
auggacaacaacauaaccgucgagaaaacggaacucggccuaggcauaaccuacaaccacgacaaggucgaagacaaacacuacuucggcgguuucuucaaccuugcccaaaacaacauagaccugguggcccaggaauuuaagaaacggcuccucauccagggcaaagacucuauaaacaucuucgccaacuacuuuuccgaccagugcagcaucaccaaccucgaacgcggaaucaaaauacucgccgaauacuucccugucgucagcuauauugaccuagacgaaaagaacaaaucgaaguccauccgagaacaccuaauauuacuguuagaaaccauaaacaaccuccggaacuacuauacgcacuacuaccacaagaagaucaucaucgacgggucccuauucccacuacuagacaccauccuauuaaaggucgugcuggaaaucaaaaagaagaaacugaaagaagacaaaacaaaacaacuccucaagaaagggcucgagaaagaaaugaccauacucuucaaccucaugaaagccgaacaaaaggaaaagaaaauaaaaggauggaacauagacgaaaacauaaaaggcgcagugcugaaccgcgcauucucacaccuccucuacaacgacgaacuaagcgacuaccgaaaauccaaauacaacacggaagaugaaacgcucaaagacacccucacggagagcgggauccucuuucucuuauccuucuuccuaaauaagaaagagcaagaacaacuaaaagcgaacaucaaaggauacaaaggcaagauagcaagcaucccggaugaagaaauaacgcucaagaacaacagccuacggaacauggcaacgcacuggacguauucacaccuaaccuauaaaggacucaaacaccggauaaagacagaccacgaaaaagagacgcuacucguaaacauggucgacuaccugagcaaagucccccacgaaaucuaucaaaaccucucagaacaaaacaaaucccucuuccuagaagacaucaacgaguacaugagagacaacgaggagaaccacgauagcagcgaggcaucccguguaauccaucccgucauacggaaaagauacgaaaacaaguucgccuacuucgccauccgcuuccuugacgaguucgccgaguuccccacacugcgcuucaugguaaacguaggcaacuacauccacgauaacagaaagaaagacauugguggcaccucucuaauaaccaaccgcacgauaaaacaacagaucaacgucuucggcaaccucaccgaaauccacaagaagaaaaacgacuacuucgaaaaagaagaaaauaaagagaaaacccucgaaugggaacuuuucccaaauccaucguaccauuuccaaaaagaaaacauccccauauucauagaucuagaaaaaucaaaagaaacgaacgaccuugcgaaagaauacgcaaaagagaagaagaaaaucuucgguuccucucggaagaaacagcagaacaccgcgaagaaaaaccgcgaaacgauaaucaaccuagucuucgacaaauacaaaacauccgaccgcaaaacagucacauucgaacaaccgaccgccuugcucuccuucaaugaacucaacucuuuccuuuacgccuuccuugucgaaaacaaaaccggcaaagaacuggagaaaaucauuauagagaaaaucgcgaaccaauaccagauacucaaaaacugcucaucuaccguugacaaaaccaacgacaacaucccaaaaagcaucaagaaaaucgucaacaccacuacggacuccuucuacuucgaaggcaagaaaauagacaucgaaaaacuugaaaaagacaucacaaucgaaaucgagaaaacaaacgaaaaacuggaaacgauaaaagaaaacgaagaaucggcgcaaaacuacaaacgcaacgagcgaaacacccaaaaacgaaagcuauaccguaaauacguauuuuucacuaacgaaaucggaauagaggcgaccuggauuaccaacgacauccuccgcuuccuagauaacaaagaaaacuggaaaggcuaccaacacagcgagcuccagaaauucauaagccaauaugacaacuacaaaaaggaagcgcuuggccuccucgagucagaguggaaccuagagagcgacgccuucuucgggcagaaccucaagcguauguuccaauccaacuccacauucgaaacauucuacaagaaauaccuggacaaccggaaaaauacacuggagaccuacuuaagugcgaucgaaaaccucaaaacaaugacggacgugcgacccaaagugcuaaagaagaaauggaccgaacucuuucgcuucuucgacaagaaaaucuaccuacuuucaacgaucgaaaccaaaaucaacgaacuaaucacgaaacccaucaaccucucccgcgggaucuucgaagaaaaacccaccuucaucaacgguaagaaccccaacaaagagaacaaccagcaccuuuucgccaacugguucauauaugccaaaaagcaaacaauccuccaagacuucuacaauuuacccuuggaacaacccaaagccaucaccaaccuaaagaaacauaaauacaaacucgaacggucaaucaacaauuugaaaauagaagacaucuacaucaaacaaaugguagacuuccuauaccagaaacuauucgagcaauccuucaucgguucccugcaagaccucuacacgucgaaagaaaagcgcgaaaucgaaaaaggcaaagccaaaaacgaacaaacgcccgacgaauccuuuaucuggaagaaacaagucgagaucaauacccacaacggacgcaucauagcaaaaaccaaaaucaaagacauuggcaaauucaaaaaccugcucacagacaacaaaaucgcgcaccuaauaucauacgacgaccgcauaugggacuucucacuaaacaacgacggcgacauaacaaagaaacucuacagcaucaacacagaacuagagagcuacgagaccauacgccgcgagaaauuacugaagcagauccagcaauucgaacaauuucuccucgagcaagaaaccgaauacucggccgaaaggaaacaccccgaaaaguucgagaaagauugcaacccgaacuucaaaaaguacaucauagaggguguccugaacaagaucauccccaaucacgaaaucgaggaaauagaaauccucaaaucgaaggaagacgucuuuaaaaucaacuucagugacauacugauccucaacaaugauaacaucaagaaagguuaccugcucaucaugauacgcaacaaauucgcccacaaccaauuaaucgacaaaaauuuguuuaauuucucacugcagcucuauuccaaaaacgaaaacgaaaacuucagcgaauaccucaauaagguaugccagaacaucauccaggaguucaaggaaaagcugaaauaa

SEQ ID NO: 11655 - RNA, 3480 nt, Artificial Sequence
  Cas13b variant__Myroides odoratimimus__EHO06562.1__Cas13b
augaaggacauccuaacaaccgauaccaccgaaaaacaaaaucgguucuacagccacaagauugcggacaaauauuucuucggagguuacuucaaccucgccucgaacaacaucuacgagguguuugaggaaguaaacaagcgcaacacauucggcaagcuggcaaaaagagacaacggcaaucucaaaaacuacaucauccacguauucaaggacgagcucagcauaucagacuucgaaaagcgaguggcaauauucgcgagcuacuuccccauccucgagacaguagacaagaagaguaucaaggagcgaaaucgcaccauugaccuaacauuaucccaacgaauccgccaguuccgcgagaugcugauaucauuaguaaccgccguugaucagcuccgcaauuucuacacccacuaccaccacucagacaucgucaucgaaaacaaaguacuagacuuccuaaauuccagcuucguauccaccgcccuccacgucaaagacaaauaccucaaaaccgacaagacaaaagaguuccuaaaagaaacaaucgccgcagaacuagacauccuuauagaagcguacaaaaagaagcaaaucgagaaaaagaacacucgguucaaagccaauaagcgggaagacauccuaaaugcuauauacaacgaagccuucugguccuucaucaacgacaaagacaaagacaaagauaaggagacaguaguugccaaaggagcggacgccuacuucgaaaagaaccaccacaaaucaaacgaccccgacuuugcacuaaacaucucagagaaaggcauaguauaccuccuuagcuucuuccuaacaaacaaggaaauggacucacuaaaggccaaccuaacuggcuucaaaggcaagguggaccgggaauccggcaauuccaucaaauacauggccacccaaagaaucuacagcuuccacaccuaccgcgggcuaaaacagaaaauacgcacaucagaagaaggcgugaaggaaacacuacuaaugcaaaugaucgacgagcuguccaaaguccccaacguagucuaccagcaccucaguacaacacagcaaaacucguucauagaggacuggaacgaauacuacaaagacuacgaagacgacgucgagaccgacgaucuaucgcgagugauucacccagucaucagaaagcgcuacgaagaccgauucaacuacuucgcaauccgauuccucgaugaguucuucgacuuccccacccuccgcuuucaaguucaccuuggagacuacguccacgaccggcgcaccaagcaacucggcaaggucgaaagcgaccggaucauaaaggaaaaagucacaguauucgcccgacucaaggacauaaacucagcgaaggcuuccuacuuccacucccuugaggaacaagacaaggaggaacucgacaacaaauggacacuguuccccaacccaucauacgauuucccaaaagaacacacccuccaacaccagggcgagcagaaaaaugcggguaaaauuggcaucuaugucaaauuacgcgacacacaauacaaggagaaggcagcccuugaggaggcccggaagucgcuaaaucccaaggaacgcuccgccacaaaagccagcaaguacgacauaauaacccagauuaucgaagcgaacgauaacguaaagucugagaaaccgcuagucuucacgggccaacccauagcauaccuaucuaugaacgacauccauaguaugcuauuuagccuucuuacggacaacgcugaacuaaagaaaacccccgaagaggucgaggccaaacucaucgaccaaaucggcaaacaaaucaacgaaauccugucuaaagacaccgacaccaaaauacucaagaaauacaaagacaacgaccucaaggagacagacacagauaagaucacaagggaucucgcgcgcgacaaagaggaaaucgaaaaacucauccucgagcagaaacagcgagcagacgauuacaacuauaccucgagcacuaaauucaacaucgacaaaagccgaaagcgcaaacaccuacucuucaacgccgaaaagggcaagauuggcguauggcucgccaacgauauaaagagauucauguucaaagagagcaaguccaaauggaaaggguaccaacacacagagcuacaaaaacucuucgccuacuucgacacaagcaaauccgaccucgaacuaauccuaucuaacauggugaugguaaaggacuauccaaucgaacucaucgaccuagucaagaaaucacgcacacuuguugacuuccucaacaaauaccucgaagcccgcuuggaauacauagagaacgucauaacucgagucaagaacagcauugggacgccccaauucaaaaccgucagaaaagagugcuuuacauuccucaagaaaagcaacuacacugucgugucccucgacaaacagguagagagaauccucucaaugccgcuauuuaucgaacgaggcuucauggacgacaaacccaccaugcucgagggaaaaagcuacaaacagcacaaggaaaaauucgcugacugguucguacacuacaaagaaaauuccaacuaccagaacuucuacgauacggaggucuacgaaauaacaaccgaagacaaacgcgagaaggcgaaaguaacaaagaaaaucaaacagcaacaaaagaacgacgucuuuacacucaugauggucaauuacaugcuugaagaaguacucaagcucuccagcaacgaccgauuaagccucaacgaacucuaccaaaccaaagaggaacgcaucgucaacaaacagguagcaaaagacacacaagagcgcaacaaaaacuacauauggaacaaagucgucgaccuccaacucugcgacgggcuaguccauaucgacaacgugaaguuaaaggacauaggcaacuuccgcaaauaugagaacgacucccgggucaaggaguuccuaaccuaccagagcgacaucguauggagcgcguaccucuccaacgaaguagacucuaacaaacuuuacgucaucgaaagacaacuagauaacuacgagagcauacgcuccaaagagcuacucaaggaagugcaagaaauagaaugcucgguguacaaccagguggcgaacaaagaaucccuaaaacaauccggcaacgaaaacuuuaagcaauacguacugcaagggcuccuaccaaucgggauggacguccgagagaugcucauccuauccacggacguaaaauucaagaaagaagagauuauacaacuaggacaagccggcgaagucgagcaagaccuuuacucacucauauacauccgaaacaaauucgcacacaaccaacugcccauuaaggaauuuuucgacuucugcgaaaacaacuacagaagcaucuccgacaacgaauacuacgcagaguacuacauggaaauauuccgcagcauaaaagaaaaauacgcgaacuaa

SEQ ID NO: 11656 - RNA, 3474 nt, Artificial Sequence
  Cas13b variant__Myroides odoratimimus__WP_006261414.1__Cas13b
augaaagacauacucaccaccgacacgacagagaagcagaacagguucuacagccacaagauagccgacaaauacuucuucggcggcuacuucaaccucgcuucaaacaacaucuacgaaguguuugaggaaguaaacaagagaaacaccuucggaaaacucgccaaacgcgacaacggaaaccucaagaacuacaucauccacguauucaaagacgagcugaguaucucugacuucgaaaaacgcgucgccaucuucgcgagcuacuuccccauacucgagaccgucgacaagaaaucgaucaaggaacggaaccggaccaucgacuuaacccuuucccaacgcauccgccaauuccgagaaaugcuaauaucgcucgugacagccguagaccaguugcggaacuucuacacacacuaccaccacucagagauugucauagaaaacaaaguccucgacuuccuaaacucgucucuagucuccaccgcacuccacgucaaggacaaauacuuaaaaacggacaagaccaaggaguuccuaaaggaaacaaucgcggcggaacucgauauacucaucgaagcguacaagaagaaacagaucgagaaaaagaacacacgcuucaaagccaacaaacgugaagacauccucaaugcaauauacaacgaagccuucuggucguucaucaacgacaaggacaaagacaaagaaacggucgucgcuaagggggcugacgccuacuucgagaaaaaucaccacaagagcaacgaccccgacuucgcacugaacaucucagagaaaggcaucgucuaccuacuuucguucuuucuaacaaacaaagaaauggacucucugaaggcgaaccucacuggcuucaagggaaaaguagaccgcgagucagguaacagcauuaaauacauggcgacccaacggaucuacucguuccauacauaccgagggcucaaacaaaagaucaggacuuccgaagagggcguuaaagagacacuccucaugcaaaugauagacgagcucagcaaagucccaaacgucguauaccaacaccugucuacaacccaacaaaacagcuucaucgaggauuggaacgaauacuauaaagacuacgaggacgacguagaaaccgaugaccuaucccggguaauucacccggucaucaggaaacgauaugaagaccgguucaacuacuucgcuauccgcuuccucgaugaguucuucgacuucccaacccuacgguuccaaguacaccuaggcgacuacguccacgaccgucgaaccaaacagcucggcaagguggaaagugaccgcauaaucaaagaaaaaguaacagucuucgcccgacuaaaagacauuaauagcgccaaagccaacuacuuccacucgcuggaagaacaagacaaagaggaacucgauaacaaauggacccucuucccaaacccaucguacgacuucccgaaagaacacacucuccaacaccagggagagcagaagaacgcaggcaaaaucgggauauacgucaaacuacgagacacccaguacaaagaaaaggccgcguuagaggaagcucgaaaaucgcuaaaccccaaagaacgcucagcaaccaaagcauccaaauacgacaucaucacccaaaucaucgaagcaaacgacaacguaaagagcgagaaaccauuagucuucacaggccaacccaucgccuaccucucgaugaacgacauucacucaaugcuauucucacuacucacagauaacgccgaacucaagaaaacccccgaggaaguggaggcaaaacuaauagaccaaaucggcaaacagaucaacgagauccuuucaaaagacacugacacaaaaauccugaagaaauacaaagauaacgaccucaaagagacugacacugacaaaauuacacgggaccucgcaagagacaaggaagagaucgaaaaacuaauccucgaacaaaaacaacgggcggacgacuacaacuacaccagcagcaccaaauucaacaucgacaagucccgaaagcgcaaacaccuucuuuucaacgccgaaaaaggcaaaaucggcguauggcuagccaacgacauaaagcgauucaugacagaagaguucaaaucgaaguggaagggcuaucaacacacugaacuccagaaacuguucgcauacuaugacacaagcaagagcgaccucgaccucauccugucggacaugguaaugguuaaagacuaccccaucgaacuuauagcauuggucaagaagucccgcacccucgucgacuucuugaacaaauaccucgaagcacgacucggcuacauggaaaacgucaucacacggguuaaaaacagcaucgguacgccccaauucaagaccguacgaaaagaaugcuucacguuccuaaagaaauccaacuacacagucgucuccuuagauaaacaagucgaaagaauccucucaaugccacuauucaucgaacgcggcuucauggaugacaaaccaacgaugcuagaaggaaaauccuaccaacaacacaaggaaaaauucgccgacugguucgugcacuacaaagaaaacuccaauuaccagaacuucuacgauaccgaagucuacgaaauaaccaccgaggacaaacgcgaaaaagcaaaggucacgaaaaagaucaagcaacagcagaaaaacgacguguucacacugaugauggucaacuacaugcucgaagagguacucaagcugagcuccaacgaccgacuaucccucaacgaacuuuaccaaaccaaggaagaacgaaucguaaacaaacaaguugccaaagacacgcaagaacgaaacaagaauuacaucuggaacaaaguugucgaccugcaacuaugcgaaggccuaguaagaauagacaagguaaaacuuaaggacaucggaaauuuccgcaaauacgagaacgacagccggguaaaggaguuccugacguaccaauccgacaucgucuggucggcauaccucagcaacgaagucgacagcaacaaacucuacguuauugagaggcaacucgacaacuacgaaagcauacgcagcaaagaacuccuaaaagaaguccaagaaaucgaauguagcgucuacaaccagguagcgaacaaagaaagccucaaacagucagggaaugaaaacuucaagcaguacguguugcaagggcucguaccaaucggaauggacguacgggagaugcugauacucagcaccgacgucaaauucaucaaggaagaaaucauccagcugggacaagcuggagaaguagagcaggaccuauacagccuaauauacauucgcaacaaauuugcccacaaucagcuaccgauaaaggaguuuuucgacuucugcgaaaacaacuacagaaguauaucagacaacgaauacuaugccgaauauuauauggaaaucuuccgcucaaucaaagaaaaguacaccagcuga

SEQ ID NO: 11657 - RNA, 3474 nt, Artificial Sequence
  Cas13b variant__Myroides odoratimimus__EKB06014.1__Cas13b
augaaagacauccucacaacggauacaacggaaaaacaaaaccgcuucuacucccacaaaauagcugacaaauacuucuuuggagguuacuucaaccucgcaagcaacaacaucuaugaagucuuugaagaagucaacaaacgcaacacguucgguaaacuggccaaacgagacaacggcaaccuaaagaacuacauaauccacgucuucaaagacgagcugucuaucagcgacuucgaaaagcggguggccaucuuugccuccuauuucccgauccucgaaacagucgacaaaaaguccaucaaagaacggaaccgcaccaucgaccucacccuaucacaaaggauccgacaauuccgggagaugcugauaucccucguaacugccguugaccaacugcgaaacuucuacacccacuaccaccacucagaaaucgugaucgagaacaaaguccuggacuuccucaacuccucucuagugagcacggcccuccacguuaaggacaaguaccucaaaacggacaaaaccaaagaguuccucaaagaaacaauugccgcagagcucgacauccuaauagaagcauacaaaaagaaacagaucgagaaaaagaauaccagguucaaagcaaacaagcgcgaagacauauuaaacgccaucuacaaugaagccuucuggucuuucauuaacgacaaggacaaagacaaggaaacagucgucgcgaaaggcgcggaugcguacuucgagaaaaaccaccacaagagcaacgaccccgacuucgcgcucaacaucagcgaaaagggcaucguauaccuccuuucauucuuccuuacaaacaaagaaauggacucgcucaaggccaaucucaccggauuuaagggcaaggucgaucgcgaauccggcaacagcaucaaguacauggccacccaaagaauauacucauuccacacguaccguggccuaaagcagaaaauccgcaccuccgaggaaggcguaaaagaaacccuucucaugcaaaugauagacgagcucucgaaaguccccaacgucguguaccaacaccuaaguaccacgcaacaaaacucauucaucgaagacuggaacgaguacuacaaggacuaugaagacgacgucgaaacugacgaccucucccgaguaauucaccccguaaucaggaagcgcuacgaagaccgcuucaacuacuucgcgauacguuuccucgaugaguucuucgauuucccaacacuccgauuccagguccaccucggcgacuaugugcacgaccgcaggacuaagcaacucggcaaaguagaaucagaccgcaucaucaaagaaaaagucaccguguuugcccgccuaaaggacaucaauucagccaaagcaucauacuuccacuccuuagaggaacaggacaaagaggaacuagacaacaaauggacacuuuuccccaaccccaguuacgacuucccaaaggagcacacccuccaacaccaaggcgaacaaaagaacgcuggaaagaucggaauauacgucaaauuacgagacacccaauacaaggagaaagcagcccuagaagaagccagaaaaagccucaacccaaaggaaagauccgcaacuaaagccucaaaauacgacauuaucacgcaaaucauagaagcaaacgacaacgucaaaucggaaaaaccccuggucuucacgggacaaccaaucgcauacuuaucaaugaacgacauccacucaaugcuguucucccuucuaaccgauaacgcagagcuaaagaaaacucccgaagaagucgaagcaaaacuaauagaucaaaucgggaaacaaauaaacgagauauuaagcaaagauaccgacaccaaaauccugaagaaauacaaagacaacgaccucaaagagacagacacagacaaaaucacccgggaucucgcucgcgacaaggaagaaaucgaaaaacucauacuugaacaaaaacaacgugcggacgacuacaacuauacauccuccaccaaguucaacauagacaaaucccggaagcggaagcaccuccucuucaacgcagaaaagggcaagaucggagucuggcucgccaacgacaucaagagauucauguucaaagaauccaaaagcaaauggaaaggauaucagcacaccgaacuccaaaaacucuucgccuacuucgacacauccaaguccgaccucgaacuaauccuaucugacaugguaaugguaaaggacuaccccaucgagcucaucgaccucgugcgcaaaagccgcaccuugguggauuuccucaacaaauaccuagaggcacgacugggcuacauagaaaacguaauaacgaggguaaagaacagcaucggaaccccacaauuuaagaccguccggaaagaaugcuucgcauuccuaaaggaaucgaacuacaccguggcaucacucgacaaacaaaucgaaagaauacuaucaaugccacucuucaucgaacgaggcuucauggauucaaaacccaccaugcuagagggcaaaagcuaccaacaacacaaggaagacuucgccgacugguucguccacuacaaagaaaacuccaauuaucagaacuucuacgacaccgaagucuacgaaauaaucacugaggacaaacgagagcaggcuaaagucaccaagaaaaucaaacagcagcagaagaacgacgucuucacacuaaugaugguaaacuacaugcucgaggaaguccuaaaacucccauccaacgaccggcuaucccucaacgagcuguaccaaacaaaggaggagcggauuguaaauaagcaaguggccaaagacacacaagaacgaaacaaaaauuacaucuggaacaaaguggucgaucuccaacuaugcgagggccucguccgaaucgacaaagucaaacuaaaggacauuggaaacuuccggaaauacgagaacgacagucgcgugaaagaguuccucacguaccaaucggacauugucugguccgguuaucuaagcaacgaagucgacuccaacaagcuauacguaaucgaacgccaacuagacaacuacgaaagcauccggagcaaggagcuccucaaagaggugcaagagauugagugcaucguauacaaccaaguggccaacaaagagucccucaagcaaucgggaaacgagaacuucaaacaauacguccuccagggccuacucccucgcggaacagacguccgcgaaaugcuuauccuauccacugaugucaaguucaagaaagaggaaauuaugcagcuaggacaaguucgugaggucgagcaagaccuuuacucccuaauauacauccgaaacaaauucgcacacaaccaguugcccauaaaggaguucuuugacuuuugcgaaaacaacuaccgcccaauaucggacaacgaauacuacgcagaauacuauauggaaaucuuccgcagcauuaaagaaaaauacgccagcuag

SEQ ID NO: 11658 - RNA, 3480 nt, Artificial Sequence
  Cas13b variant__Myroides odoratimimus__WP_058700060.1__Cas13b
augaaggauauacucaccacagauaccaccgaaaaacagaaccgcuucuauagccacaaaauugcagacaaauacuucuucggaggcuacuucaaccuugcaagcaacaacauauacgagguuuucgaagaaguaaacaaaagaaacacauucggcaaacucgccaaacgcgauaacggcaaccucaaaaacuacauaauccauguauuuaaggacgagcugagcauauccgauuucgagaagcgaguagcgauuuucgccuccuacuucccaauccuagagaccguggacaaaaagagcaucaaggaacgcaaccggacuauagaccugacccugucgcagcgcauccgccaauuucgcgagaugcuaaucucccugguaacggccgucgaucaacucaggaauuucuacacacauuaccaccauuccgauaucgucaucgagaacaagguccuggacuuccucaacucaucauuugucuccaccgcacugcacguaaaggacaaguaccuuaaaacagacaaaacaaaagaguuccuaaaagaaaccaucgcggccgaacucgacaucuuaaucgaagcauauaaaaagaaacaaaucgagaagaaaaauacacgcuuuaaagcaaauaaacgggaagacauccuaaacgcgauauacaaugaggcguucugguccuucaucaacgacaaggacaaagacaaagacaaagagacgguagucgcaaagggcgccgacgccuacuucgaaaagaaccaccacaaaucgaacgaccccgacuucgcacuaaacaucuccgaaaaaggaauagucuaccucuuauccuucuuccucaccaacaaagaaauggauucgcugaaggcaaaccugaccggcuuuaaaggcaaaguggaccgcgaaaguggaaacagcaucaaauacauggcgacacaacgcauuuacuccuuccauacguaccgaggccuaaaacagaaaauacggacaucugaagaaggcgucaaagaaacgcuacuaaugcaaaugaucgacgagcuaucaaaagucccgaacgucguauaccaacaccugagcacaacccaacagaacuccuucauagaggacuggaacgaguacuauaaagacuacgaggacgacgucgagaccgacgaccucagccgagugacccacccagucauccgcaaacgguacgaagacagauucaacuacuucgccauuagauuccuggacgaguucuucgacuuccccacauugcgauuccaaguccaccucggcgauuacguacacgaucgccggaccaaacaacuuggaaaaguagaauccgaccgcauaaucaaagaaaaggucacggucuucgcgcgacugaaagauauuaacuccgcuaaggcaaguuacuuccacucccuugaggagcaagacaaggaagaacucgacaacaaauggacccuauuccccaacccaagcuacgacuuccccaaggaacacacucuccaacaccaaggagagcagaaaaacgccggcaaaauagggaucuacgucaaacucagagacacacaauauaaagagaaggcagcccuggaagaagcccgcaaaucacuaaaucccaaagagaggucggcuacuaaagccagcaaauacgacauaaucacacaaauaaucgaagcgaacgacaacgucaagucagaaaaaccacucguguucacaggccaacccaucgccuaccuaagcaugaacgauauacacagcaugcuauucagccugcugaccgacaacgcagaacugaagaaaacccccgaagaaguggaagccaaacuaauagaccagaucggaaaacagauaaacgaaauacucagcaaagacaccgacacgaaaauccuaaagaaauacaaagacaacgaccucaaagagaccgacaccgacaaaaucacgcgcgaccucgcccgcgacaaggaggagauagaaaaauuaauucucgaacaaaaacaacgagcagacgacuauaacuacaccagcucgacgaaguucaauaucgacaagaguagaaaacgaaaacaccucuuguucaacgcagaaaagggcaaaaucggcguauggcucgcgaacgacauaaagagauucauguucaaagaauccaaaucgaaauggaaaggauaccaacacaucgaacuccaaaaacucuucgccuacuucgacacgucgaaaagcgaccuggagcugauccugucaaacauggucauggucaaagacuaucccaucgagcucaucgaccucguaaagaaguccagaacccucguagacuuccuaaacaaauaccucgaagcccgacucgaguacauugaaaacguaauaacacgggucaagaacagcauuggaaccccacaguuuaagaccguccgaaaagaaugcuucaccuuccugaaaaaguccaacuacaccgucguaucacucgauaagcaagucgaacgcauucucucaaugccacucuucaucgagcgaggcuucauggacgacaaaccgaccaugcucgaaggcaaguccuacaagcagcacaaagaaaaauucgcugacugguucgugcacuauaaagaaaacagcaacuaccaaaacuucuacgacacagagguauacgaaaucacaacagaagacaaacgggaaaaagccaaggucaccaaaaagauaaaacagcaacaaaagaacgacgucuucacucucaugauggucaacuacaugcuggaggaagugcugaagcuauccagcaaugaccgccuuagucugaacgaacucuaccaaacgaaagaggaacgcaucguaaacaaacaggucgcgaaggacacgcaggaaagaaauaaaaauuacaucuggaacaaagucgucgaccuccagcuaugcgacggacucgugcacaucgacaacguaaagcucaaggacaucggcaauuucagaaaguacgaaaacgacaguagggugaaagaguuccucacuuaccaguccgacauaguaugguccgccuaccucagcaacgaaguagacuccaacaagcucuauguaauagaaagacaacuugauaauuacgaauccauccguagcaaggaacuacuaaaggaaguccaagaaaucgaauguuccguauacaaccaaguggcgaacaaagaaagccuaaaacaguccgggaaugagaacuuuaaacaauacgugcugcaaggacuacuccccauaggcauggaugucagagagaugcucauccugucaacggacgucaaguuuaagaaagaggaaauaauccaacuaggccaggccggagagguggaacaagaccucuacucccucaucuauaucaggaacaaauuugcccacaaccaacucccuauaaaggaguucuucgauuucugcgaaaacaauuaccgaagcauauccgacaacgaauacuacgcagaauauuacauggaaauauuccgcuccaucaaagaaaaguacgcaaacuaa

SEQ ID NO: 11659 - RNA, 3465 nt, Artificial Sequence
  Cas13b variant__Paludibacter propionicigenes__WP_013446107.1__Cas13b
augaaaaccagugcaaauaacauauacuuuaacggaaucaacaguuucaagaaaaucuucgacagcaaaggagccaucgccccaaucgcagaaaaauccugccgcaacuucgacaucaaagcccagaacgacguaaacaaagaacaacgcauccacuacuucgcugugggacacaccuucaaacaacuagacacagaaaaccucuucgaauacguccucgacgaaaaccuaagggcgaagcgcccaacacgauucaucucccuccaacaguuugacaaagaguucauagaaaacaucaagcgacuaauauccgacauccgcaacaucaauucccacuacauucaccgguuugacccacucaagaucgacgccgugcccacgaacauaauagauuuccuaaaagaauccuucgaacucgccgucauucaaaucuaccucaaagaaaaaggcauaaacuaucuccaguuuuccgagaacccacacgcagaccaaaaacucgucgcauuccuacacgacaaauuccuaccacuugaugagaagaaaacguccaugcuccaaaacgagacuccacagcucaaggaauacaaagaauaccgaaaauacuucaaaacccuauccaaacaggccgcaaucgaccaacuccucuucgccgaaaaggagacagacuacaucuggaaccuguucgacucgcacccaguacucaccaucuccgccgguaaauaccucucuuucuauagcugccuuuuccuucuuuccauguuccucuacaaaucagaggcgaaucagcucauauccaaaaucaaagguuucaagaagaacacuaccgaagaggagaaaagcaaacgagaaaucuuuacauucuucucgaagcgcuucaacucgauggacaucgacagcgaagaaaaucaauuaguaaaguuccgagaccuaauacuauaccuuaaucacuacccagucgccuggaacaaagaccuagaacucgacucuagcaacccggcaaugacagacaaacugaagucgaagaucauugaacuggaaauuaaccgcagcuucccccucuacgaaggaaacgaacgguucgcaacauucgccaaauaccaaaucuggggcaagaaacaccucggaaaauccauugaaaaagaguacaucaacgcaucuuucacagacgaagaaauaacagcguacaccuacgaaacagacacaugccccgaacuaaaagacgcccauaagaaacuagcagaccucaaagcagcuaaaggacuauucggcaaacgcaaagagaagaacgaaucugacaucaagaaaacugagacaagcauaagagagcuccaacacgaaccaaacccaaucaaagacaaacucauccaacgaaucgagaaaaaccuacucacagucuccuacggacguaaucaagaccgcuucauggauuuuucagcccgauuucucgccgagaucaacuacuucggacaagacgcauccuucaaaauguaccauuuuuacgcaacggacgaacaaaacuccgagcuugaaaaauacgaacuccccaaagacaaaaagaaauacgacagccucaaauuccaucagggcaagcuaguccauuucaucucauacaaagaacacuuaaaacgcuacgaaucuugggacgaugcauucgucaucgaaaacaaugccauacagcucaaacuuuccuucgauggcguugaaaacaccguaacgauccagcgcgcgcugcucauuuacuuacuugaagacgcccucagaaacauccaaaauaacaccgcagagaaugccggcaagcaacuccuccaggaauauuacagccacaacaaagccgaccucucugccuucaaacagauccucacccagcaggacucgauagaaccgcaacagaaaaccgaauuuaagaaacuccuaccacgccgacuacuaaacaacuacuccccagcgaucaaucaccuacaaaccccacauagcucgcuaccccuaauccuagagaaagcccuccuagccgaaaaacgcuacugcucacuggucguuaaagcaaaagccgaaggcaacuacgacgauuucaucaaacgaaacaaaggcaagcaauuuaaacuccaauucaucaggaaagccuggaacuugauguacuuccgaaacucauaucugcagaacguacaagccgccgggcaccacaaguccuuucacaucgaacgggacgaguucaacgacuucucacgcuacauguucgcauucgaagaacucucccaauacaaguacuaccucaacgaaauguucgaaaagaaaggcuucuucgaaaacaacgaauuuaaaaucuuguuccaaagcggcacgucacucgaaaaccuguacgaaaagaccaaacaaaaguuugaaauuuggcucgccagcaauacagccaaaacuaacaaaccagacaacuaccaccuuaacaacuacgaacagcaauucucgaaccaacucuucuucaucaaccucagccacuucauaaacuaccucaaaucgaccgggaaacuacaaacagacgcaaacggccagaucauauacgaagcccuuaacaacguccaauaccucaucccagaauacuacuacacagacaaacccgaacggucggagagcaaauccggcaacaaacuauacaacaaacugaaagcaaccaaacuagaagacgcccuccuauacgagauggccaugugcuaccucaaagcggacaagcaaauugccgacaaagccaaacauccgaucacuaagcuccuaacgagugaugucgaguucaacaucaccaacaaggaaggaauccagcucuaccaucugcucguaccauucaagaaaauagacgccuuuauaggucuaaaaaugcacaaggaacaacaggacaagaagcacccaaccucauuccucgcuaacaucgucaacuaccucgaacucguaaagaacgacaaagacauacgcaagacuuacgaggccuucucgacaaaccccguaaagcguacccucaccuacgacgaccucgccaaaaucgacggacaccuaaucuccaaauccaucaaauuuaccaacgucacccuagagcuagaacgauacuucaucuucaaagagucccuuauaguaaagaaaggcaacaacauagacuuuaaauacaucaaaggccucagaaauuacuacaacaacgagaaaaagaaaaacgaaggcauucgaaauaaagcauuccacuucggaaucccagacuccaaaagcuaugaccaauuaauaagagacgcagaagucauguucaucgcaaacgaagugaagccaacccacgcuacaaaauauacagaccucaacaagcaacuccacacagucugcgacaagcuaauggaaacgguccacaacgacuacuucagcaaagaaggugauggcaaaaagaaacgggaagccgccggacaaaaauacuucgaaaacaucauaagcgcuaaauaa

SEQ ID NO: 11660 - RNA, 3396 nt, Artificial Sequence
  Cas13b variant__Phaeodactylibacter xiamenensis__WP_044218239.1__Cas13b
augaccaacacccccaagcgccgcacacuccaccgccacccaucuuacuucggugcauuccucaauaucgcccgccauaacgccuuuaugaucauggaacaccucuccacaaaauacgacauggaagacaagaacacccucgaugaggcgcaacuaccaaaugcaaaacuuuucggaugccuaaagaaacgcuacgggaaaccugaugucaccgaaggcgucucucgggaccuccgccgcuacuucccauuccuaaacuacccgcuauuccuccaccucgaaaaacagcaaaacgccgaacaggcagcuacauacgacaucaaccccgaagacauugaguucacccuuaagggcuucuuccgccugcuaaaucagaugcguaacaacuacucccacuacauaagcaacacagauuacggcaaauucgacaaacuaccaguucaagauaucuacgaggcugcaaucuuucgccuccuagaccguggaaagcacacuaagcgcuucgaugucuucgaaagcaagcacacccgacaccucgaaucaaacaacucggaauaccgcccacgcagcuuagcaaacagccccgaccacgagaauacagucgccuucgucaccugucucuuccuagaacgaaaauacgccuucccuuuccucucccgacucgacugcuuccguuccaccaacgacgcugccgaaggcgacccacucauccgaaaagccucacaugaaugcuacacaauguucugcugucgacugccccaacccaaacuugaauccucagacauacuacuggacauggugaacgaacucggccgcugccccagcgcccucuacaaccuacucagcgaggaagaccaagcccgguuucacaucaaacgcgaagagaucacaggauucgaagaagaccccgacgaagaacuagaacaggagaucguacucaaacgucauucugaccgauuccccuauuucgcgcuccgauacuuugacgacacagaggcuuuccagacgcuacgauucgacguauaccugggaagauggcgcaccaaacccgucuacaagaaacgaauauacggccaagaacgugaccgcguccugacccagagcauccgcaccuucacaagacucucacgccuccucccaauauaugagaacgucaaacacgacgccguccgccaaaaugaagaagacggcaaacugguaaaccccgacgucacaucccaguuccacaaauccuggauccaaaucgaauccgacgaccgagccuuccuaucagacaggauagaacacuucagcccccacuauaacuucggcgaccaggucaucggacuaaaauucauaaacccagaucgguacgccgcaauccaaaacguauucccaaaacuccccggggaagaaaagaaagacaaagacgcuaaacucgucaacgaaaccgccgacgcaaucaucuccacccacgaaauacggucccuauuccuguaccacuaucucucaaagaaaccuaucucagccggagaugaacgucgguucauccaaguugacacagagacauucauaaaacaguacaucgacaccaucaaacucuucuucgaagacaucaaauccggagaacuccaaccgauagcagauccacccaacuaccagaaaaacgaaccccuaccauacguucgaggcgacaaagagaaaacgcaagaagaaagagcacaauaccgggagaggcaaaaagaaauaaaggaacgucgcaaagaacuaaacaccuuacuccaaaaccgauacggccuaucaauccaguacauccccuccagacuacgagaguaccuucuaggauacaaaaagguacccuacgaaaaacucgcacuucaaaaacuuagggcccaaagaaaagaagucaagaaacguaucaaagacauagagaaaaugcgcaccccgcgaguuggcgaacaagccacguggcuugccgaagauauaguguuccuuacgcccccaaagaugcacacucccgaacgaaaaacuacaaaacacccccaaaaacuaaacaacgaccaguucagaaucaugcagucaucucuagcauauuucagcgucaacaagaaagccaucaagaaauuuuuccaaaaagaaacagggauuggccucuccaaccgagagacaucccaccccuuccucuaccgaaucgacguaggcagaugccgcggcauccucgacuuuuacacgggauaccuaaaauauaaaauggacuggcucgacgaugccauuaagaaagucgacaaccgaaaacacggcaagaaagaagcaaagaaauacgaaaaauacuuacccuccuccauacagcauaaaacaccccucgaacuagacuacacccgacugcccgucuaucugccacggggccuauuuaagaaagccaucgucaaagcucucgcagcccaugccgacuuucaagucgaacccgaagaagacaacgugaucuucugccuagaccaacuucuagacggggacacccaggauuucuacaauuggcaaagguauuaccgcagcgcccucaccgagaaagaaaccgacaaccaacucguacuagcgcacccauacgccgaacagauccucggcacaaucaaaacccucgaagguaaacagaagaacaacaagcucgguaauaaagcgaaacagaaaauaaaagaugaacugaucgaccuaaagcgggcaaaacguaggcuacuagaucgcgaacaauaccucagggcuguccaagcagaagacagagcacuguggcucaugauccaagaacgccaaaaacaaaaagcagagcacgaagagaucgcuuucgaccagcuagaccugaaaaacaucacaaaaauucuaacagaauccaucgacgcacggcuccggaucccagauacaaaaguagacauaaccgacaaacuaccacugcgcagguacggggacuuacgccgcguugcaaaggaccgccgcuuagucaaccucgcauccuacuaccacguugccggccucucggaaaucccguaugaccucguaaagaaagaauuagaagaguacgaccgccgacgcgucgcguucuucgagcauguguaccaguucgagaaagaggucuacgaucgcuacgcugcagagcuucgcaacgaaaaccccaaaggcgaaagcaccuacuuuucccacugggaauacguagccgucgccguuaaacacagcgcggacacccacuucaaugaacucuucaaagagaaagugaugcaacuccgcaacaaauuccaccauaacgaguuucccuacuucgacuggcuccuacccgagguagaaaaggcauccgcagcccuuuacgccgauaggguauucgacgucgccgaaggguauuaccaaaagaugcgcaagcucaugcgccaguag

SEQ ID NO: 11661 - RNA, 3408 nt, Artificial Sequence
  Cas13b variant__Porohyromonas gingivalis__WP_012458151.1__Cas13b
augaacacaguuccagccucagaaaacaaaggccaaucgcgcaccgucgaagacgacccccaauacuucggucuauaccugaaccuagcgcgcgagaaccucauagaagucgaaucacacguaagaaucaaauucggaaagaagaaacucaacgaagagucacucaagcaaucacuccucugcgaccaccuccuaucagucgaccgcuggacgaaggucuacggccacagccgcagauaccuccccuuccuucacuacuucgauccagacucucaaauagaaaaagaccaugacagcaaaacaggcgucgacccagacucugcccaacgacuaauccgcgaacuauauagccugcucgacuuccuccgcaacgacuucucacauaacagacucgacggcacaaccuucgaacaccuggaaguaucaccugacauaucgucguucauaacgggcacuuacucgcuggccugcggccgagcucagagcagauucgcaguauucuucaaaccggacgacuucguacucgcgaaaaacagaaaggaacaacucaucagcguggcagaugguaaagaaugccuaacggucucgggauuugcauucuuuauaugccuguuccucgaccgagagcaggcuuccggcaugcuauccagaauacgcggcuucaaacgaacugacgaaaacugggcccgagcaguccacgaaacuuucugugaccugugcauacggcacccacacgaccggcuggaaucauccaacaccaaagaggcccugcuccucgacaugcuaaaugaguugaaccgaugcccacgcauccucuacgacaugcucccggaagaagagagggcacaauuccucccggcacuggacgaaaacuccaugaacaaccugagcgaaaacucccucgacgaagaaucccgccuccucugggacggaucaucagauugggccgaagcacuaacuaagagaauacgccaccaagaccgcuucccauaccuuaugcuccgcuuuaucgaagagauggaccugcucaagggaauccgguuccggguagaccuaggugaaaucgaacucgacucauauucgaagaaaguaggccgaaacggcgaauacgaccggaccaucacggaccaugcgcuggcauucggaaaacucuccgacuuccaaaaugaagaagaggugucacgcaugauauccggcgaagcaucauaccccguccgcuucagccucuucgcccccagauacgcaauauacgacaacaaaauuggcuacugccacaccagcgaucccguauacccaaaauccaaaaccggcgaaaaacgugcacucagcaacccucagucaaugggcuuuauaagcgugcacgaccuccggaaacuacuccuuauggagcugcucugcgaaggcagcuucucaaggaugcaauccgacuuucugcggaaagcaaacagaauccuggacgagacagccgaaggaaaacugcaguucagcgcacuguuccccgaaaugcgacaccgcuucauuccaccacagaaccccaaaaguaaagacagacgggaaaaagccgagacaacccucgaaaaauacaaacaagaaauaaaaggccgcaaggacaaacuuaacagccaacuacuaagcgcguucgacauggaccaacggcaacugcccucccgccuucuagacgaauggaugaacaucaggcccgcgagccacagcguaaaacuccgcacuuacgugaagcaacuuaacgaagacugccgccuacgccuuaggaaauuccgcaaagacggcgacgggaaagcccgcgcaauuccgcuaguaggugaaauggcaacauuccucucacaagacaucguuagaaugaucauuagcgaagaaacuaagaaacucaucacauccgccuauuauaacgaaaugcagcgguccuuggcacaauacgccggcgaagaaaaccgccgacaguucagagccauaguagccgagcuacgccuacucgacccauccuccggccacccauuuuugucggccaccauggaaacagcacaccgcuacaccgagggauucuacaaaugcuaucuagaaaagaaacgcgaauggcuggccaaaaucuucuaccgaccugagcaagacgaaaacacgaagcgaagaaucagcguguucuucguaccagacggcgaggcccguaaacugcuaccccuacucauccgccgucgaaugaaggagcaaaacgacuuacaagacuggauacgcaauaaacaggcgcaccccaucgaccuccccucccaccucuucgacuccaaagucauggaacuccugaaagucaaggacggaaagaagaaauggaacgaggcguucaaagacugguggagcacaaaauacccagacggaaugcaaccguucuauggccuccgccgcgagcugaauauacacggaaaaagcguaagcuacauaccaagcgacgggaaaaaguucgccgauugcuacacccaccucauggagaaaacggucagagacaaaaagagagaacugagaacagcuggaaaaccgguacccccagaccuagcagcagacauaaaacguagcuuccacagagccguaaaugagcgagaguucaugcuccgccuaguccaagaagaugaccgacuaauguuaauggcaauaaacaaaaugaugaccgaccgagaagaagauauccucccaggccucaaaaacaucgacagcauacucgacgaagaaaaccaauucagccucgccguccacgccaaagugcuagagaaggaaggagaaggcggagacaacucgcuuucccuaguccccgccaccaucgagauaaagucaaaacgcaaggacuggagcaaguacauacguuaccgcuacgaccgccgaguccccggacucaugagucacuucccggaacacaaagcaacccuggacgaaguaaaaacccuccuaggugaauacgaccgcugccgcauuaaaaucuucgacugggccuucgcacuggaaggcgccaucaugucagaucgcgaccuaaagccguaccuccacgaaucaagcucaagagagggaaaaucaggagagcacagcacucuugugaaaaugcuggucgaaaagaaagggugcuuaacgcccgacgagucacaguaccuaauccucaucagaaacaaagccgcacacaaucaauuccccugcgcagcagaaaugccacuaaucuaccgcgacguauccgccaaagucggcagcauagaagguuccagugccaaagaccuacccgaaggaucaucacugguagacagccuguggaagaaauacgaaaugauaaucagaaaaauccuccccauacucgacccggaaaaucgauuuuucggcaagcuacuaaacaacaugucccaacccaucaacgaccuauaa

SEQ ID NO: 11662 - RNA, 3408 nt, Artificial Sequence
  Cas13b variant__Porohyromonas gingivalis__ERJ81987.1__Cas13b
augaauaccguacccgccucggaaaacaaaggccagagcagaaccguagaggacgacccccaauauuucggacuauacuuaaaucucgcccgggagaacuuaaucgaagucgaaucccacguccgaaucaaguucggcaaaaagaaacuaaacgaggaguccuuaaagcaaucccuucucugcgaccaccuccucuccguagaucgcuggaccaaagucuacggacacucacgacgcuaccuacccuuccuucacuacuucgaccccgacucgcaaaucgagaaagaccacgacuccaaaacaggcgucgacccggacagcgcccagagacucauccgagaacuauacucucuacucgacuuccuucgaaacgacuucagccauaaccgacucgacggaacgacguucgaacaccucgaaguaucccccgacaucuccuccuucauaaccggcacguauucgcuagccugcggccgagcacagagccguuuugcggauuucuucaaaccggacgacuucguccucgccaagaaccgaaaagagcagcucauaucagucgcugacggaaaggagugccuaaccguaucagguuuagcauucuuuaucugccucuucuuagaccgugaacaggcuuccggcaugcuaucacgcauucgcggguucaaacgcacagacgaaaauugggcacgcgccgugcacgaaacuuucugcgaccucugcaucagacacccccacgaccggcuggaaagcagcaacacaaaagaagcccuccuccucgauaugcuuaacgaacuaaaccgcugucccagaauacucuacgacaugcucccggaagaagagagagcacaauuccucccagcccucgacgagaacucuaugaacaaccucagcgaaaacucccucaaugaagagagccgauuacucugggacggaucaagcgacugggcagaagcgcuaaccaaaaggaucagacaccaagaccgcuuccccuaccuaaugcuucgauucaucgaggaaauggaccugcucaaagggauucguuuccgaguagacuugggcgaaauugaacucgacuccuacagcaagaaaguuggccgcaacggcgaauacgaccggacaaucaccgaccacgcccucgccuucggcaaauuaucagacuuccagaacgaagaagagguauccagaaugaucucgggcgaagcguccuaccccguacgcuuuucccucuucgcuccgcguuacgcaauauaugacaacaaaaucggcuacugccacacgagcgacccaguauauccuaaaucuaaaacgggcgaaaaacgagcacucuccaacccccaaucuauggguuucauauccguccacgacuuacgcaaacuucuacucauggaacuccuaugcgaaggcucguucucacgcaugcaguccggauuccuccgaaaagccaaccgaauacuagacgagacagccgaaggcaaacuacaguuuuccgcccuauuccccgaaaugcgccaccgcuucaucccaccacaaaacccaaaaucgaaagaccgacgugaaaaagcagagaccacacuggagaaauauaaacaagaaaucaagggccguaaggacaaacucaauucccaacuccuuucagcauucgacaugaaccagcgacagcuccccagccgucuacuagacgaauggaugaacauccgccccgcaucacacuccgugaaacuucguaccuacguuaaacaauuaaacgaagacugcagacuacgccuacggaaauuccguaaagacggcgacggcaaggcccgcgccauaccgcuugugggugaaauggccacauuccuaucacaggacauagucagaaugaucaucagcgaagaaacuaagaagcucaucacuagcgcauacuacaacgagaugcaacgcucgcuagcucaauacgccggugaggaaaaccgacgccaauuccgcgcgauagucgcagaacugcaccuccuugaccccuccagcggacaccccuuccuaucggccaccauggaaaccgcccaccgcuacaccgaggacuucuacaaaugcuaccuagagaaaaagcgcgaauggcucgcuaagacguucuaccgcccggaacaagaugaaaacaccaagcgccgcaucuccguauucuucguccccgacggcgaagcccgcaaacuccucccccuacucauuaggcgcagaaugaaagaacagaacgaccuacaagauuggauccgcaauaaacaggcacaccccauugaccugcccagccaccuauucgacagcaaaaucauggaauuacucaaagucaaagauggcaaaaagaaauggaacgaagcguuuaaagacugguggucaacaaaauaccccgacggcaugcaaccauucuacggccugcgacgcgaacucaacauucauggaaaaucaguaucauacauccccuccgacgggaaaaaguucgccgacugcuacacccaccucauggagaaaacuguccaagacaagaaacgcgaauuacgcacagcuggaaaacccguucccccggaucucgcugccgacaucaaacgcuccuuccaccgggcagucaacgaacgugaguucaugcuacgccucguccaagaagacgaccgucugaugcuuauggccauaaacaagaugaugaccgaccgcgaagaagacaucuuacccggucucaaaaauauagacuccauccuagacgaagaaaaccaguucagccuugccguccacgccaaaguacucgaaaaagaaggagaaggaggcgauaacucacucucacucguaccggcuaccaucgagauaaaaaguaaacgaaaagacugguccaaauacauucgauaccgcuacgaccgacgagucccaggcuuaaugucccacuucccggaacacaaagcaacccuagacgaagugaaaacauuacucggggaauaugaccgcugccgaauaaagauauucgacugggccuucgcccucgaaggcgccauaauguccgaucgcgaccuuaaaccguaccuucacgaaucauccagccgagaaggaaaaucaggcgaacacucgacccuagucaagaugcuugucgaaaagaaaggcuguuugacucccgaugaaucucaauaucucauacucauacgcaacaaagccgcucacaaccaauuccccugcgccgccgaaaugccgcucaucuaccgggacguaucagccaaagucggcucgaucgagggcucuagcgcaaaagaucuaccugagggauccucccuugucgacucccucuggaaaaaguacgaaaugaucauucgaaaaauccuccccauccuggaccacgaaaaccgcuucuucggaaaacuacucaacaacaugucccagcccaucaacgaccucuaa

SEQ ID NO: 11663 - RNA, 3408 nt, Artificial Sequence
  Cas13b variant__Porohyromonas gingivalis__ERJ65637.1__Cas13b
augaacacagucccagcaagcgaaaacaaaggccagagcagaaccguggaggacgacccucaguacuucggccucuaucuaaaccuagcaagagaaaaccuuauagaaguagaaagccauguccgaauuaaauucggaaagaagaaacugaacgaagaaagccuaaaacaaucauuauuaugcgaccaccuccucuccgucgaccgauggaccaaagucuacggacauucccgaagguacuuaccauuccuccacuacuucgacccagacucccaaaucgagaaagaccaugacagcaaaacgggaguggacccagacucagcacagcgccuuaucagagagcucuauucccuauuggacuuccucagaaacgacuuuucgcacaaccgccucgacggcaccacguucgaacaccuagaaguuucuccagauaucuccuccuucaucacagggacauacucacucgccugcggacgagcacaaagccgcuucgcugacuucuuuaaacccgacgacuuuguccuagccaaaaaucgcaaagaacaacucauaagcguggcggacggaaaagaaugucucaccgucucuggacucgcauucuucaucugccuauuccucgauagagaacaagccuccggcaugcucucacgcaucagaggauucaaacgcaccgacgagaauugggcacgcgcaguacacgaaaccuucugcgaccuuugcauacggcacccccacgaccgacucgagucauccaacaccaaagaagcccuucugcuagauaugcuaaacgagcugaaccgcugcccccgcauccuauacgacaugcuccccgaagaggaaagagcccaauucuugccagcccuagacgaaaauucgaugaacaaccucuccgaaaacucacuuaaugaggaaagccgccugcuaugggacggcuccagcgacugggccgaagcccucacuaaacgaaucagacaccaagaccgauucccguaccucauguuacguuucaucgaagagauggaccuacucaaaggaauccguuucagaguagaccucggcgaaaucgagcucgacagcuacucgaagaaaguaggccgaaacggcgaauacgacagaacaaucacagaucacgcucucgccuucgguaaacucucggauuuucaaaacgaagaagaagucuccagaaugaucagcggcgaagcaucauaccccguccgauucagccucuucgcgccccgcuacgccaucuacgauaacaaaaucggcuauugccauaccucggaccccgucuaccccaaaucaaaaaccggcgagaaacgagcacucucaaacccacggucaaugggcuuuaucagcguccacgaucuacguaaacuucugcucauggaacuccucugugaaggcucauuuucccgaaugcaaucagacuucuuacgcaaagccaaccgcauucuggacgaaaccgcggaaggcaaacuccaauucucagcgcuauucccagagaugcgccacagauucauacccccacagaacccgaaaagcaaagaccgccgugagaaggcagaaacaacgcucgaaaaauauaagcaggagaucaagggacgcaaagacaaacugaacucucaacuccuguccgccuuugacauggaccaaaggcaacucccgucacgccuacuggacgaauggaugaacauaaggccugcaucacacuccgucaaauugcgcaccuacgucaaacaacucaacgaagacugccggcuaagacuccagaaauuccguaaagacggcgacggcaaagcccgcgcgaucccacugguaggcgaaauggcuaccuuccucucacaagacauuguacgcaugauaaucagcgaagaaaccaagaaacucauaacuagcgccuacuacaacgaaaugcagcgcucccucgcccaguacgcgggcgaggagaacaggcaccaauuccgagcaauagucgcagaacuaaggcuacucgacccguccuccgggcaccccuuccuuagcgccaccauggaaaccgcucaccgcuauacagaagacuucuacaaaugcuaccuugagaaaaagagagaauggcucgccaagaccuucuacaggcccgaacaagacgaaaacacaaaacgaagaauaagcguguuuuucguacccgacggcgaggcccgaaagcuacucccccuccugauccgucgccgcaugaaagaacaaaacgaccuccaagacuggauacgcaacaaacaggcacacccuauugaccucccaucacaccuuuucgacucaaagaucauggaacuccugaaagucaaggacggcaaaaagaaauggaacgaagccuucaaagacuggugguccacaaaauaccccgacgggaugcagccuuucuacggacucagacgugaacucaauauacacggcaaaagcgucuccuacaucccaagugacgguaagaaauucgcagauugcuacacccaccuaauggagaaaacgguccaagacaagaaacgcgaauuacgcaccgccgggaaacccgucccacccgaccucgccgccgacaucaaacgaucauuccacagggccguaaaugaaagagaguucaugcuacgccuuguccaagaagacgauaggcuuaugcucauggccaucaacaaaaugaugacagaccgcgaagaagacauccugcccggacucaaaaacaucgacucaauccuagacgaagaaaaccaauucucccucgcuguccacgcuaaaguacuagaaaaagaaggcgaaggaggggacaacucacucagccugguacccgcuacgaucgaaauaaaaagcaagcgcaaagacugguccaaauacauacgcuaccgcuacgaccgaagaguccccggccuaaugagucauuuccccgaacacaaggccacccucgacgaagucaagacccugcuaggggaguacgacaggugccgcauaaagaucuucgacugggccuucgcccucgagggcgcuauaauguccgaccgagaccucaaaccauaccuccacgaaagcuccucacgagaaggcaaauccggagagcacucaacccucguaaagaugcuagucgaaaagaaaggcugccuaacccccgaugaaucccaguacuugauccucauacgcaacaaagccgcacacaaccaguucccgugcgccgccgagaugccccuaaucuaccgcgacguaagcgcgaaaguaggcucaauagaaggcucguccgcgaaagaccugcccgaaggcuccagccucguagacucucucuggaagaaauacgaaaugauaauacgcaaaauccuccccauccuggacccagagaaccgauucuucggcaaacuacucaacaacaugucccagccgaucaacgaccucuaa

SEQ ID NO: 11664 - RNA, 3408 nt, Artificial Sequence
  Cas13b variant__Porohyromonas gingivalis__WP_021665475.1__Cas13b
augaacaccgugcccgcauccgaaaacaaaggacaaagccgcaccguugaagacgauccacaauacuucggacuauaccucaaccucgcacgcgaaaacuuaaucgaagucgaaucccacguccgcauaaaauucggcaaaaagaaacuaaacgaagaaagccuaaaacagagucuucuuugcgaccaucuacuuagcgucgaccgcuggacaaaagucuacggucauuccagacgcuaucuaccuuuccuccacuacuucgacccggauucacaaaucgaaaaagaucacgacagcaaaaccggcguggaccccgacucagcccagcgacucaucagagaacuuuauucgcuucucgacuucuuacgcaacgacuucucccauaaccgacuggacggcaccaccuucgaacaccucgaaguauccccggauaucagcuccuucauaaccggaacauauagucucgcuugcgggcgcgcccaaucgcgauucgcggacuucuucaagccagacgacuuugugcucgcaaagaaccggaaagaacaacucaucagcguagccgacggaaaagaaugccugaccgucagcggccucgccuucuucaucugccucuuccucgaccgcgagcaggccucaggaaugcuuucucgaauccggggcuucaaaagaaccaacgaaaauugggcgagagcaguccacgaaaccuucugcgaccuaugcauccggcacccccacgaucggcuggagagcucaaacacgaaagaagcccuccucuuagacauguugaacgaacugaaucgcugcccccgaauuuuauacgacaugcuacccgaggaagagagggcccaauuccuccccgcgcuggacgaaaauucgaugaacaaccucagcgaaaauucuuuaaacgaagagucaaggcuacucugggacggaagcagugauugggccgaagcacucacgaagcgaauacgacaccaggaccgauucccauaucucaugcuacgauucaucgaagaaauggaccuccuaaaaggaauccgauuccgcgucgaccuaggcgagaucgagcucgacuccuauuccaagaaagucggacgcaacggcgaauacgaccguacaaucacugaccacgcgcuagcauucggcaaacugucagauuuccaaaacgaagaagaagucagccgcaugaucucaggcgaagccagcuaccccguaagauucucgcuauucgcgccacgauacgccauauaugacaauaaaaucggguacugccacaccuccgaccccgucuacccaaaaagcaaaaccggggagaaacgggcauuguccaauccgcaaagcaugggcuuuauuucugugcaugaccuacgcaagcucuugcuuauggagcuccuaugcgaaggcagcuucucccggaugcagagcggcuuccuucgcaaagccaaccgcauccucgaugaaaccgccgaagguaaacuccaguuuuccgccuuguuccccgagaugcgccaccgauucauacccccacaaaaccccaagucuaaggaccgaagagagaaagcugaaacgacacucgaaaaguacaaacaggaaaucaaagggcgcaaagacaaacugaacucacagcuacuaucugccuucgacaugaaucaacgacaacuccccucgcgacuucucgacgaauggaugaacauacgaccagcaucccauucagucaaacuccgaacauacguuaaacaacuaaacgaagacugccgccuccgccuuagaaaguuccgcaaagacggcgauggcaaagcccgugccauaccccuaguaggcgaaauggccacauuccucucacaagacaucguaagaaugauaaucuccgaagaaaccaagaaacucaucacguccgcauacuacaaugagaugcaacgaucacucgcacaguacgcaggagaggaaaacagacgacaguuccgcgccaucgucgccgaacuccaucuacuugacccaucaagcggacaucccuuucucucugccaccauggaaacagcacaccgauacaccgaagacuucuacaaaugcuaccuggagaaaaagcgcgaauggcucgccaagaccuucuaccgcccagaacaagacgaaaacaccaaaaggcgaaucucugucuuuuucgucccagacggcgaagcucgaaaauuacugccccuccucauccgucgccgaaugaaggagcaaaacgaccuacaggacuggauucgaaacaaacaagcccacccaauagaucuacccagccaccucuucgacuccaaaaucauggaacuucucaaaguaaaggaugggaaaaagaaauggaacgaggcuuucaaagacugguggagcacgaaauaucccgacggcaugcaacccuucuacggacuccgccgcgaacucaauauacacgggaaaucaguauccuacauacccuccgacgggaagaaauucgcggacugcuacacacaccugauggagaaaaccguccaagacaagaaacgugaacuacgcaccgccggcaaaccagucccacccgaccucgcagcugacauaaaaagaucuuuccaccgagcggucaacgaacgcgaguucaugcuccgacuggugcaagaggacgaccgccuaaugcucauggccaucaacaaaaugaugacggaccgcgaagaagacauucucccaggacucaaaaacauagacuccauacuagacaaagaaaaccaauuuucccuagccguucaugccaagguacucgaaaaagaaggugaaggcggcgacaauucacuaagccucguaccggcuaccaucgagaucaagucgaaacgcaaagacuggagcaaguacauuagauaucgauacgaccgccgcguucccggacuuaugucccacuucccagagcacaaagcaacucucgacgaaguaaaaacgcuccucggcgaauacgaccgaugcaggaucaagaucuucgacugggccuuugcacucgagggcgccauaauguccgaccgagaccuaaagccguaccuccacgagucauccucgcgagaagggaaaucgggcgagcacuccacucucgucaagaugcucguggaaaagaaaggaugccucaccccagaugagagccaauaccucauccugauacggaacaaagcggcccacaaccaauuccccugcgccgcugaaaugccacugaucuaccgagacgucagcgcaaaaguaggaucaauugaaggcuccuccgccaaagacuuacccgaaggaagcagccugguugacagccucuggaagaaauacgaaaugauaauacgcaaaauccuuccaauucuagaccacgagaaccgcuucuucggcaaacuccucaacaacaugucucaacccaucaacgaucuauaa

SEQ ID NO: 11665 - RNA, 3408 nt, Artificial Sequence
  Cas13b variant__Porohyromonas gingivalis__WP_061156637.1__Cas13b
augaacacgguuccggccucagaaaauaaaggccaaucacgcaccguagaagacgacccucaauacuucggucuauaccucaaccucgcucgcgaaaaccucaucgaagucgaaucacacgugcggaucaaauucgggaaaaagaaacuaaacgaagaaagucugaaacagucccuccucugcgaccaccuacugucgguagaccgauggacaaaagucuacggccacucacgccgcuaccucccauuccuccacuacuucgauccagacucccaaauagagaaagaccacgacucgaagaccggcguagaccccgacuccgcccaaagacucauccgugaacuauacucccuucuagacuuucuccgcaacgacuucucacacaaccgacucgacggaaccaccuucgagcaccucgaagucucaccagacauauccagcuucauuaccggcacauacuccuuagccugcggacgcgcacaaucacgguucgcagacuucuucaaaccagacgacuucguacuagcgaagaaccgcaaggaacagcucaucagcgucgccgacggcaaagagugccuaaccgucucaggccucgccuucuucauaugucucuuccuggaccgagaacaagcaucuggaaugcugucucgaauccgaggcuuuaaacggacggacgaaaauugggcucgcgcuguccacgaaacauucugcgaccuuugcaucagacauccucacgaccgccucgaguccagcaacaccaaagaagcacuacugcuagacaugcucaacgaacuaaauaggugcccccgaauacucuacgacaugcugcccgaggaggaacgcgcccaguuucuaccggcgcuggacgagaacucuaugaacaaccuaagcgaaaacucucuaaaugaagagucccgacuccuaugggacggcagcuccgauugggcugaagcccuuacaaaaagaaucagacaccaggaccgguucccguacuugaugcuucgcuucaucgaagaaauggaccugcucaaaggaauuagauuccguguagaccugggcgaaaucgagcuagacaguuacuccaaaaaggucggacgcaacggcgaauacgaccgcacaaucacagaccacgcccuagccuucggcaaacuaagcgacuuccagaacgaagaagaagucuccagaaugauaucuggcgaggccucuuaccccguccgcuucucacuauucgcaccacgauacgcgauauacgacaacaaaauaggauacugccacacauccgacccaguguaccccaaauccaagaccggagagaagagggcgcucuccaacccucaaucgaugggcuucaucucgguccaugacuuacgcaaacuccuccucauggaacuacucugcgaagggucguuuucccgcaugcaauccggcuuccucagaaaagccaaccgcauucucgacgagacagcggaaggaaaacuucaauucagcgcccuuuucccagagaugcgccaccgauucaucccgccccaaaaccccaaaucaaaagaucgacgcgaaaaagcggaaacaacacucgaaaaauacaaacaagaaaucaaaggucgcaaggacaaacucaacucacaacugcuaucugcuuuugacaugaaccagagacaacuccccucccgacuucucgacgaauggaugaacauccgaccugccagccacagcgugaaacuucgaaccuacguaaagcaacuaaacgaagauugucgccuacgacuccgcaaauuccgaaaggacggcgacgggaaggcacgagcgauaccacuugucggagagauggccacauuccugucgcaggauaucguccgcaugauaauuuccgaagaaacuaaaaagcugaucacaucagccuacuacaacgaaaugcaacggucacuagcccaauacgcgggcgaggagaaccgaaggcaauuucgcgcuauagucgccgaacuacaccuccuagacccauccucgggacacccauuucucuccgcgacaauggaaacagcccaccgguacacagaagacuucuacaaaugcuaccucgaaaagaaacgagaauggcucgcaaaaacauucuaccggccugaacaagacgaaaacacaaaacgaagaaucuccguauucuucgucccggacggugaggccagaaaacuccuaccccucuuaauucgcagacgcaugaaagaacaaaacgaccuccaagacuggauacgaaauaaacaagcucacccaauugaccuacccagccaccuauucgacagcaagaucauggaacugcuaaaaguaaaggacggcaaaaagaaauggaacgaagccuucaaagacuggugguccacaaaauauccugacggcaugcaacccuucuacggccucagacgcgaacuaaacauacacggaaagucagucuccuacauccccucagacggcaagaaguucgccgauugcuacacgcaucuaauggaaaagacaguccaagauaaaaagcgagaacuccgaaccgcggggaaacccguacccccggaucuugccgcugacauaaaacggaguuuucaccgugccgucaacgaacgcgaguucaugcuacggcugguccaagaggacgaccgccucaugcucauggcgauuaacaagaugaugacagacagagaagaagacauccuaccaggacucaaaaacaucgacuccauccuagacaaggagaaccaauucagccucgcuguccacgcuaaaguccuagagaaagagggcgagggaggcgacaacagcuuaucccucgucccagccaccauagaaaucaaauccaaacggaaagacugguccaaauacauccgauaucgcuacgaucgacgcguccccggccucaugagccacuucccagaacacaaagcgacgcucgaugaagugaaaacacuccucggagaauacgaccguugcagaaucaaaaucuucgacugggcuuucgcgcuagagggggcaaucauguccgaccgagaccuaaaaccauaccugcacgaaucaucaucccgggaaggaaagagcggcgaacacucgacccuggucaagaugcucguagaaaagaaggggugucuaacgcccgacgaaucgcaauaccuaauucuaauccgaaacaaagcugcacacaaccaguucccaugcgccgcggagaugccguugaucuaccgggacguaagcgcaaaaguuggcuccaucgaaggauccucggccaaagaucuaccagaaggcuccucucucguagacucacucuggaagaaauacgagaugaucaucagaaaaauacuaccaauccucgauccagagaacagguucuucggaaaacuccuaaauaacaugucccaacccauuaacgaccuuuga

SEQ ID NO: 11666 - RNA, 3408 nt, Artificial Sequence
  Cas13b variant__Porohyromonas gingivalis__WP_023846767.1__Cas13b
augaacacagucccagccuccgagaauaaaggccaaagccgcacaguagaagaugacccgcaauacuucggccucuaucuaaaccuagcaagagaaaacuuaaucgagguagagucccacguacgaauaaaguucggcaagaagaaacucaacgaagagucacucaaacaaucccugcuuugcgaccaccuacucucagucgaccgcuggacuaagguauacggacacuccagacgguaccuucccuuccugcauuacuuugacccagacagccaaauugaaaaggaccacgauuccaaaaccggcgucgacccagauagcgcacaacgucucauacgcgaacuauacucacuacuugauuuucuccgaaacgacuucucucacaaccgcuuagacggcaccaccuucgaacaccuagaaguaagcccagacauuucuagcuucaucacgggaacuuacucccuagccugcggacgugcacaaucacgauucgcagacuucuucaaaccagaugacuucguacuggccaaaaaccgaaaagaacagcuaauuucagucgcagacggcaaagaaugccugacgguaagcggacucgccuucuucaucugccucuuccuagaucgcgaacaggccuccgguaugcuaucgcgcauaagagguuucaaacggacggacgaaaacugggcccgcgcagugcacgagaccuucugugaccuuugcauaaggcacccacacgaccgauuagaaagcuccaacacaaaagaagcccuccuacuagacaugcugaacgagcucaaucgcugcccucgcauauuguacgacaugcucccggaagaggagcgugcccaauuucuccccgcccuggacgaaaauucgaugaacaaccuaucugaaaauucacucaaugaggagucaagacuccuuugggacggcuccucggacugggccgaggcgcucaccaaacgcauacgccaccaagaccgcuuucccuaccuaaugcuacgcuucauagaagaaauggaccuccucaaagggaucagauuucgggucgaccuaggggaaauugagcuugauuccuacagcaagaaagucggucggaacggugaguacgaccgaaccaucacagaccaugcccuagccuucgggaaacuuagcgacuuccagaacgaggaggaggucucccgcaugaucucuggagaggcgucuuaccccguucguuucucacucuucgcuccccgcuacgccaucuacgacaacaaaaucggauacugccacaccuccgaucccguauacccaaaaucuaaaaccggcgaaaaacgagcacucuccaacccacgcagcaugggcuucauauccguacaugaccuuaggaaacuccuccuuauggaacuccuaugcgaaggcucauuuagccgaaugcaaucagauuuccuccgcaaagcgaaccgcauucuugaugaaaccgcagaggggaaauugcaauucuccgccuuauuccccgagaugcgucacagguucauaccaccacaaaaccccaagucaaaagaccgccgcgaaaaagccgaaacaacccuagagaaguacaagcaagaaauaaaaggucggaaagauaagcucaacucccagcuacugagugcuuucgacaugaaccaacgccaacuacccucacgccuacuggaugaauggaugaacauccgccccgcgucccacagcguaaaacuccgaaccuacguaaagcaacucaaugaagacugccgguugcgacuuagaaaauuccgcaaagacggcgacggcaaagcucgcgccaucccacugguaggggagauggccaccuuccucagccaagacauaguccgcaugaucaucuccgaggagaccaaaaagcucauaaccagcgcauacuacaacgaaaugcagcgcagucuagcccaauacgcgggggaagagaacagacgacaauuccgcgccauagucgccgaacuccaccuccuagaccccuccagcggacaccccuuccugagcgcgacaauggaaaccgcccaccgauacaccgaagacuucuacaaaugcuacuuggaaaagaaacgugaauggcuagcgaaaacauucuaccgccccgaacaagacgaaaacaccaagcgccgaauuagcgucuucuucguacccgacggggaagcccgaaaacugcuacccuuacugauccgucgccguaugaaagaacaaaacgaccuccaagacuggaucagaaacaaacaggcacaccccaucgaucucccaucccaccucuucgacucgaagaucauggagcuacugaaagucaaggacggaaagaaaaaguggaacgaagccuucaaagacugguggucaaccaaauaccccgacgggaugcagccauucuacggccugcgaagagaacucaacauacacggaaaauccguguccuacauacccucagacggcaaaaaguucgcugacugcuacacccacuuaauggaaaagacuguccaagacaagaaacgcgaacuacgcaccgcaggcaaacccguacccccugaccuggcagccgacauaaaacgauccuuccaccgagcagucaacgagcgcgaguucaugcugcgguuaguacaagaagacgaucgucuaaugcugauggcaaucaacaaaaugaugaccgaccgcgaagaagacauccuucccgggcuuaaaaacauagacagcauccucgacgaggaaaaccaauucagccucgcaguacacgccaaaguacuugaaaaagagggggaaggcggcgauaacagccugucccuaguccccgccacgauagagaucaaauccaagcgcaaagacuggucaaaauacauccgcuauagauacgaccggcgcguaccagggcucaugucacacuucccggaacacaaagccacgcucgacgaggucaagacacuacuuggcgaauacgacagaugccgaaucaaaaucuucgacugggcguucgcgcucgaaggagcaaucauguccgacagagaccuaaaacccuaucuacacgaaucaucaucucgcgaaggaaaaucuggagaacacuccacgcucgucaaaauguuaguagaaaagaagggaugccucacacccgaugaaucacaguaccuaauccuaauucgcaacaaggcagcccacaaccaauucccgugugcggccgaaaugccccugaucuaccgcgacguaucagcuaaaguuggauccauagaagguuccuccgccaaagaccuucccgaaggcuccucucucguugacagccucuggaagaaauacgaaaugaucauaagaaaaauacuaccaaucuuagacccugaaaacagauucuucggcaaacuccucaacaacaugucccaaccaaucaacgaccucuaa

SEQ ID NO: 11667 - RNA, 3408 nt, Artificial Sequence
  Cas13b variant__Porohyromonas gingivalis__ERJ87335.1__Cas13b
augaacacagucccagccucagaaaacaaaggucaaucccgcacgguagaagacgacccccaauauuucgggcucuaccuaaaucucgccagagagaaccuaaucgaagucgaaucacacguccguaucaaauucgggaaaaagaaacuaaacgaggagagcuugaagcaaucacuccugugugaccaucugcucucgguagaucgcuggacgaaagucuauggacacucccgacgguaccuccccuucuugcacuacuucgaccccgauagccaaaucgaaaaagaccacgacagcaagacaggaguagacccagacagcgcccagcgacucauacgcgaacucuauucgcuacuagacuuccuacggaacgacuucucgcacaacagauuagacggcacaaccuucgaacaccuagaagucucccccgacaucagcuccuucauaacaggcaccuacucacuagccugcggacgcgcccagagcagauucgcagacuucuucaaaccggaugauuucgugcucgccaaaaaccgcaaagaacagcuuaucucagucgcagacgguaaggaaugccuaacgguaucaggucuggccuucuucaucugccucuuccucgacagggaacaagcauccggcaugcucucccgcaucagaggcuuuaaacgcacagacgaaaacugggcccgcgcaguccacgaaacauuuugcgaccucuguauacgacacccccacgaccgccuagaaucauccaauaccaaagaggcuuuacugcuagacaugcuaaaugaacucaaccgaugcccccggauccucuacgacaugcugcccgaagaggaacgagcccaauuccugccugcauuggacgaaaacagcaugaacaaccucagcgaaaacucacuuaaugaggaaagccgucuccugugggacggcuccagcgauugggcagaggcacuaacaaaaaggauccgacaccaagaccgauucccuuaccuuaugcuaagauucaucgaagaaauggaccuccugaagggaauccgguuccgaguagaccugggcgaaauagaacuagacuccuacuccaaaaaggugggccgcaacggcgaauacgaccgcaccaucacagaccacgcgcucgccuucggaaaacuaucggacuuccaaaacgaagaagaagucucucgcaugaucucgggcgaggcaucauauccaguucgcuucucacucuucgcaccccgguacgccauuuacgacaauaaaauuggcuacugccacaccucagacccggucuacccaaaaucaaaaaccggcgaaaagcgggccuugucaaaucccaggagcauggguuucauaagcguacacgaccuccgaaaguuacuacucauggaacuccuaugugaaggaucuuucucccgaaugcaauccgacuuccucagaaaggccaaucgcauucuggacgaaacagccgagggcaaguuacaauucuccgcccuauuucccgagaugcgccaccgguucaucccaccccaaaauccaaaaucaaaagaucggcgggaaaaagccgaaaccacgcuugagaaauacaagcaggaaaucaaaggccgaaaagacaaacucaacagccaacuccuauccgcauucgacauggaccaaagacaacuccccucccggcuacuagacgaauggaugaacauccgacccgcaagccacuccgucaaacuccggaccuacgucaagcagcucaacgaggacugccguuuacggcuccagaaauuccguaaagacggcgacgguaaggcccgcgccaucccgcucgucggugagauggccacauuccucucacaagacaucgucaggaugaucaucucggaagagacaaagaaacuuauaaccuccgcauauuacaacgaaaugcaaagaucgcuggcacaguacgcaggagaagaaaauagacaucaguuucgugcaauaguugcggagcuucgucugcucgacccaucaucaggccaccccuuccuauccgccacgauggaaacagcgcaccgcuacacagaagacuucuacaaaugcuaccuugaaaagaaacgcgagugguuagccaaaaccuucuaccgucccgagcaggacgagaacacuaaaagacggauaucaguauucuucgucccagacggcgaagcacgcaaacuccuuccacuacucauucgaagacgaaugaaagagcaaaacgaccuccaagacuggauccgaaacaaacaagcacaccccauagacuugcccucgcaccuauucgauucaaaaguaauggaacuacucaaagucaaagacgggaaaaagaaauggaacgaggccuucaaagacuggugguccaccaaguaccccgacggcaugcagccauucuacggccuacggagagaacucaacauacacggaaaaagugucucuuacauacccuccgacggaaagaaauucgcagacugcuacacccaucucauggagaaaacaguacgagacaagaaacgcgaacuccgcaccgccggaaaacccgucccgccagaccuagcagccuauaucaaacgcaguuuccaccgggcugucaacgaacgcgaguucaugcuccgccucguucaggaagacgaccgccuuaugcucauggccaucaauaaaaucaugacagaccgcgaagaagacauucucccaggacuaaagaacauagacuccauccuagacaaagaaaaccaguucucacuagcgguccacgcaaaagucuuagaaaaagaaggcgaggguggcgacaacucccucucgcuaguaccggcgaccaucgagauaaaaucaaaacgaaaagauugguccaaauauauuagguaccgauacgaccgccgcgucccaggacucaugucacauuuccccgagcacaaagccacacucgacgaagucaagacucuacucggcgaauacgaccgaugccgaaucaaaaucuucgacugggcauuugcccuagaaggugcaaucaugucagaccgggaccucaaaccuuaccuccacgaauccucgucacgcgaaggcaagucgggagagcacagcacccucguaaaaaugcuagucgaaaagaaagggugccucacgccagacgaaucccaguaccuuauccucauacgcaacaaagccgcucacaaccaauuccccugcgcagccgaaaucccccucaucuaccgagacguaucugccaaagucggaagcaucgaaggaucgagcgcaaaagaccuaccggaaggaagcucccuagucgacucacucuggaagaaauacgagaugaucauacgcaaaauccuuccaauacuagacccagaaaaccgauucuuuggcaaacucuuaaacaacaugucccaacccaucaacgaccucuaa

SEQ ID NO: 11668 - RNA, 3408 nt, Artificial Sequence
  Cas13b variant__Porohyromonas gingivalis__WP_005873511.1__Cas13b
augaacacaguaccagcauccgagaacaaaggccagucgaggacagucgaagaugauccacaguacuucggacuauaccucaaccuugcgagggaaaaucugaucgagguggaaagccacguccggaucaaauucgggaaaaagaaacuaaacgaagaaucacugaaacaaucacuacucugcgaccaccuccucucaguggaccgcuggacaaaaguauacggccacucccgccgauaccucccauuccuccacuacuucgacccagacucccaaauugaaaaagaccacgacuccaaaaccggaguagaccccgacagcgcacaacgccuaauccgagaacuuuacagccuacucgacuuccuacggaacgauuucagccauaacaggcucgacggaaccaccuucgagcaccucgaagucucaccagacaucucuagcuucauaacugggacauacucacuggccugcggccgggcacaaagucgcuucgccgacuuuuucaaaccagacgauuucguccuagcgaaaaaccgcaaagaacaacugaucucagucgcagacggaaaagaauguuuaacagucagcggacucgcauucuuuauaugucucuuucucgaccgcgaacaagccagcggaaugcucucccgaauccgcggcuucaagcgaaccgacgagaacugggcccgagccguccacgagaccuucugcgacuuaugcauccggcauccacacgaccgauuagaaagcuccaacaccaaagaagcacuccuacuggacaugcucaacgaacuuaaccgcugcccccgaauacucuaugacaugcuccccgaggaggaacgagcccaauuucugcccgcacucgacgaaaacuccaugaauaaccuaucugagaacucucucaacgaagagucccgcuuacucugggacgggucguccgauugggccgaggcacucacaaaacgcauucgacaucaggaccgauuuccuuaccuaaugcuccgcuucauagaagaaauggaucuccucaaggggaucagauuccggguugaccuuggcgaaaucgaacuagacagcuacuccaagaaaguaggacgaaacggcgaguacgaccguaccauaacggaccacgccuuagcauucggcaaacuuucugacuuucaaaacgaagaagaaguaagucgaaugauaagcggagaagccuccuacccgguaagguuuagcuuauucgccccaagauacgccauauacgacaacaaaauuggauacugccacaccucggaccccguguacccuaaaagcaaaacaggcgaaaaacgugcccugucgaacccacaguccaugggauucauaucaguccacaaccuuagaaaacuccugcucauggaacuccugugcgaaggaaguuucucacgaaugcaaagugacuuccuacgaaaagcgaaccgcauccucgacgaaacagccgaaggaaaauuacaauucucagcacuauuccccgaaaugcgccaccguuucauaccaccccagaaccccaaauccaaagaccgacgcgagaaagccgagacaacucucgaaaaauauaaacaagaaaucaaaggccgaaaggacaaacuaaauagucaacuccuuuccgcauucgacaugaaucaacgacagcucccgagccgacuccucgacgaauggaugaauauccgacccgccucucacuccgugaagcucagaacauacguaaagcaacucaacgaagauugcagacugcgcuuacgaaaauuucgcaaagacggcgacggcaaagcccgcgcuauaccgcuuguuggcgagauggcaaccuuccuaagccaagacaucgugagaaugauuauaucagaagaaacgaagaagcugauaaccagcgccuacuacaacgagaugcaacggagccucgcccaauacgccggagaggaaaaccgccgccaguuccgcgcaauaguagcggaacuccacuuguuagaccccagcuccggccacccauuccugucugcgacaauggaaaccgcccaccgcuacacagaagacuucuacaaaugcuaccuagaaaagaaacgggaauggcucgcaaaaaccuucuaccgcccggagcaggacgaaaacacaaaacggcgcaucagcguauucuucguacccgauggcgaggcacggaaacuccugccgcuguuaauccgccgucgaaugaaagaacagaacgaccuucaggacuggauacgaaauaaacaggcacacccaauagaccugcccagccaccuguucgacucgaaaauaauggaacuacucaaaguaaaggacggcaaaaagaaauggaacgaagccuuuaaagacugguggucaaccaaauacccagacggaaugcaaccauucuauggacuacgccgggaacucaauauccacggaaaauccguguccuacauacccucugacggcaaaaaguucgcggacugcuauacacaccuaauggagaaaacgguccaagacaaaaagcgcgaacuuagaaccgccggaaaacccguacccccagaccuggccgcugauauaaagcgcuccuuccaccgcgcagucaacgaacgagaguucaugcucaggcuaguccaagaagacgauaggcuaauguuaauggccauaaacaagaugaugaccgacagggaagaagacauccuaccaggacugaaaaacauagacagcaucuuagacgaagaaaaccaguucagccucgccguacacgcaaagguacuagaaaaggaaggcgaagggggcgacaacuccuuaucccucgugccggcaacaaucgaaaucaagagcaaacgcaaagacuggucaaaauacauaagauaccgauaugacagaaggguaccagggcuaaugucccacuucccagaacauaaagccacccuagacgaggucaaaacccuccuuggcgaguacgaccgcugccgaaucaaaauauucgacugggccuucgcccucgaaggcgccauaauguccgaccgcgaccugaaaccauacuuacacgagucauccucgcgagaaggcaaaucaggagagcacuccacucuaguaaaaaugcuagucgagaagaaaggcugccuaacacccgacgaaagccaauaccucauacugauacgcaacaaagcagcccacaaucaauuccccugcgccgcagaaaugccccuuaucuacagagacguauccgccaaaguagguuccaucgagggcagcagugcgaaggaccuaccagaggguucaucgcugguagacucacuauggaagaaauacgaaaugaucauccgaaaaauacucccaauccuugacccagaaaaccgauucuucggaaaacuccucaacaacaugagccaacccaucaacgaccucuag

SEQ ID NO: 11669 - RNA, 3408 nt, Artificial Sequence
  Cas13b variant__Porohyromonas gulae__WP_039445055.1__Cas13b
augaacacagugccagccaccgaaaacaaaggucaaucccgcacaguggaggacgacccacaguacuuuggacuauaccuaaaccuggccagagaaaaccucauagaaguggaaucccauguccgcaucaaauucgggaaaaagaaacuaaacgaggagagccucaaacagagucuccucugcgaccaccuacuaucuaucgaccgcuggaccaaagucuacgggcauucccgucgcuaccucccguuccuacacuguuucgaucccgacucuggcaucgagaaagaucacgacuccaaaacgggcgucgaccccgacagcgcacaacgccugauacgcgaauuauacucacuacucgacuuccugaggaacgauuucucacauaaucgccuugacgggaccaccuucgagcaccuaaagguguccccagauauuuccagcuucauaaccggagccuacacauuugccugugaacgcgcacaaucccgauuugcggacuucuuuaaacccgacgacuuccuacuagccaaaaaccgcaaagagcagcuaaucuccgucgcagacggaaaagagugccucaccgucucgggauucgccuucuucaucugccucuuccuagaccgagaacaagccucggggaugcuaucacggauccgaggauucaaaaggaccgacgaaaacugggcacgugccguccaugagaccuucugcgaccuuuguauacgacacccgcacgaccgccucgaaagcuccaacacgaaggaagcacuccugcuugacaugcucaacgagcucaaccgcuguccccgcauucuauacgacaugcucccagaagaagaaagagcccaauuccuucccgcccucgacgaaaacucaaugaacaaucuaagcgaaaauagccuaaacgaagaaucgcgucuccugugggacggcucaucagauugggccgaagcucucaccaaaagaauccgccaucaggaccgguucccauaccuaaugcuccguuucaucgaggaaauggaccuccucaaaggcauacgcuuucgcgucgaccuuggcgaaauagaacucgacuccuauuccaagaaagucggacgcaauggugaguacgaccgcaccaucacggaccacgcccuggccuucggaaaacucagcgauuuccaaaaugaagaagagguaagccgaaugaucucuggagaagcgucguaucccguucgauucucacucuucgcaccucgguacgcaaucuacgacaacaaaauuggguacugccacaccuccgacccggucuaucccaaauccaaaaccggugaaaaacgcgcacucucaaacccccagucaaugggcuucaucucuguacacgaccuccgcaaacuacuacucauggagcuccucugcgagggcucauucagucgaaugcaaucagacuuccuacguaaagccaaccgcauccuagacgaaaccgcagaggguaaacuucaguucagcgcacuuuucccggaaaugagacaucgauucaucccaccacaaaaccccaagucaaaggaccgccgagaaaaagccgagacaacgcucgaaaaguacaagcaagaaauaaaaggacgaaaagacaaacugaacucccaauuacucagcgccuucgacaugaaccaacgacaacuccccagccggcuacucgacgaguggaugaacauucgaccggcaucacacuccgucaaacuacgaaccuacguaaagcaacucaacgaagacugccgccuacggcuccgcaaauuccgcaaagauggcgacggaaaagcaagagcaauaccccuggucggcgagauggcaaccuuccucagccaggacaucguacgaaugaucauuuccgaagaaacgaagaaacugauaaccuccgccuacuacaaugaaaugcaacgcagccuagcacaauacgccggagaagagaaccgacgucaauucagagccauaguagcggagcuucaucuccucgacccaagcucaggucacccguuccuaucagcuaccauggaaacagcgcaucgcuacaccgaagacuuuuacaaaugcuaccuagaaaagaaacgagaguggcucgccaaaaccuucuaccgcccagagcaagacgaaaacacgaaaagaaggaucucugucuuuuucguccccgacggcgaggcucgaaaacuucuuccacuacucauccgccgaagaaugaaagaacaaaacgaccugcaagacuggauacguaacaaacaggcccacccgaucgaccuccccagccaccuauucgauagcaaaaucauggaacuacuaaaaguuaaagacggcaagaagaaauggaacgaggcuuucaaagacugguggucuacaaaauaucccgacggcaugcaaccuuucuacggccuccggcgcgaacucaacauccacggcaaauccgucagcuauauuccauccgacggaaagaaauucgccgacugcuacacacaccuaauggagaaaaccguucgggacaagaaacgcgaacuccgaacagccggcaaacccgucccgcccgaccucgccgcauacauuaaacggagcuuccacagagcaguuaacgaacgagaguucaugcuacgacucguccaagaagaugaccgacuaaugcucauggcaaucaauaaaaugaugaccgaccgcgaagaagacauacuccccggacugaaaaacauagacaguauccuagacgaagaaaaccaauucagccucgcaguccacgcuaaaguccuggaaaaggagggagaagggggcgauaacagccuaucacucguacccgccaccauagaaaucaagucgaaacgcaaagacugguccaaauacauccgauaucguuacgaucgacgagucccagggcuaaugucacacuuccccgagcacaaagcgacccuggacgaaguaaaaacacuccucggggaauacgaccgaugucgaaucaagauauucgacugggcuuucgcccucgagggagccauaaugucagaccgagaccugaaacccuaccugcacgagaguaguucgcgcgaagggaaauccggcgaacacucaacccuggucaaaaugcuagucgaaaagaaaggaugucucacaccggacgaaucacaguaccucauccucauaagaaacaaagccgcccacaaccaauuccccugcgcggccgagaugccgcuaaucuaccgcgacgucucugcaaaagucgggucgaucgaaggcagcucugcaaaagaccuuccagaaggcuccagccuagucgacucccucuggaagaaauacgaaaugaucauacgcaaaauccuccccauucucgaccacgaaaacagguucuucgguaaacuacuuaacaacaugucgcaaccaaucaacgacuuauaa

SEQ ID NO: 11670 - RNA, 3528 nt, Artificial Sequence
  Cas13b variant__Porphyromonas gingivalis__WP_052912312.1__Cas13b
augacggaacagaaugaaaagccguacaacggcaccuacuacacccucgaagacaaacacuucugggccgccuuuuucaaccuagcccgccacaacgcguacauaacgcucgcacacaucgaccgccaacucgcauacagcaaggccgacaucacaaacgacgaggacauccucuucuucaaagggcaauggaaaaaucuggacaacgaccuggaacgcaaggcccgccuccguucccucauccuaaagcacuucagcuuccuugagggagcagccuacggcaagaaacuguucgaaucgcaauccucgggaaacaaaaguuccaaaaagaaagagcuaaccaagaaagaaaaagaagaacuucaggccaacgcgcuuucccucgauaacuuaaaaucgauccucuucgacuuccuccaaaaacuuaaagacuuccgcaacuacuauagccacuacaggcacccugaaagcagcgaacucccccucuucgacggcaauaugcuacaacgccuguacaacguauucgauguauccguccaacggguaaaaagagaccacgaacauaacgauaaaguagacccccaccgacacuuuaaucaccugguccgaaaaggcaagaaagacaaauacgggaauaacgacaaccccuuuuucaaacaccacuucguagaccgagaagagaaagucacagaagcaggccuccucuucuucguaucccuguuccuugaaaaacgcgacgccaucuggaugcaaaagaaaaucaggggcuucaaaggaggaacggaggcauaccaacaaaugaccaacgaagucuuuugccgcucacgaaucagccucccuaaacuaaagcucgaaucccuccgaacagacgacuggaugcuccuagacauguuaaacgaacuuguuagaugcccaaaacuccuguacgacagacuacgggaggaagaccgagcccgauuccgcguaccaguagacauccuuuccgacgaagaugauacggacggaaccgaggaggacccuuuuaaaaacacccucguucgucaccaggaccgauuccccuauuucgcccuucgguacuuugaccucaaaaagguguucaccagccuacgcuuucacaucgaccugggcaccuaccauuuugcaauauacaagaaaaauaucggagagcaaccugaggaccgccaccugacacgaaaccuguacggcuucggccgaauccaggacuucgcagaagaacauagaccagaagaauggaaacgacucguaagagaccuagacuacuuugaaacaggcgacaagcccuacaucacccagaccaccccacacuaccacauagaaaaggguaaaaucgggcucagauucguccccgagggacaacuccuauggccaucgcccgaagucggcgccacacggaccgggagaucaaaauacgcccaggacaagcgauucacagccgaagcauucuuaucaguccacgaacuaaugccuaugauguucuacuacuuccuacuccgagaaaaauacucagaagaagcaagcgcugaaaaaguucaaggccgcaucaagcgcgucauugaggaugucuacgcuguguacgacgccuucgcacgcgacgaaauaaacacuagagacgagcucgacgccugccuagcggacaaagggauacgaagaggacaucugccccgacaaaugauagcgauacugucucaagaacacaaggacauggaggaaaaaguccgcaaaaagcuccaagaaaugaucgccgacaccgaccacaggcucgacaugcuagaucgccaaacagaccgcaaaauaagaaucggacguaaaaacgcagggcuacccaaaaguggcgucaucgcggacuggcucgucagagauaugaugcgauuucaaccaguggccaaagacacaagcggcaaaccccucaauaacagcaaagcaaauaguacggaauacagaaugcugcaacgugcccuagcacuguucgggggcgagaaagaacgccuaacacccuacuuccgacaaaugaaccucaccgggggaaacaacccacaccccuuccuccacgaaacccguugggaaucccacaccaacauacugagcuucuaucgcuccuaccugaaagcucggaaagccuuccuccaaucaauaggccgcuccgaucgggaagagaaccaccgcuuucuacuacugaaggaacccaaaacagacagacaaacccucgucgcgggcuggaaaagcgaguuccaccuaccccgcggcauauuuacagaagccguacgcgauugccugaucgaaaugggguacgacgaaguaggcucauacaaggaagucggcuuuauggcgaaggcgguaccacucuacuucgaacgcgcgugcaaagaccgcguccagcccuucuacgacuaucccuucaacgugggcaauucccucaaacccaagaagggccgcuucuugagcaaagagaaaagagccgaagagugggagagcggcaaagaaagauucagagaccucgaagccuggucgcacuccgccgccagacgcaucgaagacgcuuucguaggcauagaauacgcgaguugggaaaacaagaagaaaauagaacaguuacuccaagaccuuagucucugggaaacauucgaauccaaacucaaagucaaagcagacaaaaucaacauagccaaacuaaagaaagagauacucgaagcaaaagaacacccauaccacgacuucaaaagcuggcaaaaauucgagcgcgaacuccgccucgucaaaaaccaagacauuauaaccuggaugaugugcagggacuuaauggaagaaaacaaaguagaaggacuggacacggggacucuauaucugaaagacauacggacagauguccaagaacaaggcucccucaacguacuuaaccacguaaaaccaaugcgccuaccugucguuguuuaccgagccgacagccgaggccacgugcacaaagaagaggcgccacuagccaccgucuacauagaggaaagagacacaaaacuacucaaacaaggcaacuuuaaauccuuugucaaagaccgacgucucaacggccuauuuuccuucguagacacgggagcccuagccauggagcaauacccaaucagcaaacugcgcguagaguacgagcuggcgaaguaccaaaccgccagagugugugccuuugaacaaacccucgaacuggaagagagcuuacuaacacgcuacccacaucugcccgacgaauccuuccgugaaaugcuagaaagcuggagcgacccacuccuagacaaguggccagaccuccaaagggaaguacgucuacuaauugccguccgcaaugcguucucccacaaccaguaccccauguaugacgaaacgaucuucucgucaauccgcaaguacgacccaagcucauuggacgccauagaggaacgcaugggacuaaacaucgcgcacaggcucuccgaggaagucaagcucgccaaagagaugguugaacgaauuauccaagcauga

SEQ ID NO: 11671 - RNA, 3360 nt, Artificial Sequence
  Cas13b variant__Porphyromonas gingivalis__WP_053444417.1__Cas13b
augaccgaacagaacgagaaaccauacaacggaacguacuacacguuagaagacaagcacuucugggcggccuuucuaaaucucgcccggcacaaugcguacauaacccuugcgcacaucgaucgacaauuagcauacuccaaagccgacauaaccaaugacgaagacauccuauucuucaaaggacaauggaagaaccucgacaacgaccuggaacggaaagcacgccugcgaucccuaauccugaaacacuucuccuuccucgaaggagcagccuacgggaaaaagcuauucgagucccaauccagcggaaacaaaagcagcaaaaagaaagaacuguccaaaaaggaaaaagaagaacuacaagcaaacgcacucagccuugacaaccucaaauccauccucuucgacuucuugcaaaaacuuaaagacuuccgcaacuauuacagccacuaccgacacccugaaagcuccgaacucccccucuucgaugguaacaugcuccaacggcuauacaacguauucgacgucagcguacaacgggucaaacgagaccacgaacacaacgacaaggucgacccccauagacacuucaaccaucuuguccggaaaggcaagaaagacaaguacggaaacaacgacaaccccuucuucaaacaccacuucguagaccgggaaggaaccgucaccgaggccggccuccucuucuucguaagccuauuccuagaaaagagagacgccaucuggaugcagaaaaagauccgcggcuuuaaaggcggcacagaggcguaucaacaaaugacuaacgaaguuuucugcagaucgagaaucagucuuccgaaacucaaacuggagagccuacgaacagacgauuggaugcuccucgacaugcucaacgaacucguucgaugccccaaaucccucuacgaccgacucagagaagaggaccgcgcacgauuccguguccccguagacauccucucugaugaggacgacacugacgggaccgaagaagacccauucaaaaacacacucgugcgacaccaagaccgcuucccguacuucgcacugcgauauuuugaucugaaaaagguauucaccagccugcgguuccacauagaccuaggcacauaccacuucgcuauauacaagaaaaacaucggggaacagcccgaagaccgacaccucacgcgaaacuuauacggcuucggucggauccaggacuucgccgaggaacaucgccccgaggaauggaaacgucuaguccgcgaccucgacuacuucgaaacaggagacaaaccuuacauaacccaaacaacuccccacuaccacaucgaaaaaggaaaaauaggccuucgcuuugucccagaaggccaacaucucuggcccucccccgaaguaggcgccacccgcaccggccggucgaaauacgcccaggacaaacgacucaccgcagaggcguuccugagcguacacgaacucaugcccaugauguucuacuacuuccugcuccgcgaaaaauacucagaagaagucucagccgaaaaaguccagggccgcaucaaacgcgucauagaagacguguacgccguauacgacgcauucgcgcgggacgaaaucaacacccgagacgaacucgacgcaugccuagcggacaagggcauacggcgggggcaccuaccccgccaaaugauagcaauacucucacaagaacacaaggacauggaagagaagguacggaagaaacuacaggaaaugaucgccgacaccgaccaucgacucgacaugcucgaccgccagacagaccguaaaauccguauaggacgaaagaacgccggccuacccaaauccggcgucgucgccgacuggcucgucagagacaugaugcgcuuccaaccgguagccaaagacacauccggaaaaccccucaauaacuccaaggcgaacuccacagaauaccgcaugcugcagcgagcgcuagcccucuucggcggagaaaaagaaaggcuaacacccuacuuccgacagaugaaccugaccggcggcaauaacccccaccccuuccuccacgaaacgagaugggaaagccacacuaacauccuuucauucuauagaucguaccuagaagcccgcaaagccuuccuccaauccaucggacgauccgaccgagucgagaaccaccgauuccuacuacuaaaagagcccaaaaccgaccgccagacccucgucgccggcuggaaaggagaguuccaccuuccaagagggaucuucacagaagcgguucgcgacugucuaaucgaaaugggauaugacgaggugggcucuuacaaagaagucggauucauggccaaagcaguaccacuuuacuucgagagagcaagcaaggacagaguccaacccuucuacgauuaucccuucaacgucggaaauucucucaaaccgaagaaaggccgcuuccuauccaaggagaaaagggcggaagaaugggaaagcggcaaagaacgcuucaggcuggcaaaacugaagaaagagauucucgaggcaaaagaacacccguaccacgacuucaaaagcuggcaaaaauucgaacgagaacuccgacuugucaaaaaccaggacauaaucacauggaugaugugccgggaccucauggaggaaaacaaaguagaaggacucgauacgggcacacucuaccucaaagacaucaggaccgacguucaagagcaaggaucccuaaacgugcuaaaccgggugaaaccuaugcgccuacccgucgucgucuaccgagccgacagccgcggccacguccacaaagagcaagcgccccucgccaccgucuacaucgaagaacgcgauacaaaacuccucaaacaagguaacuucaaauccuucgucaaagaucgacgccugaacggccucuuuuccuuuguugacaccggggcccucgccauggaacaguacccaaucucaaaacuacgcgucgaauaugagcuggccaaauaccaaaccgcacgaguaugcgcuuucgaacaaacacuggaacuugaggaaucccuccugacccgauacccgcaccucccggacaaaaacuuucgcaaaaugcucgaaucguggucagacccacugcuggacaaauggccagaccuccacggcaacguccgacuacucauagcgguccguaaugccuucucacacaaccaguaccccauguacgacgaaacccucuucuccucgauacgaaaguaugaccccuccagcccagacgcaaucgaagaacgcaugggccucaacaucgcacaccgccugucagaagaagucaaacaagccaaagagaugguggagagaauaauucaagccuaa

SEQ ID NO: 11672 - RNA, 3360 nt, Artificial Sequence
  Cas13b variant__Porphyromonas gingivalis__WP_012458414.1__Cas13b
augaccgaacaaaacgagcgaccauacaacggaacguacuacacacucgaagacaaacacuucugggcagcauuuuucaaccucgcacgacacaacgccuacauuacacuagcgcacaucgaccgacaacucgcguacagcaaagcggacauaacaaacgacgaggacauacuguucuuuaaaggccaguggaaaaaucuggacaacgaccucgaacgcaaagcccgccugagaucacuaauccucaagcacuucagcuuccucgaaggggcagcauacggaaagaaacuauucgaaagccaaaguagcggaaacaaaagcaguaaaaagaaagagcuaacuaagaaagagaaagaggaacuacaagccaacgcacuaucccucgacaaccuaaaaagcauacuuuucgauuuccuccaaaaacugaaagacuuccgaaacuauuacagccauuaccgacacccggaaagcagcgaacugccacuauucgacggcaacaugcuccaaagacucuauaacguuuucgacgucuccguacaacgaguaaaaagagaccacgaacacaacgacaaagucgacccgcaccgccacuucaaccaccuuguccgcaaaggaaagaaagaccgcuacggcaacaacgacaacccauucuucaaacaccacuucgucgacagagaagaaaaagucacugaagccggacuauuguucuucguaagccuauuccuagagaaaagagacgcaauuuggaugcaaaagaaaauacguggcuucaaaggcggaacggaaaccuaccagcagaugaccaacgaaguuuucugccgcucgcguauaagccuccccaaacucaaauuagagagccuaagaaccgaugacuggaugcugcuugacaugcuaaacgaacucguacggugcccaaaaucacucuacgacagacucagggaagaggaccgagcacgguuucggguacccguagacauauuaucagaugaggacgacacggacgggacagaagaagaccccuucaaaaacacccucguccggcaccaagaccgguucccauacuucgcacuccgcuauuucgaccuaaagaaaguauucacgucgcuccgcuuccacauugaccugggaacauaccacuucgccauauacaagaaaaacauaggggagcaaccggaagaccgacacuuaacaagaaaucucuacggcuucggcagaauacaagacuucgcugaggaacacaggcccgaagaauggaaacgccuaguccgggaccuagacuacuucgaaacgggagacaaaccuuacaucacacaaaccacaccacacuaccacaucgaaaaaggaaaaauaggacuccgauuugucccggaaggucaacacuuauggccgucgccggaagugggggcaacccgaacaggccgcucaaaauacgcgcaagacaaaagacuaaccgcggaagccuuccucucagugcacgagcuaaugcccaugauguucuacuacuuccuccuccgugagaaauacagcgaugaagccagcgccgaacgcguccaaggccgaauaaaacgcgugauagaggacguuuacgcaguauacgacgcauucgcccggggagaaauuaacacacgcgacgagcucgacgccugccuugccgacaaaggcauucgaagaggccaccuaccaagacaaaugauaggcauacucagccaggagcacaaggauauggaagaaaaggugcgcaagaagcugcaagaaaugaucguagacacagaccaccgacucgacaugcuagacaggcaaaccgaccgcaaaauccgaaucggacgaaagaacgcgggccucccaaaguccggcguuauugccgacuggcuggucagagacaugaugcgguuccagccugucgcaaaagacaccagcggaaaaccacuuaacaacaguaaagccaacucgacagaauaccgcaugcuccaacgggcccucgcacuauucgggggugagaaagaacgacuaacaccauauuuccgccaaaugaaccucacgggcggcaacaacccccacccauuccuacacgaaacuagaugggaaucgcacacaaacauucucaguuucuaccgauccuaccugaaagcgcgaaaagccuuccuacaaucaaucggacgaagcgaccgcguugagaaccaccgcuuucuccuccuaaaagaaccgaaaaccgaccgccagacccucgucgcaggcuggaagggagaguuccaccucccacgcggcaucuucacugaagcagucagagacugcuugaucgaaaugggucuagacgaaguaggcagcuauaaagaagucggauucauggccaaagccguuccacuauacuucgagagggccugcaaggaucgagugcaaccguucuacgacuaucccuucaacguaggcaacagccucaaacccaaaaagggacgcuuccuuagcaaagaaaaacgcgccgaggagugggaaucuggcaaagaaagauuccgccuagccaaacugaagaaagaaaucuuagaggccaaggaacacccauaccucgacuucaaaagcuggcagaaauucgaacgggaacuccgccucgucaaaaaccaagacaucaucacauggaugaucugucgcgaccucauggaagaaaacaagguagaaggccuagacaccggcacccucuaccucaaagacauacgcacagacgugcaagaacagggaaaccuaaacguacucaaccguguaaaaccaaugagacuaccgguggugguauaccgcgccgacagccggggccacguccauaaggagcaagcaccacuagcgaccguguacaucgaagaaagagacacgaagcuacugaaacagggaaacuuuaaaucauucguaaaagaccgaagacucaacggacuauucagcuucgucgacacuggcgcccuagcaauggaacaguacccgaucuccaaacuacggguagaauacgaacuggcaaaguaccaaaccgcgcggguaugcgcauucgaacaaacccucgaacucgaggagucccuccugacgcguuacccccaccuaccggacaaaaauuuccgaaaaaugcucgaaagcuggagugaccccuuacuugauaaguggcccgaccuccacggcaacguaagacuacugauugcaguccgaaacgccuucagccacaaccaauauccgauguacgacgaagcgguguucucgucaauccggaaguacgaucccuccucaccagacgccauagaagaacggaugggccucaacaucgcacaccgccuuagugaagaggucaagcaagccaaggaaauggccgagcgaauaauacaagccuaa

SEQ ID NO: 11673 - RNA, 3360 nt, Artificial Sequence
  Cas13b variant__Porphyromonas gingivalis__WP_039417390.1__Cas13b
augacagaacaaaacgagcgcccauacaacggcacauacuacaccuuagaagacaaacauuucugggccgcauucuucaaccuagcccgacacaaugccuacauaacccucgcgcacauagaccgccaacuagccuacaguaaagccgacaucaccaacgacgaagacauccuguucuucaaaggccaguggaagaaccucgauaacgaccuagagaggaaagcacgccuccgcagccugauccuaaagcacuucucuuuccuagagggcgcugccuacggaaagaaacuguucgagucgcaaucuucagggaacaaaagcucgaaaaagaaagagcuaaccaagaaagaaaaagaagaacuccaagcaaaugcauugucccucgauaaccucaaaucaauacucuucgacuuccuccaaaaacuaaaagacuuccgcaacuacuacucgcacuauagacauccggaaucuuccgaacucccccuauucgacggaaacaugcuacagagacuuuacaacgucuucgacguaagcguccagcgaguuaaaagagaccaugaacacaacgacaaaguggacccgcacagacacuucaaccaccuuguccggaaaggcaaaaaggaccgcuacggaaacaacgacaauccauucuucaaacaccacuucguagacagggagggaaccgugaccgaagcuggacuacucuucuucguaucacucuuccucgaaaagcgagacgccauauggaugcaaaagaagauccgcggcuucaaaggagggaccgaagccuaccaacaaaugacaaacgagguauucugcagaagccgaaucucacuaccgaaacuuaaauuagagagccuccggacagacgacuggauguugcucgacauguugaaugaacucguacgaugcccgaaaucccuauacgaccgccuacgggaagaagaccgcgcaagauuucgaguccccauagacauacuuuccgacgaagacgacacagacggcacugaagaggacccuuucaagaacacccuagugagacaccaagaccgcuucccauacuucgcacuacguuacuucgacuuaaagaaagucuuuacaagccuccgcuuccauaucgaccuaggaacguaucacuucgccauauacaagaaaaacauaggagagcaaccagaagaccggcaccucacacgaaaccucuacggcuucggccguauccaggacuucgccgaggaacaccgacccgaagaauggaaacgccugguccgcgaucucgacuacuucgaaaccggcgacaaacccuacauaacccaaaccaccccacacuaccauauagaaaaagguaaaaucgggcuccguuuugugcccgaaggccaacaccuauggccaucccccgaagugggugcaacccgcacaggcaggucaaaauacgcccaggacaaaagacuuacggccgaagcauuccucagcguccaugaacucaugcccaugauguucuacuacuuccuccuaagagaaaaauacucugaagaagucuccgcagaaaaaguccagggacgcauaaaaagagucauagaggacguauacgcaguuuacgacgccuucgcucgcggcgagaucgacaccuuagaccgacuagacgcgugccucgcggacaaaggaauccgaagaggccacuugccccgucaaaugaucgccauccugucccaagaacacaaagacauggaagaaaaggucaggaaaaagcugcaagaaaugauagccgacacggaccacagacucgacaugcucgacagacagacagacagaaaaauuagaauaggccgcaaaaaugcaggccuccccaaaaguggugucaucgcugacugguuaguccgggacaugaugagauuccaacccgucgcgaaagacacaagcggcaaaccgcugaacaacuccaaagccaacagcacggaauaucggaugcuacaacgagcguuagcauuauucggcggggaaaaagaacgacuaacccccuacuucagacagaugaaccuaacgggaggcaacaacccccacccguuccuccacgagacacgcugggaaagccacaccaacauuuuaucauucuacagaagcuaccuaaaagcacggaaggcuuuccuccagagcauaggacgauccgaccgagaagaaaaccaccgcuuccucuuacucaaagagccaaaaaccgaccgccagacacucgucgcgggcuggaaauccgaguuccaccucccucggggaauauucacagaagccgucagagacugccuuaucgaaaugggauacgacgaagucggcuccuauaaagagguaggcuuuauggcgaaggccgucccgcuauacuucgaaagagcaugcaaagaucgaguccaaccuuucuacgacuacccauucaacgucggcaacucccucaagcccaagaaaggacgguuccucagcaaagagaaacgcgcugaggaaugggaauccgggaaagaacgcuuccggcuagccaaacucaaaaaggaaauccuagaagcaaaagagcaccccuauuuagacuucaaaagcuggcaaaaauucgaacgagagcugcgccuugucaaaaaccaagacaucaucaccuggaugaugugccgggauuugauggaagaaaacaaggucgaaggccucgacaccgggacucucuaccucaaagacauacgcaccgacguucacgagcaaggcucccucaacguccugaacagagugaagcccaugcggcuuccagugguagucuaccgcgcagacagccgaggccauguccacaaagaacaagcaccauuggccacggucuacauagaggagcgcgacacaaaacuccuaaaacaaggcaacuucaaaucauucguaaaagacagacgccucaacggucuauucagcuucguggacacuggugcacucgcgauggaacaauacccaaucaguaaauuacgggucgaauacgaacuggcgaaauaccaaacagcucgaguaugcgccuucgaacaaacccuugaacuggaagaaagccuccuuacacgcuacccccaccuccccgauaaaaacuuccgcaaaaugcuagaaagcuggucagacccccuauuagacaaauggccagacuuacaccgcaaaguccgccuccucauagccguucgcaacgccuucucucauaaccaauacccaauguacgacgaagcagucuucucuucaauucguaaauacgacccaagcuccccagacgccauugaagagagaaugggccucaacaucgcacaccgccucucagaggaagugaagcaagcaaaggagauggccgaacgcauaauacaagucuaa

SEQ ID NO: 11674 - RNA, 3528 nt, Artificial Sequence
  Cas13b variant__Porphyromonas gingivalis__EOA10535.1__Cas13b
augacagaacaaaacgagaaaccuuacaacgggacauacuacacgcucgaagacaagcacuuuugggccgcauucuuuaaccuggcccgucacaacgccuacauaacccuaacgcacaucgaccgacagcucgcguacuccaaagcagacauaacaaaugacgaagacauccucuucuucaaaggacaguggaaaaaccuggauaacgaucucgagcgcaaggccagacugcgguccuuaauacucaagcacuucucguuccucgagggagccgcguacggcaagaaacuauucgaaucccaaucaucgggcaauaaauccagcaagaaaaaggaacuaaccaaaaaggagaaagaggaacuccaggccaacgcucucucccuggacaaccucaaaucgauacuauuugacuucuugcaaaaacucaaagauuuccggaacuacuacagccacuaccgacacccagaauccagcgaacucccccuguucgacgggaacaugcuacaacggcucuacaacguuuucgacguaagcguccaacgagucaagcgcgaucacgaacacaacgauaaagucgacccacaccgccacuuuaaccaccucgucagaaagggaaagaaagaccgauguggcaacaacgacaaccccuuuuucaaacaucacuucgucgacagagaagagaaaguuacagaggcgggacuccuguucuuugugucccucuuccucgaaaaacgugacgcaauuuggaugcaaaagaaaauacggggauucaaaggcggaaccgaaaccuaccaacagaugaccaacgaagucuucugcagaucccgcaucagccuccccaaacucaaacucgagucgcuacgcacagacgacuggaugcuccuagacaugcuaaaugagcucguaaggugccccaagucccucuacgacagacuccgugaagaagaccgagcacgcuuccggguuccuguagacauucuuuccgacgaagaugacacggacggcaccgaagaagacccuuucaaaaacacccucguacgccaccaggaccgcuuuccuuacuucgcccuccgauacuucgaucugaagaaggucuuuacuucccuuagauuccacauugaccucggaaccuaccacuucgccaucuauaaaaagaacaucggugaacaaccagaagaccgccaccuuacaagaaacuuguacggauucgggcgcauacaagacuucgcagaagaacaucgcccugaagaauggaaacgucugguccgugaccucgacuacuucgaaacaggugacaagccauacauaacacagacaaccccacacuaccacauagagaaaggcaaaaucggccuucgauuugucccggaaggucaacuacuuuggccaagccccgaggucggagcaacgcgaacaggcagguccaaauacgcgcaagacaaacgauucaccgccgaagccuuucugagcguccacgagcucaugcccaugauguucuauuacuuccuccucagagagaaauacucugaagaagcaucagccgaacgcguccaagguagaauaaaacgcgugaucgaggacguauacgcugucuacgacgccuucgcacguggagaaaucgacacccucgacaggcuagaugcaugccucgccgacaagggcauacgacgcggccaccucccccgacagaugauagcaauacuaagccaggaacacaaggacauggaagaaaagguacgaaagaaacuccaagaaaugauagcagacaccgaccaccgacucgacaugcuugacaggcaaacagaccgaaaaauaaggauaggccgcaaaaacgccggacuuccaaagagcggugucauagcagacuggcuagucagagauaugaugcgauuccaaccggucgcaaaagauacauccggcaagccgcuuaauaauagcaaggccaauaguaccgaauaccgcaugcuccaacgagcccuagcccuuuucgggggcgaaaaggaacgccuuaccccauacuuccgucaaaugaaccucaccggaggaaacaacccgcaccccuuccuccacgaaacccggugggagucucacaccaacauacuauccuucuaucgaucguaccucaaagcgcgaaaagcauuccuacaaucuaucggacgcucggaccgcgucgagaaccaccgauuccuccuccucaaggagcccaagacggaccggcaaacgcucguggcaggauggaagggcgaguuccaccucccacguggcauauucacagaagcaguccgcgacugccuaauagaaaugggacuagacgaagucggauccuacaaagaaguuggauucauggcgaaagccgucccacuauacuucgaacgcgccugcaaagacagaguccaacccuucuacgauuaucccuucaacguaggcaacucacucaaaccgaagaaaggaagguucuuaucuaaagaaaaacgcgcugaagagugggaaagcgguaaggaaagguuccgagaccucgaagccuggucacacagcgcugcccggcgaauagaggacgcuuucgcaggcaucgaaaacgcgagccgagagaacaaaaagaaaauugaacaacuacuccaggaccuuagccugugggaaaccuucgaaucgaagcuaaaagugaaagccgacaaaaucaacauagcuaaacugaaaaaggaaauccuagaagcaaaagaacaccccuaccucgacuuuaaaagcuggcaaaaauucgagagagaacuccgacucgucaagaaccaagacaucauaaccuggaugaugugccgcgacuuaauggaggaaaacaaaguagagggccucgacacaggcacccucuaccuaaaagacauccgcacagauguacacgaacaaggaagccucaacguccucaacagggucaaacccaugcggcuacccguaguugucuaccgggccgacucccggggacacguccacaaagaacaagccccucuagccacgguguacaucgaggaacgugacaccaaacuacugaagcaaggcaacuucaaauccuucgucaaggacagacggcugaacggccucuucagcuucgucgacacgggcgcacucgcuauggaacaguauccaauauccaaacuacgcguagaauaugaacucgcaaaguaccaaaccgcuagaguaugcgccuucgaacagacgcucgaacucgaagaaucccuccuaacccgcuacccacacuuacccgacaaaaacuuuagaaagauguuagaauccugguccgacccgcuacuagacaaauggccagaccuccacggaaacguucgccugcugaucgcagugcgaaacgcauucucccacaaccaauacccaauguacgacgagacccucuucucguccauccgcaaauacgauccaucaucaccagaugcgauagaggaacgcaugggacucaacauagcucaccgacuauccgaagaagucaagcaagccaaagagaugguggagcgaaucauccaggcguaa

SEQ ID NO: 11675 - RNA, 3360 nt, Artificial Sequence
  Cas13b variant__Porphyromonas gingivalis__WP_061156470.1__Cas13b
augacagaacaaaaugaacgccccuacaacggcacauacuauacacuagaagacaaacacuucugggcagccuucuucaaccuagcaaggcacaacgccuacaucacacuuacccacauagaccgucagcuagcguacagcaaggccgacauaacaaacgacgaagacauccuauucuucaagggccaauggaaaaaccuagacaacgaccuagaacgaaaggcccgccuccgcucacucauacucaaacacuucucguuccucgaaggagccgccuacggaaagaaacuauucgagaacaaaagcuccggaaacaaaucauccaaaaagaaagaacucacgaaaaaggaaaaagaggagcuucaagccaacgcccuaucacucgacaaccugaaaucaauccucuucgacuuccuccaaaaacuuaaagacuuucguaacuacuacucgcacuaccgacacccagagagcuccgaacuaccgcuguucgacggcaauaugcuccaaagacucuacaacguauuugaugucagcguccaacgaguaaaacgcgaccacgaacacaacgacaaagucgacccucaccgccauuucaaucaccucgucagaaaaggcaagaaagaccgaugcggcaauaacgacaacccauucuucaaacaccacuucguugaccgugagggaaaggucaccgaagccggccuacuuuucuucgucucacucuucuuagagaagcgcgacgccaucuggaugcagaaaaagauccgagguuucaaaggcgggacagaagccuaucaacaaaugacaaacgaagucuucugccgaucccgcaucuccuuaccaaaacugaaacuagaaagccuccgcacugacgacuggaugcuauuagacaugcucaacgaacuugugcgaugcccgaagucccuauacgaucgccugcgagaggaagacagagcacgcuuccgcgucccagucgacauauuaagcgacgaggacgacacugauggaaccgaagaagauccauucaagaacacccuaguccgccaucaagaccgauuuccguacuucgcgcuuagauacuucgaccucaagaaaguguucacgucccugcgauuccacauagaccucgggaccuaccacuucgcaauauacaagaaaaacauuggcgagcaaccggaggaucgccaccucacccgaaaccuuuacggcuuuggcagaauccaagacuucgcggaagaacaccgacccgaagaguggaaacgauuagucagagaccuagacuacuucgaaacgggcgacaaaccauacaucacacagaccacaccccacuaccacauugaaaaaggaaaaauaggacuccgauucguccccgaaggucagcaucucuggcccucccccgaaguaggagccacccgcaccgggcgauccaaauacgcacaggacaagcgucugacagcggaagcauuccucuccguccacgaacucaugcccaugauguucuacuacuucuuacuccgcgagaaauacagcgaagaagucuccgcagaaaaaguucagggccgcaucaaacgagucauagaagacguauacgcgguuuacgacgcauucgcccggggcgaaauagauacauuggacagacuugacgcuugccucgccgacaaaggcaucaggcgaggucaucuuccaagacaaaugauagccaucuugucccaggaacacaaagauauggaagaaaaaguccggaaaaagcuccaagagaugaucgcggacaccgaccaccgccuggacaugcuugaucgccaaacggaccgaaagauccgcaucggccguaaaaacgcaggacuuccgaaauccggcgugauagccgacuggcuaguccgagacaugaugcgauuucaaccagucgcaaaggacaccagcgguaaaccgcucaacaacagcaaggccaacagcacagaguaccgaaugcuccaacgagcccucgcacuauucgguggcgagaaagagagacuaacacccuacuuccgccaaaugaaccucaccggcggaaacaacccacacccauuccuucacgaaacccgcugggaaucccacacuaacauacuaucuuucuaucgcucauaccucaaagcgcgcaaggcuuuccuacaauccaucggccguuccgaccgagaggaaaaccacagguuccuacuccucaaagaacccaaaaccgaccgccaaacacugguagcuggauggaagucggaguuccaucugccccgcggcauauucacagaagccguccgagacugccuaauagaaaugggcuacgaugaaguaggaagcuacaaagaaguuggcuucauggccaaggcgguaccacucuacuucgaacgggccuguaaagaccgcguccaacccuucuacgacuauccguuuaacguaggcaacagccugaaacccaagaaaggccgauuccucuccaaagagaaacgcgcggaagagugggaaucaggcaaagaacgcuuccgccucgcaaaacugaagaaagaaauccuggaggcaaaagaacacccuuaucucgacuucaaaucauggcaaaaauucgaacgagaacugcgguuaguuaaaaaccaagacaucauuaccuggaugaugugccgagaccucauggaagaaaacaaagucgagggccuggacacagggacccuauaccucaaagacauacgcaccgaaguccaggagcaaggcucacucaacgugcuaaaccgugugaagccaaugcgccucccaguggucguauacagggcggacucacgcggacacguccacaaagaacaggcaccccuagccacagucuacauagaagaacgggauacaaaacugcuuaaacaaggcaauuucaaaucauucgucaaagaccgcagacuaaacggccuguuuucauucguggacaccggaggccuagccauggagcaguacccaaucuccaaacuuagaguagaauacgaacucgccaaguaccagaccgcgagagucugcgccuucgaacagacccucgagcucgaagagucccuucucacgaggugcccccacuugcccgacaaaaacuuccgaaaaaugcuagaaagcuggucagacccccugcucgacaaauggccagaccuccaacgcgaagucuggcuacuaaucgccgugagaaacgccuucucacacaaccaauacccgauguacgacgaggccguuuucucguccauacgaaaauacgacccaucgucgccugacgccauagaagaacgcaugggacucaacauagcgcacagacuuucagaggaagugaaacaagccaaagaaauggccgaacggauaauacaggccuaa

SEQ ID NO: 11676 - RNA, 3360 nt, Artificial Sequence
  Cas13b variant__Porphyromonas gingivalis__WP_013816155.1__Cas13b
augacagaacaaaacgaaaagccauacaacgggacauacuacacccucgaagacaagcacuucugggccgcauuuuucaaccuagcacgccacaacgcguauauaacccuagcacacaucgaccgacaacuugcauacagcaaagccgacauuacaaacgacgaggacauccucuucuucaagggacaguggaaaaaccucgacaacgaccucgaacguaaagcacgccuccgcagcuuaauccucaagcacuucaguuuccucgaaggagcagccuacggaaagaaacucuucgaaucacaguccucgggaaacaaguccuccaaaaauaaagaacucaccaaaaaggaaaaagaggaacuccaggcaaacgcacugucccucgacaaccuaaaaucuauacucuucgacuuccugcaaaaacugaaagauuuccggaauuauuacucucacuaccgacaccccgaaucaucagagcugccccucuuugaugggaacaugcuccaaaggcuauacaacguuuucgacgucucuguacagagaguaaaaagagaccacgaacacaacgacaagguagacccacaccgccacuucaaccaccucguccgcaaaggaaagaaagauagguauggaaacaacgacaaccccuucuucaaacaucauuucguagaccgcgaaggaacggucaccgaggcggggcuucuuuucuuugucucacuauuccucgaaaagagagacgccaucuggaugcaaaagaaaauucgcggcuucaaaggagggaccgaaaccuaccaacaaaugacuaacgagguauuuugccgaagccgaauaagucuaccgaagcucaagcuagagucgcugcgcacagacgacuggaugcugcucgacaugcucaacgagcuaguccgaugcccaaagucacuguaugaccgccuucgagaagaagaccgugccagauucagagucccagucgacauccugagcgacgaagaagacacagacggggcagaagaagaccccuucaaaaauacgcuaguccggcaccaggaccgauuccccuacuucgcgcuccgcuacuuugaccucaaaaagguguucacaagucuucgauuccagauagaccucggcacauaccauuucgcaauuuacaagaaaaacaucggugaacaacccgaagaccgccaccucacacgcaaccuauacggauucggccgaauacaagacuucgccgaagaacacagaccagaagaauggaaacgacuuguccgcgaccucgacuacuucgaaacgggggacaaacccuacauaacacaaaccaccccacauuaccacauugaaaaagguaaaauaggacuccgcuucgugccagaaggccagcaccuguggcccuccccggaagucggcgccacccgcaccggccguuccaaauacgcccaagacaaacgguucaccgccgaggcauuccuaucagcccacgagcucaugcccaugauguucuacuacuuccuccuccgcgaaaaauauagcgaggaagccuccgcagaaagaguccaaggccgcaucaaacgcguaauagaagacgucuacgccgucuacgacgccuucgcacgagacgagaucaacacacgcgacgaguuagacgcaugccuagcagacaaaggaauacgacggggacaucugccacgccaaaugaucggaauccugucccaagagcacaaagauauggaagagaaaauacgcaagaaacuacaagaaaugauggcggacaccgaccaccgccucgacaugcucgaccggcagacugaccguaaaauaagaauaggucguaaaaacgcgggacuccccaaauccggcgucaucgcggacuggcuaguccgugacaugaugcgcuuccaaccaguagcaaaagacacauccggcaaaccccuaaacaacucaaaggcuaacaguaccgaauaccgaaugcuccagagagcccuggcacucuucggaggcgagaaggagcggcucacacccuacuuccgccagaugaaccuuacaggcgggaacaacccacacccauuccuccacgaaaccagaugggaaagccacaccaacauccucuccuucuaccggaguuaucuaaaagcgcguaaagcguuccuccaaucaaucggccgcuccgaccgcguugagaaccaccgguuccuucuccuuaaggaaccaaaaaccgaccgacaaacccugguagcaggauggaaaggagaguuccaccucccaagaggcaucuucacagaagcuguaagggacugucucauagaaaugggacucgacgaggugggcucguacaaagaggucggguucauggcgaaagcgguaccccuauacuucgaacgggccugcaaagacuggguccagcccuucuacaacuacccguucaacgucggcaacucuuuaaagcccaagaaaggccgguucuugucgaaagagaaacgggcagaagaaugggaauccggaaaagaacgcuuccgacuugcaaaacuaaagaaagaaauccuagaggcaaaagaacacccauaccucgacuucaaaucguggcaaaaauucgaacgcgagcuacgacucgucaaaaaccaagacauaaucaccuggaugauaugcggcgaccucauggaagaaaauaaaguagaagggcucgacaccgggacacucuaccuaaaagauauacgaaccgacgugcaggagcaaggcucacucaauguacuaaacaggguaaaaccaaugcgccuacccgucguagucuaccgcgccgacagucgcgggcacguucacaaagaacaagcaccacucgcaacaguauacauagaagaacgagauaccaaacuucucaagcaagguaacuucaaaucguucgucaaagaccgacgccucaacggacuuuucuccuucgucgacaccggugcgcuggcuauggagcaguauccuaucagcaagcuacgcguggaauacgagcuugcaaaauaccagacggcgcgcgucugcgccuucgaacagacacucgagcuagaagaaucacuucucacgagaugcccccaucuaccggacaaaaacuuucguaagaugcuagagagcugguccgacccccugcucgacaaauggcccgaccuccacagaaaagucagacuauuaaucgcaguccgcaaugccuucucucacaaucaauauccaauguacgacgaggccgucuucagcucaaucagaaaguacgacccaaguuuccccgacgcaauagaagaacguauggggcuaaacauagcgcaccgccuguccgaagaggucaaacaagcaaaagaaacaguggaacgcauaauucaagccuaa

SEQ ID NO: 11677 - RNA, 3528 nt, Artificial Sequence
  Cas13b variant__Porphyromonas gingivalis__WP_005874195.1__Cas13b
augaccgagcaaaacgaaaagcccuacaacggcaccuacuacaccuuagaggacaagcacuucugggccgccuucuucaaccuggcgcgucacaacgccuacauuacacucgcacacaucgaucgccaacuggccuacagcaaggcagacaucacaaacgacgaagauauccuuuucuucaaaggacaauggaagaaccuagauaacgacuuggagcgcaaggcccgacuaagaucccuaauccugaagcauuucagcuuccuagaaggcgcugcauacggcaaaaagcuauucgagucccagucgucagggaacaagagcucuaagaagaaagaacuaaccaagaaagaaaaagaggaacuacaagcgaacgcccucucacuagacaaccugaaguccauccuauuugacuucuugcaaaaacuaaaagacuucaggaacuauuacucacacuaccgccacccggaaagcucggaacuaccccucuucgacgggaacaugcuacaacgacuguacaacguauucgacgugucaguccaaagaguaaaacgcgaccacgaacacaacgacaaaguagacccgcaccgacacuucaaccaccuagugagaaaaggaaagaaagacaaauacggcaacaacgacaaccccuucuucaaacaccacuuugucgaccgagaagaaaaggucaccgaggccggccuacuauucuucguaagccucuuccuggagaaacgcgacgcgaucuggaugcaaaagaaaaucagggguuucaaaggugguaccgaggcauaccaacaaaugacuaacgaagucuucugccgaagccgaauaucccuaccaaaacucaaacuugaaucccuccgcaccgacgacuggaugcuucuagauaugcucaacgagcugguacgcugcccuaaguccuuauacgaccgccuacgagaagaggaccgcgcccgcuuucgagugccggucgacauucuaagcgacgaagacgacaccgauggcacagaagaagaccccuucaagaacacacuggugcgccaccaagaccgcuucccauacuucgcacugagauacuuugauuugaagaaaguuuucacaucgcuccgauuccacauagaucucggaacauaccacuucgccauuuacaagaaaaacaucggggagcaaccagaagacagacaccucacacguaaccuauacggauucggacgcauccaagacuucgccgaggaacaccgcccagaggaauggaaacgacucgugcgagaccucgacuacuucgaaaccggcgacaaaccauacaucacacaaaccacgccccacuaucacaucgaaaaagguaagaucggccuccguuucguacccgagggacaacugcucuggcccucucccgaggucggcgccaccagaaccggccggaguaaauacgcccaagacaaaagauucaccgccgaagcguuccuaucaguccaugaacuaaugcccaugauguucuacuacuuccuccuccgcgagaaguauucggaagaggcgucugcggagaaaguccagggccgcaucaagcgagucauagaggacgucuacgcuguguacgacgcauucgcgagagacgagauaaacaccagagacgaacuagacgccugccuggccgacaaaggaauacgacgcggccaucugccacgccagaugaucgccauccuaucccaagaacacaaagauauggaagaaaaaguccgaaagaaacugcaggaaaugauagcugacaccgaccacaggcuggacaugcucgaccggcaaacagaccgcaaaauaagaaucgguagaaagaacgccggccugccaaaaucaggcgugaucgcggacuggcucguacgagacaugaugcgcuuccagccuguagccaaagacacguccgggaaaccccugaacaacagcaaggcaaacuccacagaauauaggaugcuucaacgcgcauuagcccuguucggaggggagaaagaacggcuaaccccauacuucagacaaaugaaccuaacaggcgguaacaacccccaccccuuccuccacgagacccgcugggaaagccacacgaacauccucuccuucuaccgcuccuaccucaaagcucgaaaagccuuucuucaguccauuggacgaagcgaccgcgaggagaaccacagguucuuacuccuaaaagaacccaaaacagacagacaaacacuugucgcgggguggaaaucagaguuccaucugcccagaggaaucuucacagaggcagugagggauugccugaucgagaugggcuaugacgagguaggcagcuacaaagagguuggauuuauggccaaagcaguaccccucuacuucgagcgagcaugcaaagaccgaguccaacccuucuacgauuacccauucaacguaggaaacagcuuaaagcccaagaaaggccgcuuccuauccaaagaaaaacgcgcagaagaaugggagucuggcaaagaacguuuccgcgaccuggaagccuggagccacagcgccgcacgaaggauagaagaugcguucguaggcauagaauacgccucgugggaaaacaagaagaaaauugaacaacuacuucaagaccuaucccucugggaaacauucgaaagcaaacuaaaaguaaaagcggacaagaucaacaucgcaaaacucaagaaagaaauccucgaagccaaagaacaccccuaucacgauuucaaauccuggcagaaauucgagcgagagcuccggcuaguuaaaaaccaagacaucauaaccuggaugaugugccgagaccucauggaagaaaacaaagucgaaggacucgacacaggcacacuauaccucaaagacauccgcaccgacguccaagaacaaggaucccuaaacguccucaaucacgucaaaccaaugcgccucccagugguuguuuaccgggcagauucacggggccacguccacaaagaagaagcgccccucgcgaccguguacauagaagaacgugacacgaaacuccugaagcaaggaaacuucaaguccuucgugaaagaucgucgacucaacgggcuauucuccuucguugacaccggcgcccuggccauggaacaauaccccaucagcaaacuccgaguagaguacgaauuagcaaaauaucagacagcccgaguaugcgcauucgagcaaacacuagaacucgaagaaucccuacuaaccagauacccucaccuccccgacgagagcuuccgagaaaugcucgaaagcuggucagauccacugcuggacaaguggcccgaucuccaacgagaaguacggcuccugaucgccguacgcaacgcauucagccacaaccaauaucccauguacgacgaaacuauauucuccuccauccgaaaauacgacccaagcagccucgacgcgaucgaggaacggaugggacuaaacaucgcccacagacucuccgaagaggugaaacuugcaaaggagauggucgaacgcaucauacaagccuaa

SEQ ID NO: 11678 - RNA, 3360 nt, Artificial Sequence
  Cas13b variant__Porphyromonas gulae__WP_039437199.1__Cas13b
augaccgagcaguccgaacgccccuacaaugguaccuacuacacgcuagaagauaagcacuucugggccgcguuccuaaaccuagcgcgccacaacgcauacaucacgcugacucauaucgauaggcagcucgcauacucuaaagcggacaucacaaacgacgaagauauccucuucuucaagggacaguggaaaaaucucgacaaugaccucgaacgaaaaagccgauuacgcucgcugauccugaaacauuucuccuuccuagaaggagccgcauacggcaaaaaguucuucgaauccaaauccagcggaaacaaaucaaguaaaaacaaagagcucacuaaaaaggagaaagaagaacuccaagcaaacgcgcucucacuggacaaccugaaguccauacuauucgacuuucugcaaaaacucaaagacuuccgcaacuauuacucacacuaccgacacagcggaagcucagaacuaccacuauucgacggaaacaugcuccaacgacucuacaacgucuucgacgucagcgugcaacgcgucaagcgcgaccacgaacauaacgacgaggucgacccccacuaccacuucaaucaccuaguacgcaaaggcaaaaaggaccgcuacggccauaacgacaaccccuccuucaaacaccacuucgucgacggcgaaggaaugguaacagaagcgggacuccuguucuucgucucucuauuccucgaaaaacgagacgcgaucuggaugcagaagaaaauacgaggauuuaagggaggcacagaacccuacgaacaaaugacaaacgaagucuucugccgcagccgcauaucacuucccaaacucaaauuagagucccuccggaccgacgacuggaugcuccucgacaugcucaacgaacucguccggugccccaaaccacucuacgaccgccuacgagagaaagaccgggccugcuuccgcguaccagucgacauacucccagacgaagacgacacagacgguggcggagaagacccauucaaaaacacccuggugcggcaccaagaccgcuuccccuacuuugcccugcgauauuucgaccucaagaaagucuucacaucccuccgauuccacaucgaccucggaacuuaccacuucgccauauacaagaaaaugauaggagaacaaccugaagaccgacaccuuacccgcaaucucuacggcuucggcagaauacaggacuucgccgaggaacaucgcccggaagaguggaaacgacucguccgcgaccuugacuacuucgaaacuggggacaaacccuacauaagccaaacgacaccucacuaccacaucgaaaaaggcaaaaucggccuacgcuuugucccagaaggccaacaccuguggccaucgcccgaagucggcacuaccagaaccggccguuccaaauaugcccaagacaaaagacucaccgcagaagcauuccuguccguacacgaacucaugccaaugauguucuacuauuuccuacuccgcgaaaaauauuccgaagaagucagcgccgagaaaguacaagggcgcauaaagagaguaaucgaagacgucuacgccaucuacgacgcauucgcccgcgacgagauaaacacacuaaaagagcuagacgccugccucgccgauaagggcauaaggcgcggacaccuccccaaacaaaugauaggcauccucucgcaggaaagaaaagacauggaagagaaaguccguaagaaacuucaggaaaugaucgcagacaccgaccaccgccuagauaugcuagacagacaaaccgaccgcaaaauacgcauaggacgaaagaacgccggccucccaaaaaguggagucaucgccgacuggcuuguccgcgacaugaugcgauuccaaccagucgcaaaagacacaucaggcaagccccuaaauaacagcaaagccaacagcacggaauaccgcaugcuacaaagagcccucgcacuauucggcggagaaaaggaacgccuuacgccauacuuccgacagaugaaccuaaccggagggaauaacccccacccguuccugcacgaaacacgcugggaaagccacacgaacauucugucauucuaccggucuuaucugcgagcacgcaaggcauuccucgaaagaaucggacgauccgaccgaguagagaacugccccuuccuccuccucaaagaaccaaaaacagauagacaaacccucguagccgguuggaaaggggaguuccacuuacccaggggcauuuucacagaagccguaagagacugccucauugaaaugggauaugaugaaguaggaucguaccgagaagugggcuucauggcuaaagccgucccccuauacuucgaacgcgccugcgaggaccgaguccaaccuuuuuaugacagccccuucaacgucggcaacucccugaaacccaagaaagggagauuccuuuccaaagaaaaacgggccgaagagugggaauccggcaaagaacgcuuccgccucgcaaaacucaagaaagaaaucuuagaagcccaagaacacccguaccacgacuucaaauccuggcagaaauucgagcgggaacuccggcucgucaaaaaccaagauaucauaaccuggaugaugugccgggaucucauggaagaaaacaaaguggaagggcucgacaccggcacgcucuacuuaaaagacauccgacccaacguccaagaacaagguucacucaacguccuaaaccgugucaaaccaaugcgccugccagucgucguauaucgagccgacucccgaggucacguccacaaagaggaagccccacucgcaacagucuacauagaagaacgcgacacgaagcuccucaaacaaggaaacuuuaaaucauucgucaaagacagacgccucaacggacucuucuccuuugucgacaccggcgcccucgcaauggaacaauaccccauaucuaagcuacgcgucgaauacgaacucgccaaguaccagacugcaagaguaugcgcguucgagcaaacacuugagcuagaggagucccuacugacccgauacccccaccuccccgaugaauccuuccgcgaaaugcuagaaucguggagcgacccccuccuaacaaaguggccggaacuccacggcaagguccgccuucucaucgccguacggaaugcauucucacacaaccaguacccaauguaugacgaagcagucuucagcagcaucuggaaauacgaccccaguagcccugacgcaaucgaggagagaaugggcuuaaacaucgcccaucggcucucggaagaggugaaacaggccaaagaaaccauagaaaggaucauucaagccuaa

SEQ ID NO: 11679 - RNA, 3360 nt, Artificial Sequence
  Cas13b variant__Porphyromonas gulae__WP_039419792.1__Cas13b
augacagagcaaagcgaacgcccauacaacgggaccuacuacacacuggaagacaaacacuucugggcagcauuucucaacuuagcaaggcacaacgcuuacaucacccuuacacacauagauaggcagcuggccuauagcaaagccgacauaacuaacgaccaggacguacuauccuucaaagcacucuggaaaaaccucgacaacgaccucgaaagaaaaagccgacuccgaucucucauccugaaacacuuuuccuuccucgaaggcgcagcguauggaaagaaacucuucgaaucgaaauccuccggcaacaaauccuccaaaaacaaggaacuaacaaagaaagagaaagaagaacuccaggccaacgcccugucccucgacaaccuuaaauccauccucuuugacuuccuacagaagcuaaaagacuuccgaaacuacuacucacacuaccgccacuccggaaguuccgaacuaccacuuuucgacggcaacaugcuccaacggcuauacaacgucuucgacgucagcguccaacgaguaaagagggaccacgaacacaacgacaagguagacccccaccgccacuucaaccaccuaguccgcaaagguaagaaagaccgguacggacauaacgacaacccaaguuucaaacaucacuucgucgacggcgaaggcauggugaccgaagccggccuauuauucuucgucucacuguuccuagagaagcgcgacgcaaucuggaugcagaagaaaauacggggcuucaaaggugguacggagaccuaccaacagaugacaaacgagguauucugcaggucccggaucagccuccccaagcuaaaacucgagucuuuacgaacagacgacuggaugcugcuagacauguuaaacgaauuaguaagaugccccaaaccacuguacgaccgcuuacgcgaaaaagaccgcgcccgauuccgcguucccguagacauacucccggacgaggacgacacagacggaggcggcgaggaccccuucaaaaacacacucguccgacaccaagaccgauuccccuacuucgcccugcgauacuucgaccucaagaaagucuuuacaagccuuagguuccauauugaccuaggaaccuaccacuuugcaauuuacaagaaaguuauaggcgagcaacccgaggaccgccaccucacccggaaccuuuacggcuucggccgaauacaggacuucgcggaagaacaccgccccgaggaauggaaacgccucguccgcgaccuagacuacuucgaaacaggggauaaaccguacauaucccaaaccacaccacauuaucauauagagaaagguaaaaucggccuccgcuucguaccggaggggcagcaccucuggcccagucccgaagugggaaccacgcgcacaggccgcucgaaauacgcgcaggacaaacgccuuaccgcagaagcauuccucagcguacacgaacucaugccuaugauguucuacuauuuccuacuccgcgaaaaauacucagaagaggugagcgcagaaaaaguacaaggaaggauaaaacgagucaucgaggacguguacgcaauauacgacgcuuucgcccgugacgaaaucaauaccagggaugagcuugacgccugucucgccgauaaaggcauacgacgcggccacuuacccaaacaaaugaucgguauacugucccaggaacacaaaaacauggaagaaaaaguaagaaagaaacuccaagaaaugaucgcagacacagaccaccgacuagacauguuggaccgucaaaccgaccgcaaaauccgcaucggaaggaaaaacgcaggccucccgaaaagcggugucaucgccgauuggcuuguacgagacaugaugcgauuccagccaguagccaaagacacguccggcaaaccacuaaacaacagcaaggcaaacuccaccgaauaccgcaugcuacagcgcgcucuugcccuuuucgggggcgaaaaagagcgacucacccccuacuuccgacaaaugaaccucaccgggggcaacaacccccacccuuucuuagacgaaacacgaugggaaagccacacaaacauccugucauucuaccguagcuaccugcgcgcgaggaaggccuuccuggaacggauaggcagaucggaccguguggaaaaccgcccauuccuacuccucaaagaacccaagaccgaccgacaaacauuagucgccggguggaaaagcgaguuccaccucccccgcgguauauucacagaagccguacgcgacugccugaucgaaaugggcuacgacgaaguaggcagcuauaaggaggucggcuucauggccaaagccgucccccucuauuucgaaagggccugcaaagaccguguacaaccuuucuacgacagcccauucaaugucggcaacagccucaaaccaaagaaaggccgcuuccucagcaaagaaaaacgggccgaggaaugggaaucgggaaaagaacgauuccgccucgccaaacuaaagaaagagauccuggaggcccaggaacacccauaccacgacuucaaauccuggcaaaaauucgaaagggagcuucgucucgucaaaaaccaggacaucauaacauggaugaugugccgagaucucauggaagagaacaaagucgaaggucuagacacaggcacacuuuaucuaaaagacauccggcccaacguacaggaacaaggaucacuaaacguccucaaccguguaaagcccaugcgacucccuguagucgucuaccgagcggauagccgcggccacguacacaaagaagaagcaccccuagccacaguguacaucgaggaacgcgauacaaaacuccuaaaacagggcaauuucaaaucuuucgucaaagaccgacgccugaauggccucuucucauucgucgacacgggcggacuggccauggaacaguaccccauuaguaaacuccgugucgaguacgaacuagcaaaauaccagaccgcgcgggucugcgucuucgaauuaacucugcgccuagaagaaucccuucuuuccagauacccccaucugcccgacgaaucuuucagagaaaugcuggaauccuggucggacccccuccuagcgaaguggccagaacuccacggaaaagucaggcuccugaucgccguccgcaacgccuucucacacaaccaauacccaauguacgacgaggccguauucagcucaauccgcaaauacgaccccagcagcccggacgcaaucgaagaaaggaugggcuuaaauaucgcacauagacucucagaggagguaaagcaagccaaggaaacugucgaacgaauaauccaagcauag

SEQ ID NO: 11680 - RNA, 3528 nt, Artificial Sequence
  Cas13b variant__Porphyromonas gulae__WP_039431778.1__Cas13b
augacagagcaaucggagcgacccuacaaugggaccuacuacacgcucgaagauaaacacuucugggcugcguuccugaaccucgcacgacacaacgccuauaucacccuaacucacauagaccggcaacucgccuauucaaaagccgacaucacaaaugaccaagacguacuuagcuucaaagcacuauggaaaaacuucgauaacgaccuggaacgaaaguccaggcuccgcagccucauacuaaaacacuucucauuccuggaaggagcagccuacggaaagaaacuguucgaaucaaaaucaagcggcaauaaaagcuccaaaaacaaagaauuaacgaagaaagaaaaagaagaacuacaagccaaugcccugagccuggacaacuuaaaauccauccuguucgacuuccuucaaaaacucaaagacuuccgcaacuacuauagccacuaccgccacagcgaaagcucagagcucccccucuucgauggcaacaugcuucaacgacuguacaacguauucgacgucagcguacaacgaguaaagcgcgaccacgagcacaacgacaagguugacccgcaccggcacuucaaccaccuuguccgcaagggcaagaaagaucgauauggccacaacgacaacccuuccuucaaacaccauuucgucgacggcgaagggauggucaccgaagcaggccugcuauucuucgucucccucuuccuagagaaaagagacgcgauauggaugcaaaagaaaaucagaggguucaaagggggaaccgaaaccuaccaacagaugaccaacgagguauucugccgcagccggaucucccuccccaaacuuaaacuagaaucacuucgcacagaugacuggaugcuccuugacaugcuaaacgaacucguacggugccccaagccccuauacgaccgacuacgcgaagacgaccgcgcaugcuuccgagugcccgucgacauccuuccagacgaagacgacacggacggcggaggggaggacccguucaaaaacacccucguaaggcaccaagaccgcuucccguacuucgcccuccgcuacuucgaccucaagaaaguguucacaucccuacgguuucacaucgaccucggcacauaucacuucgcuauauacaagaaaaugaucggcgaacaaccugaagaucgccaucucacaagaaaccuauacggcuucgggcgcauccaggauuucgccgaagaacacagaccagaagaauggaaacgacucguacgcgacuuagacuauuuugaaaccggagacaaaccguacauaagccaaaccuccccgcacuaccacauagaaaaagggaaaaucggacuaagauucaugcccgaaggccaacaccucuggccaagcccggaggucgggacgaccagaacuggccgcuccaaauacgcacaggacaaaagacugaccgcagaagcauuccuuucgguucacgaacuaaugcccaugauguuuuacuacuuucuccuccgggagaaauacuccgaagaagucagcgccgagaaaguccaagggcguaucaaaagggugaucgaagauguauacgccauauacgacgcauucgcgcgcgacgaaaucaacacccucaaagaacuggacgcaugccucgccgacaaaggcauacgucgcggucaccuaccaaaacaaaugaucgccauucugucgcaggagcacaaagauauggaggagaaaauucguaagaaacuacaagaaaugauugccgacacagaccaccggcuugacaugcuugacaggcaaacagaccgcaaaauacggaucgguaggaaaaacgcagggcuaccuaaaagcggcgucauagccgacuggcucguacgcgacaugaugcgauuccaaccaguagccaaagacacauccggaaaaccccucaacaauucaaaagccaacuccacagaauaccgcaugcuacaaagagcucuagcccuguucggaggagaaaagaagcgccuaaccccguacuuccgacaaaugaaccuaacaggugguaauaacccccauccauuccuccacgaaacacguugggaaucacacacaaauauccucuccuucuacaggagcuaccuccgagcgcgcaaagcauuccucgaacgcauaggacgaagcgaccggauggaaaauagaccuuuccuacuacucaaagaaccaaagacggaccgucaaaccuuggucgcaggcuggaaaagcgaguuccaccucccccgaggcaucuucaccgaagccguccgagacugccucaucgaaaugggguacgaugaagucggaaguuaccgggaaguaggauucauggcuaaggcaguaccccucuacuucgaacgcgccugcgaggaccgcguucagcccuuuuacgacagccccuucaacgucggaaacucucuaaaaccaaagaaagguagauuucuaagcaaagaagaacgcgcugaagaaugggagcgagguaaagaacgcuuucgcgaccucgaggcauggucccacucagccgcucggcgcaucgaggacgccuucgccggaauagaauacgccagcccugggaacaaaaagaaaauagaacagcuccuccgcgaccucucacucugggaggcuuucgaauccaaacucaaaguaagggccgacaaaaucaaccucgccaaacucaagaaagaaauacucgaagcccaggaacacccauaucacgacuucaaaucauggcagaaauucgaacgagagcuccgccuagucaaaaaccaggacaucaucacguggaugaugugccgagaccugauggaagaaaacaagguagagggccucgacacaggaacccucuaccucaaagacauacgcccaaacguacaggaacaggggagccucaacguccucaaucgugucaaacccaugagacuaccggucguagucuaccgagcagacucacgcggccacgugcacaaagaagaagcaccccuagcgacaguguacauugaagaacgagacacaaaacuucucaaacaaggcaacuuuaagagcuucguaaaagaccgucgccucaacggccucuucaguuucguagacaccggaggccucgccauggagcaguacccgaucagcaaacuaagagucgaauacgaacuagcuaaauaucagaccgcccgcguuugcgucuucgagcuuacgcucagacuagaagaaucccuuuuaacaagguacccucaccuacccgacgagagcuuccgcaaaaugcucgaaucguggagcgacccccuacuggccaaauggccggaacuccacggcaaagucagacuacuaaucgccguccggaacgcauucucacacaaccaauaccccauguacgacgaagcgguguucucaucaaucagaaaauacgacccauccuccccagaugccauagaggagagaaugggccucaacaucgcacacagacucagcgaagaagugaaacaagcaaaagaaaccguagagcgaauaauucagguauga

SEQ ID NO: 11681 - RNA, 3528 nt, Artificial Sequence
  Cas13b variant__Porphyromonas gulae__WP_046201018.1__Cas13b
augacagagcaaagcgaacgacccuacaacggaacguacuacacccucgaagacaaacacuucugggccgcauuccucaaucucgcaagacacaacgccuacauaacauuaacacacauagaccggcaacuagccuacucaaaggccgacauuacaaacgaccaagacguccucucuuucaaagcucuauggaagaacuucgacaacgaccuagaacgaaagagccgccuacggagccuaauccucaagcacuucuccuuccucgaaggggccgcauacggcaaaaagcuguucgaaucaaaaucgagcggcaauaaauccuccaaaaacaaagaacuaacgaaaaaggagaaagaggagcuccaagcaaaugcccuaucacuagacaaccucaagagcauccucuucgacuuccugcagaaacucaaagacuuccgaaacuauuacagccacuaccgccacucagaaagcuccgagcuaccccucuucgacggaaacaugcuucagcgucuguacaacgucuucgacguaagcguccaaagaguaaaacgggaccacgaacacaacgacaaaguagacccacacaggcacuucaaucaccucguccgcaaaggaaagaaagaccgcuacggccauaacgacaaccccagcuucaaacaccacuucgucgacagcgaaggaauggucacagaggcaggccuccuguucuucguaucgcuauuccuggaaaaacgcgaugcaaucuggaugcagaagaaaauaaggggauucaaagguggaaccgaaaccuaccagcaaaugaccaacgagguauucugccgguccaggaucagccucccuaaacugaaacuggagagccuuaggacagacgacuggaugcuacucgacaugcugaacgagcuaguuaggugccccaaaccgcucuacgaucgacuacgcgaaaaagacagagcacgcuuccgagugccaguggacauucuaccagaugaagacgacacagacggaggaggcgaagaccccuucaaaaacacccuagucagacaucaagaccgauucccuuacuuugcacuaagauacuucgaccuaaagaaaguuuucacaucacuaagguuccacauagaccucggcaccuaccacuucgcaauauauaagaaaaugaucggggaacagcccgaagaccggcaucuuaccagaaaccucuacggguucggccgcauccaggacuucgcggaagaacaccguccagaagaauggaaacgacucguacgagaccucgacuacuucgaaaccggagacaaaccuuacaucagccaaaccaccccacauuaccauauagagaaaggcaaaauaggccuccgguucaugcccgaaggacaacaccucuggccgagcccagaaguagguaccacgcgcacgggaagaucaaaauacgcacaagacaaacgccucacagcugaagccuuccucagcguccacgaacucaugcccaugauguucuacuacuuccuccuccgagaaaaauacagcgaagaagucagcgccgaaaaaguccaaggucgcauaaaacgggucaucgaagaugucuacgccaucuaugacgcauuugcgcgcgacgaaaucaacacgcucaaagaacuggacgccugccucgccgacaaaggcauccggagaggccaccucccgaaacaaaugaucgccauacuaucccaagaacacaaagacauggaagagaaaauaaggaagaaacuacaagaaaugauugcagauaccgaccaccgauuagacaugcucgaccgacaaacugaccguaaaauccggaucgggcggaaaaacgccggacuaccaaaauccggagucauagccgacuggcucguccgagacaugaugcgauuccaacccguagccaaagacacaagcggcaaaccgcucaacaacaguaaagccaacagcaccgaauaccgcaugcuccaaagggcccucgcacuauucggaggcgagaagaaaagacugaccccuuacuuccgccaaaugaaccuaacgggaggaaacaacccccacccguuccuccacgaaaccagaugggaaucgcacacaaacauccugagcuucuaccgcagcuaccuucgagcacgcaaagcguuccucgaacgcaucggccgaucagaccgaauggaaaaucgccccuucuuacuccugaaagagccaaaaaccgauagacagacccuaguggcgggauggaaaucagaauuucaucucccacgaggaaucuucacagaagcaguaagagacugccuaauagaaaugggguacgacgagguaggcagcuaucgagaggucggguucauggcaaaagccgucccauuauauuuugagcgagcgugcgaggaccgagugcagcccuucuacgacucaccauuuaacgugggaaacucccuaaaaccgaaaaagggcagauuccuguccaaagaggaaagagcggaagaaugggagcggggcaaagagcgcuuccgggaccuugaagccuggucacauucagccgccaggcgcauagaagaugccuucgccgggaucgaauacgcaagccccggcaacaaaaagaaaaucgaacaacuacuucgcgaucuaucccuuugggaagccuucgagaguaaacucaaaguccgggcagauaagauuaaccuagcgaaacugaagaaagaaauccuugaggcgcaggagcacccauaccacgacuucaaaucauggcagaaauucgaaagggaacuccgucucgugaaaaaccaagacaucauaacauggaugaugugccgggaccucauggaagagaacaaaguagagggacuagacacuggcacccuguaccugaaagacauccgacccaacguccaggaacaagggucgcuaaacguccuaaauagaguaaaaccuaugcgacugccggucguaguguacagagccgacagccgcgggcacguccauaaagaagaagccccgcuagccacggucuacauagaggaaagagacaccaagcuccuaaaacagggcaacuucaaauccuuugugaaagaccgacgccucaacggacuauucagcuucguagacaccggcggccuggccauggaacaguaucccaucucaaagcuaagggucgaguacgagcucgcaaaauaccagacggcccgcgucugcgucuucgagcucacgcuucgacucgaagaaucccuccugacccgcuacccucaccuaccggaugaaucguuucggaagauguuggaaucauggucagacccccuauuagccaaauggccagaacuccacggcaaggugagacuucuaauagcaguccgcaacgccuucagccacaaccaauaucccauguacgacgaagcagucuucucaucaaucaggaaauacgaucccucaucccccgacgcgaucgaagaacggaugggccugaacauagcucaucgccucagcgaagaagugaaacaagcaaaagagaccgucgaacgaaucauccaagucuaa

SEQ ID NO: 11682 - RNA, 3525 nt, Artificial Sequence
  Cas13b variant__Porphyromonas gulae__WP_039442171.1__Cas13b
augacugaacaaagcgaaagacccuacaacggaacauauuacacccuagaagacaaacacuucugggcggcauuccucaaccuugcgcgacacaacgcguauaucacacuaacacauaucgaccgacaguuagccuacagcaaagccgacauuaccaacgaccaagacguacucuccuucaaagcacuauggaaaaaccuggacaacgaccucgaacgcaagagccgccucaggucauuaauacucaaacacuuuuccuuucuggaaggggcagcuuacggaaagaaacucuuugaaucuaaaucuagcggcaacaagagcagcaaaaacaaagaacuaaccaagaaggagaaggaagaacuccaagcaaacgcccuaagccuagacaaucuaaaguccauacuauucgacuuccuucaaaaacuuaaggacuuccgcaacuacuacucccauuaccgccacagcggaagcucggaacuaccacucuucgacggaaacaugcuacaacgucuauacaauguauucgacgugucgguacaaagaguaaagcgugaccacgaacacaacgacaaaguagacccccauuaccacuuuaaccaccuuguccgcaaagguaaaaaggaccgcuacggacacaaugacaaccccucuuucaaacaccacuucguagacagcgaggguaugguaaccgaagcaggucuacucuucuucgucucauuguuccuggagaaaagagacgcgaucuggaugcaaaagaaaauacgcggauuuaaaggcggaacagguccauacgagcagaugacaaacgaaguauuuugccgaagccguauuucccuaccaaaauuaaaacuggagucacuccgaacugacgacuggaugcuccuggacaugcucaacgaacucguacgaugccccaaaccucuauacgaucgucuccgcgaaaaagaucgcgccugcuuccgggucccagucgacauacugccggacgaggacgacacagacggcgguggggaggacccuuucaaaaacacacucguacgccaccaagaccgcuuucccuacuucgcacuacgcuacuucgaccuaaagaaaguauucacgagccuacgauuccacaucgaccuaggcacuuaccacuuugccaucuacaagaaaaugauaggugaacaacccgaagaccgccaccucacccgcaaccuauacggauucggacggauacaagauuucgccgaggaacaccgacccgaagaauggaaacgucucguaagagaucuagacuaucuggagaccggagacaaacccuacaucagccagaccacgccccacuaccacauagaaaaaggcaaaauuggccuccgguuuguuccggaggggcaacaccuauggcccuccccggaagugggcaccacccgcacuggccgguccaaaugcgcucaagacaaaaggcuuaccgcagaagccuuccucuccgugcacgaacucaugccaaugauguucuacuacuuccugcuaagagagaaauacagcgaggaaguaucugcagagaaaguccaaggccgcaucaagcgagucauugaagacguuuacgccaucuacgacgcguucgcacgcgacgaaaucaauacacugaaggagcucgacacaugccuagcagacaaagggauccggcggggccaucugccaaaacaaaugauaacaaucuuaucgcaggaacgaaaagacaugaaagaaaagauucgcaaaaagcuccaagaaaugaucgcagacacagaccaccgccuggacaugcuagaccggcaaaccgaucgcaaaauuaggauaggccggaagaacgccggccucccaaagagcgggguaaucgccgacuggcucguacgcgacaugaugcgcuuccaacccgucgccaaagacgcuagcggcaaaccacuaaacaacucaaaagcgaacucaacagaauacaggaugcuccagagagcccucgcccucuucggcggggaaaaagagcgacucacgccauacuuccgccaaaugaaccuaacgggaggcaacaacccacaccccuucuugcacgagacacgcugggaaucccacaccaacauacuaucguucuacagaagcuaccuaagagccagaaaagccuuccuugaacgcaucggccguagugaccggguugaaaacugcccguuccuucuccucaaagaacccaagaccgaccgacaaacccugguagccgguuggaaggacgaguuccaccucccaagaggaauauucacagaagcaguccgcgacugccugauagaaaugggcuacgaugaaguuggcagcuaccgcgaagucggcuucauggcaaaagcggucccacucuauuucgagagggcaugcgaggacaggguucaaccauucuacgacagcccauucaacguagggaacucccugaaaccuaagaaaggccguuuucucucaaaagaagaccgcgccgaagaaugggaaagaggcauggaaagauuccgagaccucgaagccuggucccacucugcagcacgccgaauuaaagacgcuuucgccggaauagaauacgcgucccccggcaacaagaagaaaaucgaacaauuacugagggaccucucacucugggaggcuuucgaaucaaaacugaaaguccgugccgauaaaauaaaucucgcaaaacucaagaaagaaauacucgaagcccaagaacacccauaccacgacuucaaauccuggcagaaauucgaacgggagcuccgccuugucaaaaaccaagacaucaucacauggaugaugugccgcgaccucauggaagagaauaaaguagaaggccucgacacggggacacucuaccuaaaagacauacguccaaacgugcaagaacaagggagccugaacguguugaaccgugugaaacccaugcgacuaccggucguaguauacagagcagacucccgcggacacgugcacaaagaggcaccccuagcaaccgucuacaucgaggaacgaaacacgaaacuacuaaagcagggaaacuucaaaucauucgucaaagaccgacgguuaaacggccuguucucauucguugauacaggaggguuagcaauggaacaauaccccauauccaaacuccgcguagaauacgaacucgccaaauaccaaacagccaggguaugcgucuucgaacuuacacuccgacuagaagaaucccuucuaucacgcuacccacaccuaccugacgaaucauuccgagagaugcuggaaaguuggucugauccccucuuagccaaauggcccgaacuacacgggaagguucgucuacugauagcuguccgcaacgcguucagccacaaccaguacccaauguacgacgaagcggucuucagcaguauucgaaaauaugauccauccuccccagaugcgaucgaagaacgcaugggccuaaacauagcacacagacucuccgaagaaguuaagcaagcaaaagaaaccgucgaacguaucauccaagcguga

SEQ ID NO: 11683 - RNA, 3360 nt, Artificial Sequence
  Cas13b variant__Porphyromonas gulae__WP_039426176.1__Cas13b
augacagaacaauccgaacgcccuuauaauggcacuuacuauacccuagaggacaaacacuucugggccgccuucuuaaaccuugcccggcacaacgcguauauaacccugacgcacaucgaccgccaacuagccuacucaaaggcagacaucaccaacgaccaagacguauuauccuucaaagcacuauggaagaauuucgacaacgaccucgaacggaaaucccgccuccgcucacucauauuaaaacacuucucauuccuagaaggugcugcuuauggaaagaagcucuuugaauccaaguccuccggaaacaaaagcagcaagaacaaagaacuaacaaagaaagagaaagaagaacuccaggccaacgcccuaagccucgacaaccugaaaucaauccucuucgacuuucuccaaaaacuuaaagacuuccgaaacuacuacucccacuaccgacacuccggaucaagcgaacuaccucucuucgauggcaacaugcuacagcgacuauacaacgucuucgauguuagcguccaacgcgucaaacgagaccacgagcacaacgacaagguagacccacacuaccacuucaaccaccuaguacgaaaaggcaagaaagacagauacggacacaacgacaacccgucauucaaacaccacuucguagacucugaaggaaugguaaccgaagcaggccuccucuucuucgugucucuauuucuagaaaaacgcgacgcgaucuggaugcaaaagaaaauacgaggauuuaaaggcgggacagggcccuacgagcaaaugaccaacgagguguuuugcagguccagaaucagccuacccaaacucaaacuagaaucccuacgcaccgaugacuggaugcuccucgacaugcuaaaugaacucgugcgaugccccaaaccccuguacgaccgccugagggagaaagaccgagcgugcuucagagucccaguggacauacucccagacgaagacgauacagacggcggcggagaagaccccuucaaaaacacgcucguccgacaccaggaccgcuucccauacuucgcacugcgcuacuuugacuuaaagaaagucuucacaucccucagauuccacaucgaccucggcacauaccacuucgcuaucuauaagaaaaugauaggggaacagcccgaagacagacaucuaacccgaaaccucuacggcuucggccgcauccaagacuuugcggaagaacaccgucccgaggaauggaaaaggcuagugcgagaccucgacuacuucgaaacaggagacaaaccguacauaagccaaaccacgccgcacuaccacaucgagaaaggcaaaaucggccuacgcuucaugccagaagggcagcaccuauggccgucucccgagguagggaccacgcgaacaggcagauccaaguacgcacaagacaaacgccuaacggccgaagcauuucucucagugcacgaacuuaugccgaugauguucuacuacuuccuccugcgcgaaaaauacagcgaagaaguauccgcagaaaaaguccaaggacgaauaaaacgcgugauuaaggacgucuaugccaucuacgacgcauucgcccgcgacgaaaucaacacguugaaggaacucgaugcgugcucagccgacaaaggaauacgccguggccaccuccccaaacaaaugauugggauccugucgcaagagcacaaaaacauggaggaaaaaguccgcaagaaacuccaagaaaugauagcagacacggaccaucgacuugacaugcuagaccgucagacagaccgcaaaauccgaauaggccgcaaaaacgcaggcuugccaaaauccggcgucaucgccgacuggcucgucagagacaugaugcgauuccagcccguugcgaaagacaccagcggaaaaccccucaacaacucaaaagcgaacaguacagaauacaggaugcuacaacgugcacuggcccucuucggcggcgagaaagagagacucacccccuacuuucggcagaugaaccucacagggggcaacaacccacacccauuucuggaugagacacgaugggaaucccacacaaacauccuaucguucuaucgcuccuaccuacgcgcccgcaaagccuuccuagaacgcauaggccgcuccgaccgcgucgaaaacagacccuuccuacuccuaaaagaacccaaaaacgaccgccagacccucgucgccgguuggaagucagaguuucaucugccacgaggaauuuucaccgaagcaguuagagacugucucauagaaaugggcuacgacgagguuggauccuacaaagagguaggauucauggccaaggcagucccacucuacuucgaacgcgcuugcaaagauaggguccaaccauucuacgacucaccguucaaugucggcaacagccucaagcccaagaaaggccgcuuccucagcaaagagaaaagagcagaagaaugggaaucaggcaaagagcgguucagacuagcuaaacuaaagaaagaaaucuuagaagcgaaagagcacccuuaccacgacuuuaaauccuggcaaaaauucgaacgagagcuccgccucgucaaaaaucaagacauaauaacauggaugaugugccgcgaucugauggaagaaaacaaagucgaaggacucgacaccggcacucuguaucucaaagacauaagaacagacguccacgaacaaggcucacucaacguccucaaccgcgucaaaccgaugagacucccagucguaguuuaucgcgccgacucccgcggacacgugcauaaggaacaagccccuuuggcaaccguauacaucgaagaacgcgauaccaaacugcucaaacagggaaacuucaagagcuucguuaaggaccgccgacucaacggcuuauucucauuuguagacacaggaggucucgcaauggaacaauacccaaucucuaaauugcgcguggaauacgagcucgcaaaguaccaaaccgcacgcguaugugcauucgaacagacacuagaacucgaagaaagccugcuaacccgauacccacacuugcccgacgaaaacuuucgcgagaugcuagaaucauggagcgacccacuccugggcaaauggccagaccuccacggcaagguaaggcuacuuauagccguacgaaacgcauucagccacaaccaguacccuauguacgacgaggccgucuuuucauccauccgcaaauaugacccuucaagccccgacgcaauagaggaacgcaugggccuaaauauagcgcaucgacuaucugaagaagucaaacaggcuaaggagacgguagaacggaucauacaggccuag

SEQ ID NO: 11684 - RNA, 3528 nt, Artificial Sequence
  Cas13b variant__Porphyromonas gulae__WP_039418912.1__Cas13b
augacggagcagagcgaacgaccauacaacggcacauauuacacccuagaagacaaacacuucugggcagcauuccuuaaccuagcucgccacaacgcuuacauaacacucacgcacaucgaccgacaacucgccuacaguaaagccgacaucaccaacgaccaagaugucuuauccuucaaagcccuauggaaaaaccuagacaacgaucuggaaaggaaaagccgccuccggagcuugauacuuaaacacuuuucauuccuugaaggggccgccuacggaaagaaacuuuucgaaucuaaauccucaggaaacaaauccuccaaaaacaaagaguuaacaaagaaagagaaagaagaacuccaagcaaaugcgcugucccuggacaaccuaaaaagcauccucuucgacuuucuacaaaaacuaaaagacuuccgaaacuacuauucacauuaccgccacuccggcagcucagagcugccacuauucgacggcaacaugcuacaacgacucuacaacgucuucgacgucucaguccaaaggguaaaacgcgaccacgaacauaacgacaaagucgauccccacagacacuucaaccaccucguacgcaaaggaaagaaagaccgauacggacacaacgauaacccuuccuucaaacaccacuuugucgacuccgaaggcauggugacagaagcaggccuacuguucuucguguccuuauuccucgaaaaacgcgacgcuauauggaugcagaagaaaauccgaggcuuuaaaggcggcaccgagacuuaccagcagaugacuaacgagguauucugccgaagucggauaucacucccgaaacuuaaacuagaaucgcuacguauggacgacuggaugcuccucgacaugcucaacgaacucguaagaugccccaagccacuguacgaucgccuccgcgaggacgaccgagcgugcuuucgcgucccaguagauauauugcccgacgaagacgacaccgauggggguggagaggacccauucaaaaacacccuagugagacaccaagaccgcuucccuuacuucgcacuccguuacuucgaccucaagaaaguauucacaucccuaagauuccacauagaccuaggaacauaccacuucgccaucuacaagaaaaugaucggcgaacaacccgaagacagacaccugacacgcaaucucuacgguuucggacgaauccaagauuucgccgaggaacaccgacccgaagaguggaaacgccucguccgugaccucgacuacuucgaaacaggggacaaaccauacauuucccaaaccucaccccacuaccacaucgaaaaaggcaaaauuggccuccgcuuuaugcccgagggccaacaccucuggcccagccccgaaguugggacaacgagaaccggccgaagcaaauacgcgcaagacaaacggcuaaccgccgaggccuuccuaucaguccacgaacuuaugcccaugauguucuacuacuuccuccuacgugaaaaauacagcgaagaaguuucagcggaaaaaguccaagggcgcaucaaacgcguaaucgaagacguguacgcuauauacgacgccuucgcccgcgacgaaaucaauacccugaaagagcuagaugccugccucgcagacaaagggaucagacgcggacaccucccgaaacaaaugaucgccauccugucccaagaacauaaaaacauggaagaaaaaguccgaaagaaacuccaggaaaugauagcagacacggaccaccgacuggacaugcucgaccgacagacagaucgaaaaauuagaaucggccgaaagaaugccggccuacccaaaucaggggugaucgccgacuggcucguaagagauaugaugcgguuccaacccguugccaaagacgccuccgguaaaccauugaacaacucuaaagcgaacagcaccgaauaccgcaugcugcaacgcgcccucgcucuuuucggcggcgagaaagagcggcucacaccguacuuccggcagaugaaccugacaggaggaaacaacccccaccccuuccuacacgacacgagaugggaaucccacacaaacauacucuccuucuacaggaguuacuugcgcgcacgaaaagccuuccuugaaagaauaggacgcuccgaccgaauggaaaacagaccauuccuccuacuaaaggaacccaaaacagaccgccagacgcuggucgccggcuggaaaagcgaguuccaucugccaaggggcauauucacugaagcagugagagacugccucauagaaaugggcuacgacgaaguuggaucuuaccgcgaaguaggguucauggccaaggcagucccacucuacuucgaacgugcaugugaagaccgcguacaacccuucuacgacucacccuucaacgugggaaauucuuuaaaacccaagaaaggccgcuuccuauccaaagaggaacgcgcagaagaaugggagcggggaaaagaaagauuccgagaccuagaagcauggagccacagcgccgcaagacgaauagaagaugcauucgcggguauagaauacgcuuccccaggcaacaagaagaaaaucgaacaacuccuacgugaccucucacucugggaagccuucgaaagcaaacugaaagucagggccgacaaaauaaaccucgccaaacuaaagaaagaaauccuagaagcccaagaacaccccuaucacgacuucaaauccuggcaaaaauucgagagagagcugcgacucgucaaaaaccaagacaucaucaccuggaugaugugucgcgaccuaauggaggaaaauaaaguagaaggacucgacacuggaacccuauaccugaaagacauacguacaaacgugcaagagcaaggaagccugaacguccuuaaccacgucaaaccaaugcgacucccugucgucguauaccgagcagacucgcgcgggcauguacacaaagaagaagcgccccucgccaccguuuacaucgaagaaagagauacaaaacuauuaaaacaaggaaauuucaaauccuuugugaaagaccggcgucugaacgggcuauucucauucguagacaccggcggccuagccauggagcaauaccccaucagcaaacuucgcguugaauaugaacuagccaaauaccagacggcuagagucugcgccuuugagcaaacuuuggaacucgaagagucgcuucucacccgcuacccacaccuccccgacaaaaacuuccgcaagaugcuggaaagcugguccgacccccuacuagcuaaauggcccgaacuccauggaaaaguccgccuacuaaucgccgugcgaaacgcauuuucucacaaccaauaccccauguaugacgaggcagucuucaguuccauaagaaaauacgacccaagcuccccagacgccauugaggaacgcaugggccugaacaucgcacauaggcucucagaagaggucaaacaggccaaggaaacggucgaacgcaucauucaagccuaa

SEQ ID NO: 11685 - RNA, 3528 nt, Artificial Sequence
  Cas13b variant__Porphyromonas gulae__WP_039434803.1__Cas13b
augacagaacaauccgaacgcccguacaaugggacauauuauacccuagaagacaaacauuucugggcggcuuuccucaacuuggcccgucacaacgcauauauaacccucacucacaucgaccgccaacuagccuauagcaaagccgacauaacaaacgaucaagacguucuaucuuucaaagcacucuggaaaaacuucgacaacgaccucgaacgaaaaucucgacugcgcagccuaauacuuaaacacuuuucguuccuagaaggcgccgccuacggcaagaaacuauuugagaguaaguccagcggcaacaaaagcuccaaaaacaaagaacuaaccaagaaagagaaagaagaacuucaagccaacgcccuaagccuagacaaccuaaaaagcauccuauucgacuuucuacaaaaacucaaggacuuccgcaauuacuacucucacuaccgccacagcggcuccucggaacuaccccucuuugacggcaacaugcuccaacgacuguacaacguauuugacgucagcguacaacgcgucaagaucgaccacgaacacaaugacgaaguagacccccacuaccacuucaaucaccuaguacgcaaaggcaagaaagaccgauacggccacaacgacaacccuagcuucaaacaucacuucguagacggcgagggcaugguaaccgaagccggccuccuauucuucgugucccuauuccuggaaaaacgcgacgcaaucuggaugcaaaagaaaauucgcggauucaaaggagguacagaaacuuaccagcagaugacgaacgaggucuuuugcaggucacggauuucccuacccaaacucaaacuugaaucccuacgcauggaugacuggaugcugcuagacaugcucaacgagcuagugcgcugccccaaaccgcuauacgaucgccuccgcgaagacgaccgcgcuugcuuccggguaccuguagacauucuuccagacgaagacgacaccgacgggggcggcgaagacccuuucaagaacacccucgucagacaccaagaccguuucccguauuuugcccuccgauacuucgaccucaaaaaggucuucacaaguuugcgauuucacauagaccucggcacguaccacuucgcgaucuacaagaaaaugaucggugaacaaccggaagaccgucaccuaacaaggaaccucuacgguuuugggagaauccaagacuuugcagaggaacaccgaccagaagaauggaaacgccugguacgcgauuuagacuauuuugaaacuggugacaaacccuacaucagccaaaccucaccccacuaccacauagagaaagguaaaauaggccucagauuuaugccugaagggcagcaccuauggcccucuccagaggucggcaccacccgcaccggacgcagcaaauacgcccaagacaagcggcuaacagcagaggccuuccuauccgugcacgagcuaaugcccaugauguuuuacuacuuccuccuaagagaaaaguacagcgaagaagucagcgccgaacggguccaaggccggauaaagcgcguuauagaagacgucuacgcugucuacgacgccuucgcccgcgacgaaauuaacaccagagacgagcucgacgcuugccuagcagauaaaggcauucggcgcggacaccuuccccgccagaugauagcaaucuugucccaagaacacaaagacauggaagagaaaauaagaaagaaacuccaagaaaugauggccgauacagaucaccgguuggacauguuagaccgccagacagaucguaaaauccgaaucggacgcaaaaacgcaggccuccccaaaucaggcgucauagcagacuggcugguucgcgacaugaugcgcuuccaaccaguagccaaagacgcaagcggcaaaccacuaaacaacucaaaagcgaacuccaccgaauacagaaugcuccagcgcgcacuagcucuauucggaggcgaaaaggagagacucacccccuacuuccgacaaaugaaucucacaggcggcaacaacccccacccuuuccuacacgaaacccgaugggaaucacacaccaacauccugagcuucuaucgaucauaccugcgagcgcgcaaagcguuccuugaacgcauaggaaggagcgaucgaguagaaaaucgcccauucuuacuacuaaaagaaccaaaaaccgaucggcaaacccuggucgccggauggaaaggcgaauuucaccuaccgagaggcaucuucacggaggcaguaagggacugucuaaucgaaaugggccacgacgaaguugccagcuauaaagaaguaggguucauggccaaagcagugccccucuacuucgagcgcgccugcgaggacagaguacagccauucuacgacucccccuuuaacgucggaaacagccugaaaccaaagaaaggacgcuuccucagcaaagaagaacgcgccgaggaaugggaacgugggaaagaacgcuuccgggaccuagaagccuggucuuauuccgccgcccgccguaucgaagacgcguucgcaggcauugaauaugccucaccaggcaauaaaaagaagaucgaacaacucuugcgagaccuuucacugugggaagccuucgaaagcaaacucaaaguccgagcggaccgaaucaaccuggccaaacuaaagaaagagauacuagaagcacaagagcaccccuaucacgauuucaaaucauggcagaaauucgaaagggaacucaggcuagucaagaaccaagacauaauaacauggaugauguguagggaccuuauggaagaaaacaagguagaaggucucgacacagggacacucuaccugaaagacauacgccccaacguucaagaacaaggcucccugaacgugcuaaaccgcguaaaacccaugcgccuacccguagucgucuaccgagccgacagcaggggccacguacacaaggaagaagcaccccuagccacaguauacaucgaagaacgcgacaccaaacuacuaaaacagggaaacuucaagaguuucgucaaagaccgcagacucaacggccuguucucauucguagacacuggcggccuggcgauggagcaauacccaauauccaagcuacgcgucgaauacgagcuagcaaaguaccagacagcucgcguaugcgucuuugaacucacccugcgccucgaagaauccuuacucacaagauacccacaccuccccgacgaauccuucagagagaugcucgaauccuggucggacccgcugcucgccaaauggccagaacuacacggcaaaguacgucuccugaucgccguacgcaacgcauucucccacaaccaguaccccauguacgacgaagcagucuucagcagcauaaggaaauaugaccccucaucucccgacgcaaucgaggaacgcaugggccucaacauagcacaccgccuguccgaggaaguaaagcaggcuaaagagaccgucgaacgaauuauccaagccuag

SEQ ID NO: 11686 - RNA, 3528 nt, Artificial Sequence
  Cas13b variant__Porphyromonas sp.__WP_039428968.1__Cas13b
augacagaacaauccgagcggccauacaacggaacguacuacacacucgaggauaagcacuucugggcggccuuccuuaaccucgccaggcacaacgccuacaucacgcucacccauaucgacagacaacuggcauacuccaaagccgacaucaccaacgaccaagacguacugagcuucaaggcccuauggaaaaacuucgauaaugaccuugaacgcaaaucccgccuacguucacuaauccuaaagcacuucuccuuccuggaaggcgccgccuacggcaagaaacucuucgaauccaagagcucagggaacaaaucaagcaaaaacaaggagcuaaccaagaaagaaaaggaggaacuacaagcuaacgcacucuccuuagacaaccuaaaaagcauacuauucgacuuucuacaaaaacucaaggacuucaggaacuacuacucacauuaccgccacagugaaucaucggaacugccacucuucgacggaaacaugcugcagcgccucuauaacgucuuugacgucuccguacaaagagucaagagggaccacgaacacaaugacaaaguagacccccaccggcauuucaaucaccucguccggaaaggaaagaaagaucgcuacggccacaacgacaaccccagcuucaaacaucacuucgucgacucagaaggcauggucaccgaagcaggacuacucuucuucgucucucucuuccucgaaaaacgggacgccauauggaugcaaaagaaaauucgcgguuucaaaggagguaccgaaaccuaucaacaaaugaccaacgaagucuucugccgcucccgcauaagccuccccaaacucaaauuagagagucugcgcacggacgacuggaugcuacuagacaugcugaacgagcucguacgcugccccaaaccccucuaugaccgccucagagaagacgaccgcgcaugcuuccgcguccccguagacaucuuaccagacgaagacgauacugacgggggcggagaagauccauuuaaaaacacccuggugcgccaccaagacagauucccguacuucgcacuacgcuacuucgaccucaaaaagguuuucacaucucuacgauuccacaucgaccugggaaccuaccacuucgccauauacaaaaagaugaucggagaacagccagaagacaggcaccugacccguaaccuauauggguucggacgaauacaagacuucgccgaggaacaccgcccggaggaauggaaacgcuuaguccgugaccuugacuauuucgaaacaggcgacaaacccuauaucucucaaacaacaccacacuaucacauugaaaaagguaaaauugggcuacgcuucgucccagaaggacaacaccucuggccguccccggaagucggaacuacccgaaccggcagaucaaaauacgcccaagacaaacgacucacagccgaggccuuccucagcguccacgaacucaugccaaugauguucuacuacuuccuacuacgagagaaauacagcgaagaaguaagcgccgagaaaguccaggggcggauaaaacgaguaauagaggacguauaugcaauauacgacgcauuugcccgcgaugagauaaacacucuaaaagagcucgacgcaugccucgccgacaagggcauccgccgcgggcaccuaccaaaacaaaugauaggcauucuaucccaagaaaggaaggacauggaagagaaaguacgcaagaaacuacaagagaugauagcagacacagaccauagacuggacaugcuagaccgacagaccgaccgcaaaauucgaaucggcaggaaaaacgccggacucccgaaauccggcgucaucgcagacuggcugguucgagauaugaugcgauuccagccaguggccaaagauacuagcggcaaaccgcugaacaacuccaaggcaaacucaaccgaguaccgaaugcuacaaagagcccucgcccuuuucggaggugaaaaagaacgcuuaacaccguacuuccggcaaaugaaccucaccggcggcaacaacccccacccauuccuccacgaaacucgaugggagucacacaccaauauccuguccuucuaccgaaguuaucugcgugcccgcaaagcauuucuagaacggauuggacgaucagaccgcguagaaaacugcccauuccuauuacucaaagaaccaaagaccgaucggcagacccuggucgccgguuggaaaggcgaguuccaccuaccgcgagguauauuuacggaagccguccgagauugccucaucgaaaugggcuacgacgagguaggaucauaucgcgaaguaggauucauggcuaaggccgugccacuauacuucgagagagcuugcgaggacaggguccagcccuucuacgauucacccuucaauguaggaaacagccugaaaccgaaaaagggcagauuccuaucaaaggaagaucgcgcagaagaaugggaacgcggcaaagaacgcuuccgugaccuugaagcauggucccacagcgcagcgcgccgcauaaaagacgcauucgcaggaauagaauacgccucccccggcaacaagaagaaaaucgaacagcugcuccgcgaccuaucucuaugggaggcuuucgaaucgaaacucaaagugcgagccgacaaaauaaaccuagcgaaacucaagaaagaaauacucgaagcacaggaacaccccuaccaugauuucaaaucuuggcaaaaauucgaacgcgaauuacgacucguuaaaaaccaagacauaaucacauggaugaugugccgcgaccucauggaagaaaacaaagucgaaggccucgacaccgggacccuguaucucaaggacauccgcccaaacguccaggaacagggaucucucaacguccuaaauagagucaaaccuaugcgccuaccagugguagucuaccgcgcagacucaagaggccacguacacaaggaagaagcgccgcuggccaccguauacaucgaagaacgcgacaccaaacuccuaaaacaaggaaacuucaagagcuucgucaaagaccgccgccuaaauggccuuuucagcuucgucgacaccgguggccuagccauggaacaauauccaauaagcaaguuacgcguugaguaugaacucgcgaaauaccaaacggcgcgcguaugcgucuucgaacucacacuccgccucgaagaaucccuccugagccgauacccccaccuccccgacgagagcuucagagaaaugcuagaaagcuggucagacccgcuccuugccaaauggccagagcuccacggaaagguccgccuccuaauagccguaagaaacgccuucagccacaaccaauacccaauguacgaugaagcagucuuuucaucaauacggaaauacgacccuagcucacccgacgcaaucgaagaacgcauggggcucaacaucgcgcaccgccuaagcgaagaagucaaacaagcaaaggaaaccgucgaacgaauaauccaagcauag

SEQ ID NO: 11687 - RNA, 3375 nt, Artificial Sequence
  Cas13b variant__Prevotella aurantiaca__WP_025000926.1__Cas13b
auggaggacgacaagaagacuacgggaucgaucucguacgaacucaaagacaaacacuucugggcggccuuccucaaccuagcgaggcacaacgucuacaucaccaucaaccacaucaauaagcuccucgagauacgugagaucgacaacgacgagaaaguccucgacauaaaaacccuuuggcagaaagguaacaaagaccucaaccagaaagcccgccugcgagagcucaugacgaaacacuuccccuuucuagaaacugcaauauacacgaagaacaaagaagacaagaaggaggucaagcaagaaaaacaagcagaagcacagucgcucgaaucccucaaggacugccuguuccuguuccuugacaaacuucaggaagcccgcaacuacuacucccauuacaaauacagcgaguucaguaaagaaccggaguucgaagaaggacuccucgagaaaauguacaacaucuucgggaacaacauccaauuaguaaucaacgauuaccaacauaacaaagacaucaacccagacgaagacuucaagcaccucgaucgaaagggccaauucaaauacuccuuugccgauaaugaaggcaacaucaccgaauccggccuccucuucuucguaucacucuuccucgaaaagaaagaugccaucuggaugcaacaaaaauuaaacggcuucaaggacaaccucgaaaacaagaaaaagaugacccacgaaguauuuugccguucacggauacuaaugccaaaacuccgccuggaguccacccagacccaggacuggauacuucuggacaugcugaacgaacuaauccguugccccaagagcuuguacgagcgccuccaaggagacgaccgagagaaauucaaagugcccuucgacccagcagacgaagacuacaacgccgaacaagagcccuucaaaaauacgcuaauccgacaccaagaccgcuuccccuacuucguccuccguuacuucgacuauaaugaaaucuuuaagaaccugcgauuccaaaucgaccucggcaccuaccacuucagcauauacaagaaacugaucggcggacaaaaagaggaucgccaccucacacacaaacuuuauggcuucgaacgcauccaagaguucgcgaaacaaaaccgcccagacgaauggaaggcuaucgucaaagaccuggacacauacgagacuagcaacaagcgguauauaagcgagacaacgccccacuaccaccucgaaaaccagaagaucggaauaagguucaggaaugggaacaaggaaaucuggccaagccuuaaaacaaaugaugagaacaacgagaaauccaaguacaaacucgacaaacaguaccaggccgaagccuuccucagcguccacgaacuuuugcccaugauguucuacuaccuccugcucaaaaaggaaaaaccgaacaaugaugaaaucaacgccuccaucgucgaaggcuucaucaagcgagaaauccgcaacaucuucaaacuuuacgacgccuucgcaaacggcgaaaucaacaacauagacgaccucgagaaauacugcgcagacaaaggcaucccgaaacgccaccuaccaaaacagaugguggcaauacuauacgacgagcauaaggacauggucaaagaagcaaaacgcaaacaaaaagaaaugguaaaggacaccaaaaagcuccucgcaacacuggaaaaacaaacacaaaaagaaaaggaagacgacggacgcaacgucaaacuacucaaaucgggagagauugcccgcuggcucguaaacgauaugaugcgcuuccaaccgguccagaaagacaacgaagggaagccccuuaacaacuccaaggccaacucaaccgaauaccaaaugcugcagcgaucccucgcacuauacaacaaugaggagaaacccacccgcuacuucaggcaagucaaccuaaucgaauccaacaacccccaccccuuccugaaguggacaaagugggaagaauguaacaauauccugacauucuacuacucguacuugacgaagaaaauagaguuccuaaacaaacugaaacccgaagauuggaagaaaaaccaauacuuccucaaacuaaaagaaccgaaaaccaaccgcgaaacgcugguccaaggguggaaaaacggcuucaacuuacccagagggauauucaccgaacccauacgagaaugguucaaacgacaccaaaacaacucaaaagaauaugagaaagucgaagcacuagaccggguugggcucguaacaaaggucaucccacuauucuucaaggaagaauacuucaaagacaaagaagaaaacuucaaggaagacacccagaaagagauuaacgacugcgugcagccauuuuacaauuuccccuacaacgucggcaacauccacaaacccaaggaaaaggacuuccugcaccgcgaggaacgaaucgaacucugggacaaaaagaaagacaaauucaaaggauacaaagagaaaauaaaaagcaagaaacucacggaaaaagacaaagaagaguucaggucauaccucgaguuccaaagcuggaauaaguucgaacgagaacuccgucuggugcgaaaccaagacaucgucacauggcugcucugcaaggaacuaaucgacaaacuaaaaauagacgaacucaacauagaagaacucaagaaacuacgacucaacaauaucgauacagacacggcaaagaaagagaaaaacaacauccucaaccgcgugaugccuauggagcugcccguaaccguauaugagaucgacgacucacauaaaauagucaaagacaaaccccuccacaccauauacauuaaagaagccgagacaaaacuccucaaacaagggaauuucaaagcccucgucaaagacagacgucucaacggccuguucagcuucguaaaaacaaacucagaagcagagagcaaacgcaaccccauuucaaaacuccgaguagaauaugagcuaggagaauaucaggaagcacgcauagagaucauccaagauaugcuagcccuugaagagaaacuaauuaacaaauacaaagaccuaccaacaaauaaauucucagagauguuaaacuccuggcuagaaggcaaagacgaagcagacaaagcccgcuuccagaacgacgucgacuuccuaaucgccgugcgaaaugcauucucucacaaccaguacccaaugcacaacaaaaucgaauuugcaaacaucaaacccuucucccuauacaccgcaaacaacucugaagaaaaaggccuaggcaucgcaaaccaacucaaagacaaaaccaaagagaccaccgacaagaucaagaaaauagagaaacccauugaaacaaaagaguaa

SEQ ID NO: 11688 - RNA, 3384 nt, Artificial Sequence
  Cas13b variant__Prevotella buccae__EFU31981.1__Cas13b
augcaaaaacaggacaagcuguucguagacagaaagaagaacgccaucuucgcuuuccccaaguacaucacaauaauggaaaacaaggaaaaaccagaaccaaucuacuacgaauuaaccgacaagcacuucugggcagcauuccucaaccucgcccggcacaacguguacacaaccauaaaccacauuaaccgacggcucgaaaucgcagagcucaaggacgacggguacaugaugggcaucaaaggcagcuggaacgaacaggccaagaaacucgauaagaaagucaggcugcgcgaccuuaucaugaaacacuuccccuuccucgaggcugcugccuaugaaaugacgaacuccaaaucccccaacaacaaagaacaacgggagaaagaacaguccgaagcccucagccucaacaaccucaaaaacguacucuucauauuccuugagaaacuccaaguccuucggaacuacuacucucauuauaaguacucagaagagagucccaagcccaucuuugaaaccucccuccuaaagaacauguacaaaguuuucgacgccaacguccggcucgucaaacgggacuacaugcaccacgaaaacaucgauaugcaacgagacuucacccaccuaaaccgcaaaaagcaagucggccgaacgaagaacaucaucgacaguccuaacuuccacuaccacuucgccgacaaagaggggaacaugaccauagcaggacuacuuuucuucgucucccucuuccucgacaagaaagacgcaauuuggaugcaaaagaaacucaaaggcuucaaagauggacgaaaucucagagaacagaugaccaacgaagucuucugccgaucccgaauaucacugccuaaacucaaacucgagaacguucagaccaaagacuggaugcaauuagauaugcuaaacgagcuagugcgaugcccgaaaagccuauaugaacgacuaagagaaaaagaccgggaguccuucaaaguacccuucgacauauuuuccgacgacuacaacgccgaagaagaaccuuucaaaaacacccucgugaggcaccaagaccgcuuccccuacuuuguccuccguuacuuugaccucaacgagauuuucgaacaacuccgauuccaaauagaccuuggcacauaccauuucagcauuuacaacaagcgaaucggagacgaagaugaaguccgacaccucacccaccaccuguacggguucgcccggauccaagauuucgcgccgcaaaaccagcccgaagaauggcgcaagcuagucaaagaccucgaccacuuugaaaccucgcaggaaccauacaucagcaaaacugcaccccacuaucaccuagagaacgaaaagaucggaauuaaauucugcagcgcgcacaacaaucucuuccccagucuccaaaccgacaaaaccugcaacggacguuccaaauuuaaccuaggcacacaauuuaccgccgaggcuuuccuguccgugcacgaacuccuacccaugauguucuauuaucuccuacucacuaaggauuacuccagaaaagaaagcgcugacaaagucgaaggaaucauccgcaaagaaaucucaaacaucuacgcaaucuacgacgccuucgccaacaacgaaauaaacucaaucgccgaccuaacccgcagacuccaaaacacaaacauucuccaagggcaucuccccaagcaaaugauaucaauccuaaagggcagacaaaaagacaugggcaaggaagccgaacgcaaaaucggagaaaugauagaugacacacagagaaggcucgaccuccuaugcaagcagacgaaucaaaagauacgaauaggcaaacgcaaugcuggucuacuaaaauccggcaagaucgcugacuggcucgucaaugacaugaugagguuucagccaguccaaaaagaccaaaacaacauucccauaaacaacuccaaggccaauucgaccgaguacagaaugcuccaacgggcccucgcccuguucggcagcgaaaacuuccggcucaaagcauacuucaaccaaaugaaccucgucggcaacgacaauccucacccguuccuggcggaaacccagugggagcaccaaaccaacauacucucauucuauagaaacuaucucgaggcacguaaaaaguaucuaaaaggccucaaaccccagaacuggaaacaauaucaacacuucuuaauauugaaaguccaaaagacaaaccgaaacacguuggucaccggcuggaaaaacuccuucaaccuaccgcguggcaucuuuacacagccaauccgcgagugguucgagaaacacaauaacucuaaaagaauuuacgaccaaauccucuccuucgaccgagugggcuucguagcuaaggcaaucccgcuauacuucgcagaggaauacaaagacaacguccaacccuucuacgacuaucccuucaacauuggaaaccgccuaaagcccaaaaagcgccaauuccucgacaaaaaggaacgcguggagcuuuggcagaaaaacaaagaacucuuuaaaaacuacccaagugaaaagaagaaaacggacuuagcauaccuggacuuccucucguggaagaaauucgagcgugagcuacgccugaucaaaaaccaagacauugugaccuggcucauguucaaagaacuauucaacauggccaccguggagggccuaaaaaucggagaaauccaccuccgcgacauagauacgaacaccgccaacgaagagagcaacaacauucuaaaccgcaucaugccaaugaaacuucccgucaaaacguacgagaccgauaacaaaggcaauauccuuaaggagcgaccccucgcaaccuuuuacaucgaagaaacagagaccaaagugcucaagcaaggcaacuucaaagcccucgucaaggaccgacgucucaacggccucuucuccuucgcggaaaccacagaccucaaccuagaggaacacccaauuuccaaacuaucuguggacuuagagcucauaaaguaccaaacgacucgaauauccauauucgaaaugacccuuggccucgaaaagaagcuaauagacaaauacucuacgcugccaaccgauuccuuccgcaacaugcucgaaagauggcuccaauguaaagccaaucgccccgaauugaagaacuacgucaacucccugauugccguccgcaacgcauucucucauaaccaguacccuauguacgacgcuacacucuucgcggaagucaagaaauuuacacucuuccccagcguagauaccaagaaaaucgaacucaacaucgcgccacaacuccuagaaaucgugggcaaggcaaucaaggaaaucgagaaaagcgaaaacaaaaacuag

SEQ ID NO: 11689 - RNA, 3384 nt, Artificial Sequence
  Cas13b variant__Prevotella buccae__WP_004343581.1__Cas13b
augcagaagcaagacaaacuguucguugaccguaagaaaaacgcgaucuucgccuuucccaaauacauaaccaucauggaaaaccaggaaaaaccagaacccaucuauuacgaacucacugacaaacacuucugggccgccuuccucaaccucgcaaggcacaacguauacaccaccaucaaccacaucaaucgccggcuagagaucgccgaacuaaaagacgaugguuacaugauggauaucaaaggcucauggaacgaacaggcaaagaaauuagacaagaaaguccgacuccgagaucuaaucaugaaacacuucccuuuccuagaagcagcagccuacgagaucacgaauaguaaaaguccaaacaacaaggaacaacgggagaaagagcaauccgaagcccuaucacucaacaaccucaaaaacguacucuuuaucuuccucgagaagcuccaaguccuacgaaacuacuacagccacuacaaauauagcgaagagagccccaaacccauuuucgaaaccagccuccuuaaaaacauguacaaggucuuugacgccaacguccgucucgucaaaagagauuacaugcaccacgaaaauaucgacaugcaacgcgacuucacccaccuaaaccgaaagaaacaggucggccggaccaaaaacaucauugacucaccaaacuuccacuaccacuucgcggacaaagaaggcaacaugaccaucgcaggacuucuauucuucgugagccucuuccucgauaagaaagacgccauauggaugcagaagaagcuaaaaggcuucaaagacggucgaaaccuccgggagcaaaugacaaacgaagucuucugccgaucgcgcaucagcuuaccuaaacucaagcuggagaacguccaaaccaaagacuggaugcagcuagacaugcucaacgagcuuguacgcugccccaaaucccucuacgaacgccuccgggaaaaagacagagagucauucaagguuccguucgacaucuucucugaugauuacgacgccgaagaagaacccuucaaaaacacacucguacgacaucaagacagauuucccuacuucgucuuacgguacuuugaccucaacgaaaucuucgaacaacuccgcuuccaaaucgaccucgguaccuaccacuucaguauuuacaacaagagaaucggcgacgaggacgagguuagacaccuuacccaccaccuguacggcuucgcccgcauucaagacuucgcccagcaaaaucaacccgagguauggaggaagcuaguaaaagacuuggauuacuucgaagccagccaagaaccauacauccccaaaacagcaccacacuaccaccuagagaacgagaaaaucgguaucaaauucugcuccacacauaacaaccuauuuccgucccugaagacagagaaaacaugcaacggacgcuccaaauucaaccucgguacacaauucaccgccgaagccuuccuaucuguacacgaacuccuaccgaugauguucuacuaccuucuccucacgaaagacuacucacgaaaggaaagcgcagacaaaguagaagggauuauacgcaaagagauaagcaacauauacgcaauauacgaugcguucgcgaacggcgaaaucaacucuaucgccgaccuuacaugccgccuucaaaagaccaacauccugcaagggcaccucccaaaacagaugauauccauacucgagggccgacaaaaagacauggaaaaggaagccgaacgcaaaaucggcgagaugaucgacgacacgcagcgaaggcucgaucuauugugcaagcaaaccaaccaaaagauccggaucgggaaacgcaacgcuggccuccugaaaucaggaaagaucgcugacuggcucgucaacgacaugaugcgcuuccagccaguccagaaagaccaaaacaacauccccaucaacaacagcaaagcaaacuccacagaauaccgcaugcuccaaagagcacucgcucucuucggguccgagaacuuccgacugaaggcauacuuuaaccagaugaaccucgucggaaacgacaacccacaucccuuccuagcagaaacccaaugggaacaccagaccaacauacuuagcuucuaccgaaauuaccuggaagcccgaaagaaguaccucaaaggccucaaaccccagaauuggaaacaauaccaacauuuccucauucugaagguccagaaaacgaaccgaaacacucugguaaccggauggaagaacagcuuuaaccuaccacguggaauauucacccagcccauccgcgaaugguucgagaagcacaacaacuccaaacgcaucuacgaccaaaucuugucuuucgaccgcguaggcuuugucgccaaggccauaccccucuacuucgcggaagaauacaaagauaauguccagcccuucuacgacuaccccuuuaacauaggaaacaaacucaagccacagaagggacaauuucuagacaaaaaggaaagaguggagcuauggcaaaagaacaaagagcuauucaagaacuauccgagcgagaaaaagaagaccgaccuugccuaccucgacuuccucuccuggaagaaguucgaaagggaguuacgacuaaucaaaaaccaagacauaguaacauggcucauguucaaagaacuguucaacauggccacgguagaaggccugaagaucggcgaaauccaucucagagauaucgacacaaacacugcgaacgaagaaagcaacaacauacuuaaccgaauaaugcccaugaaacugcccgucaaaaccuacgaaaccgauaacaaaggcaauauccucaaagaacgcccccuagcgaccuucuacauagaggaaaccgaaacaaaaguacucaaacaggguaacuucaaaguacucgccaaagaccgccgcuugaauggacugcuguccuucgcggaaaccaccgacauagaccuagagaagaaccccaucacaaaacucucagucgaccacgaacucauuaaauaccaaaccacgcgcauuuccaucuucgaaaugacacucggccucgagaaaaagcugaucaacaaauacccgacucucccuaccgacucauuccgcaacaugcuggaacgguggcuacaaugcaaagcgaaccgccccgaacucaaaaacuacgucaacagccuaaucgccguacgcaacgcuuucagccacaaccaauaccccauguacgacgcaacccucuucgcagaagucaagaaguuuacacuuuuccccuccguggauacgaagaaaauagaacucaacauagcaccccaacuacucgaaauagucggcaaggcuauuaaagaaaucgaaaaauccgagaacaaaaacuaa

SEQ ID NO: 11690 - RNA, 3402 nt, Artificial Sequence
  Cas13b variant__Prevotella falsenii__WP_036884929.1__Cas13b
augaaaaacgacaacaacuccacaaaauccacugacuacacacuaggcgacaagcacuucugggccgccuuccucaaccuagccagacacaacguauacaucaccguaaaccacaucaacaagguccucgaacugaaaaacaagaaagaccaggaaauaaucaucgacaacgaccaagacaucuuggcaauaaaaacccucuggggaaaaguggacacagacaucaacaagaaagaccggcuccgcgaguuaauaaugaaacacuuccccuuccuugaagccgccaccuaccaacaaucuagcaccaacaacacgaaacagaaagaagaagaacaagccaaagcacagagcuucgagagccuuaaagacugccuguuucuauucuuagaaaaacuccgcgaggcccgaaacuacuacagccauuacaagcacucgaaaucacuggaagaaccaaaacuggaggagaaacucuuggagaauauguacaacaucuucgacacgaacguccaacuggucaucaaagacuacgagcacaacaaagacaucaacccagaggaggacuucaagcaccugggccgagcagaaggcgaguucaacuacuacuuuacacgaaacaagaaaggcaacaucacugaaagcgggcuacucuucuucgucagucuguuucucgagaaaaaggacgccaucugggcccaaaccaaaauuaaagguuucaaggacaaccgagaaaacaagcagaaaaugacgcacgaaguauucugucggucccgaaugcuacucccgaaauugcgacuagaaucgacacaaacucaagacuggauacuccucgacaugcucaacgagcuuauccggugccccaagucacuauacaaacgauugcaaggagaaaagcgcgagaaguuccgcguacccuucgacccagccgacgaagacuacgacgcagaacaagaacccuucaaaaacacccuagugcggcaccaagaccgcuucccauacuuugcccuccgcuacuucgacuacaacgagauauucacaaaccuccgcuuucagauagaccuaggcacguaucacuucagcaucuacaaaaagcaaaucggcgacaaaaaggaagaccgccaucugacacacaaacucuacggauucgaaagaauacaagaguucgcgaaagaaaaccgaccugacgaauggaaggcccuaguuaaagaccuagacaccuucgaagaaucgaacgaacccuacaucucugagacaacaccacacuaccaccuggaaaaccaaaagaucggcauacgcaacaaaaacaaaaagaagaagaaaacaaucuggccgagccucgagaccaaaaccaccgugaacgaacgaucaaaauacaacuuggggaaaucuuucaaagcagaagccuuccucagcguccacgagcuccuacccaugauguucuacuaccuccuccuaaacaaagaagaaccaaacaacggcaaaaucaaugccagcaaaguugaagggaucauagagaagaaaauccgcgacaucuacaaacucuacggagccuucgcaaacgaagaaaucaacaaugaagaagaacuaaaagaauacugcgagggcaaagacaucgcgaucaggcaccucccgaaacaaaugaucgcaauacugaaaaaugaauacaaggauauggcaaagaaagccgaggacaaacagaaaaagaugaucaaggacaccaagaagagacuagcugcacucgacaaacaggucaagggcgagguagaagacggcggccgcaacaucaaaccccucaagucaggccgcauagccuccuggcucguuaacgacaugaugcgauuccaaccagugcaacgagaccgagauggcuacccucuaaacaacagcaaggcaaacuccacggaauaccagcuccuacaacggacacucgcccucuucggcuccgaacgugaaagacuagcaccauacuuucgacaaaugaacuuaaucggcaaggacaacccccauccauucuugaaagacaccaaguggaaagaacacaacaacauacugucguuuuaccggucauaccucgaagcgaagaaaaacuuccucggcagccucaaaccggaagacuggaaaaagaaccaauacuuccuaaagcucaaggaacccaaaaccaacagagaaacccucguucaaggcuggaaaaacggguucaaccugcccaggggcaucuucaccgaaccgauacgggagugguucauccggcaucaaaacgaaagcgaagaguauaaaaaggucaaggacuucgaccgaaucggccuaguugccaagguaaucccccuauucuucaaggaagacuaccaaaaagagauugaagacuacguccaaccauucuacggcuauccguuuaacguagggaacauacauaauagccaggaagguaccuuccucaacaagaaggaacgagaagaacucuggaagggcaacaaaacgaaguucaaagacuacaaaaccaaagagaaaaacaaagagaaaaccaacaaagauaaauucaaaaagaaaaccgacgaagaaaaagaagaguuccgauccuaccucgacuuccagaguuggaagaaauuugaacgggaacuacgucuaguacgcaaccaggacauugucaccuggcucuugugcauggaacugaucgacaaacuaaaaaucgacgagcucaauaucgaagaacuucaaaaacugcgccuaaaggacauagauaccgacacugcaaagaaagagaaaaacaacauccucaaccgcaucaugccaauggaacuccccguaaccguguacgaaacggacgauucaaacaacaucaucaaagacaaaccacuccacacgauauauauaaaagaagcggaaaccaagcugcucaaacagggaaacuucaaagcccucgucaaagaccgacggcuaaacggcuuguuuuccuucgucgaaacauccagcgaagcagaauuaaaauccaagccgaucuccaaaucccuaguggaauacgaacucggagaauaccagagagcaagagucgagauaaucaaggacaugcugcgccucgaagaaacgcucaucggcaacgacgaaaaacuacccaccaacaaguucaggcaaaugcuggacaaauggcucgagcauaagaaagaaacugacgacaccgaccuuaagaacgacguaaaacugcuaacggaaguacggaacgccuucucacauaaccaauauccaaugcgcgacagaauagcauucgcaaacauaaaaccuuuuucucuaaguagcgccaacaccagcaacgaagaaggucucggcauugcgaagaaacuaaaagacaaaaccaaggaaaccaucgauagaaucauagaaaucgaggaacaaaccgcaacgaaacgguag

SEQ ID NO: 11691 - RNA, 3402 nt, Artificial Sequence
  Cas13b variant__Prevotella intermedia__BAU18623.1__Cas13b
auggaagacgacaagaaaaccaccgacagcauaucauacgaacucaaagacaaacacuucugggccgcauucuuaaacuuggcccgccacaacgucuauaucacagucaaucacaucaacaagguucucgagcucaaaaacaaaaaggaucaagacaucauaaucgacaacgaucaagacauccucgcaaucaaaacccacugggagaaaguaaacggggaccuaaacaagacagagcgccugcgagagcuaaugacaaaacacuuccccuuucucgagacagccauuuacuccaaaaacaaagaagacaaagaagagguuaaacaagaaaaacaagccaaggcgcagagcuucgauucccucaaacacugccucuuccuauuccucgaaaaacuccaagagacccgcaacuacuacagccacuacaaauacucagaaucgaccaaggaacccaugcuggaaaaggagcuccucaagaaaauguauaacauauucgacgacaacauacaguuaguaaucaaagauuaccaacauaacaaggacauaaacccagacgaggacuucaagcaccucgaccgaaccgaggaagacuucaacuacuacuucacgcgaaacaagaaaggcaacauuacggaaucaggccuccuguucuucguaucucucuuccucgaaaagaaagacgccaucuggaugcagcaaaaacuaagagguuucaaagauaaccgagaaaguaagaagaaaaugacacacgaggucuuuugccggagccggaugcugcuaccaaaacugcgccuagagucaacucagacacaggacuggauacuccuggauaugcuaaacgaacucauucgaugcccuaaaagccuauacgaacgccugcaaggagaagaccgugaaaaauucaaagugcccuuugaccccgccgacgaagacuacgacgcugaacaagaacccuucaaaaacacccuagucaggcaccaggaccgguucccauacuuugcgcuuagauacuucgacuacaacgaaaucuucaccaaccuccgauuccagauugaccuggggacguuccacuucucgauauacaagaaacucauaggcggacagaaggaagaccgccaccuaacacacaaacucuacggauucgaacgcauccaggaguucgccaaacagaaccgacccgaugaauggaaagcaauaguaaaggaccuugacaccuacgaaaccuccaacgaacgauacaucucagaaacgacaccccacuaccaccuggaaaaccagaaaaucgggauacgguuccgaaacgacaacgacgaaaucuggccgucccucaagaccaacggagagaacaacgagaaaagcaaauacaaacuagacaagcaauaccaagccgaagccuuucuuagcguccacgaauuacuaccgaugauguucuacuaccuccugcucaagaaggaggaaccgaacaacgacaagaaaaaugccucgaucguagaaggcuucauaaaacgggaaauccgagacauguacaaacuguacgaugccuuugccaacggcgaaauaaauaacaucgacgaccucgaaaaauacugugaagauaaaggcauacccaagcgccaccuacccaaacaaaugguggccauacucuacgacgaacacaaagacauggucaaggaagccaaacguaaacaaagaaaaauggucaaagacacggaaaaacuccucgcagcccuagaaaaacaaacccaagagaaaacggaagacggcgggcgcaacauccgccuccuaaagucaggcgaaaucgcacgcuggcuaguuaacgacaugaugcgauuccaacccguccaaaaggacaacgaagguaacccacucaacaacucaaaagcaaacagcacagaguaccagaugcugcaacggucccuugcacucuauaacaaagaagaaaaaccgacccgcuauuuccgccaggucaaccuaauaaacuccuccaacccacacccauuucugaaauggacaaaaugggaagagugcaacaacauacugaguuucuaccgcagcuaccugacaaagaaaaucgaguuccucaacaaacucaagccagaagacugggagaaaaaccaauacuuccugaagcucaaggaacccaagaccaaccgcgaaacgcuaguccagggcuggaagaacggcuuuaaucucccccgagggaucuucacagagccaauccgagaaugguucaagagacaccagaacgacucaaaagaguacgaaaaagucgaagcccucgaccgcgugggccuaguaacgaagguaaucccacuguucuuuaaaaaggaagacagcaaagacaaagaggaagaccucaagaaggacgcccaaaaagaaauaaacaacugcguccagccauucuacucauucccuuacaacgucggcaacauccacaaaccagacgagaaggacuuccuacaccgggaggaaagaaucgagcucugggacaagaaaaaggauaaauucaaaggauacaaggcaaaggucaagaguaagaaacugacagauaaagaaaaagaggaauaccguagcuaccuagaguuccagaguuggaacaaauucgaacgagagcucagguuggugcgaaaccaggacauaguuaccugguuacucugcaccgaacucaucgacaaacucaaaguagaaggacuaaacgucgaggaacucaagaagcuacgacugaaggacaucgacacggacacagccaagcaagagaaaaacaacauacuaaaccgugucaugccaaugcaauuacccguaacaguauacgaaaucgacgacucccacaacaucgucaaggaccggccccugcacacagucuacauagaagaaaccaaaacaaagcuacuaaaacaggggaacuucaaggcgcuagugaaggaucguagacuaaacggacucuucucauucgucgacacaucaucagaagcagaacucaaaagcaauccuauaagcaagagccucguagaauacgaacucggcgaauaccaaaacgcccgaaucgaaaccaucaaggacauguuacuccuagaagaaacccuuaucgaaaaguacaagaaccuaccgacggacaacuucuccgacaugcucaacgguuggcuagaaggcaaagacgaggcggacaaagcgcgcuuccagaacgacgugaaacuccucguagcuguucgcaacgccuucagccacaaccaguacccgaugcggaacaggaucgcguucgccaacaucaacccauucucccucuccagugccgacaccuccgaagaaaagaagcucgauaucgcgaaucaacuaaaagacaaaacccacaaaauaauaaaaagaaucaucgaaauagaaaaaccaauagagacaaaggaauag

SEQ ID NO: 11692 - RNA, 3405 nt, Artificial Sequence
  Cas13b variant__Prevotella intermedia__AFJ07523.1__Cas13b
augaagauggaggacgacaagaaaacaaaagaaagcacaaacaugcucgacaauaaacauuucugggccgcguuccugaaccuugcacggcacaauguauacaucaccgucaaccacaucaacaaaguccuagaacuaaagaacaagaaagaccaagauaucaucaucgacaacgaccaagacauauuagccaucaagacucacugggaaaaaguuaauggagaccuaaacaagacagagagacuacgcgagcucaugacaaagcacuucccauuccucgagacagcaauauacaccaaaaacaaagaagacaaggaggaagugaaacaagaaaaacaagccaaagcucagagcuucgacucacuaaaacacugucuauuucuauuccuggaaaaacuacaggaagcgaggaauuacuacucccauuacaaauacagcgaaagcacgaaagagcccaugcucgaaaaggagcuacugaagaaaauguauaacaucuucgacgacaacauccagcuugugauuaaagacuaccaacacaacaaagacauaaaccccgaugaagacuuuaaacaccucgaccgcaccgaagaggaguucaacuacuacuucaccacaaacaagaagggcaacaucacagccucagggcuccuauucuucgucagccuauuccuggaaaagaaagacgccaucuggaugcagcagaaacucagaggauucaaagauaaccgcgaauccaaaaagaaaaugacgcacgaagucuucugccggagcagaaugcuacugcccaagcuccgacuagaaagcacacaaacucaagacuggauauuacuggauaugcucaacgaacucauccggugcccaaagucccucuaugaacgccugcaaggggaauaccgcaagaaauuuaacguacccuuugacagcgcagacgaagacuacgaugcagaacaagaacccuucaaaaacacgcucguccgacaccaagaccgauuucccuacuucgcccuccgauacuucgacuacaacgagaucuucaccaaccuccgguuucaaaucgaccugggcacauaccacuucagcaucuacaagaaacucauugggggacagaaagaagacaggcaccucacucacaaacucuacggauucgagcgcauucaagaguucgcaaaacaaaacagaaccgacgaauggaaagccaucgucaaagacuuugacaccuacgaaacaagugaagaaccguacauaagugagaccgcaccccacuaccaccucgaaaaccagaaaaucggcauacgguuccgcaacgauaaugaugagaucuggcccagccucaagaccaauggcgaaaacaacgaaaaacgcaaguacaaacuugacaaacaauaccaagccgaagccuuccuaucaguccacgaacuccugccaaugauguuuuacuaccuucuccuaaagaaagaggaacccaacaaugacaaaaagaacgcaagcaucgucgaagguuucaucaaacgggaaauccgcgacaucuacaaacucuacgacgccuucgcaaauggggagauaaacaacaucgacgaccuagaaaaguacugugaggacaaaggcauuccgaaaagacaccuucccaagcaaaugguagccauccucuacgacgaacauaaagacauggcugaggaagccaagcgcaagcaaaaggagauggugaaagacaccaaaaagcuccuugccacgcuagaaaagcaaacacagggcgaaaucgaagacggaggacgcaauauacgccuucuaaagagcggggaaauagcccgcugguuagugaacgacaugaugcgguuccagcccguacagaaagacaacgaaggaaacccgcuaaacaacucaaaggcaaacagcacagaguaccagaugcugcaacggagccucgcccucuacaauaaggaggaaaaacccaccagauacuuccgacagguuaaccuuauaaacuccagcaacccccaccccuuccuaaaauggaccaaaugggaagaaugcaacaacauacucucauucuaccgauccuaucucacuaagaaaauagaguuccuuaacaaacuuaaaccagaagacugggagaagaaccaguacuuccucaaacucaaagaaccaaaaaccaaccgagagacccuagugcaaggcuggaagaacggguucaaccucccgagaggcauauucaccgaacccaucagggaaugguuuaaacgacaccagaacgacuccgaagaauacgagaaggucgaaacccucgaccgcgucggccuugucaccaaagugauaccacucuucuucaagaaagaagacuccaaggacaaggaggaauaccugaaaaaggacgcccagaaagagauuaacaacuguguccaaccuuucuacggcuucccguacaacguuggcaacauccacaaaccggacgaaaaggauuuccugcccagcgaagaaagaaagaaacucuggggcgacaagaaauacaaauucaaaggcuacaaagcgaaagucaaaagcaagaaacucaccgacaaagagaaagaggaauaccgcucguaccucgaguuccaaagcuggaacaaauucgaacgggaacuccgcuugguccgaaaccaagacauagugacauggcuccuuugcaccgaacuaauagacaaacucaaaguggaaggguugaacguugaagaacugaaaaagcuccgacucaaggacauagacaccgacaccgcgaagcaggagaaaaacaacauccugaaccgagucaugcccaugcaacuccccguaacgguuuacgagauagacgacucgcacaacauagugaaagaccgcccccuccacaccguauacaucgaagagacaaaaacaaagcuacugaaacagggcaacuucaaagcacuggucaaagaccgacgccugaacgggcuuuucagcuucguugacaccagcagcgaaacagagcuaaagagcaaucccauuagcaaaucgcuggucgaauacgaacugggggaauaucagaacgcgaggaucgaaaccaucaaagauaugcuccuccuagaagagacacugauagaaaaauacaagacccuaccgaccgacaacuuuucagacaugcuaaacggauggcucgaaggaaaagacgaggcagacaaagcccguuuccaaaacgauguaaaacuccuagucgcaguaaggaacgcauucucccacaaccaguaccccaugcgcaaccgcaucgcuuucgccaacaucaaccccuucucacucagcuccgccgacacauccgaagaaaagaaacuggacaucgccaaccaacugaaagauaaaacccacaaaaucauaaaacgcaucauagagauagagaagccuauagaaaccaaagaauag

SEQ ID NO: 11693 - RNA, 3399 nt, Artificial Sequence
  Cas13b variant__Prevotella intermedia__WP_014708441.1__Cas13b
auggaagacgauaagaagaccaaggagagcacuaacaugcuagacaacaaacacuucugggccgccuuccuuaaccuagcccggcacaaugucuacauaaccgucaaccacaucaacaaaguauuggagcuuaaaaacaagaaagaccaggacauaaucauagacaaugaccaggauauccuggccaucaaaacccacugggagaaggucaacggagaccuaaacaaaacagaacgacuccgagaacuaaugaccaagcacuuccccuuccuagagaccgccaucuauacaaagaacaaggaagacaaagaggaggugaagcaagagaaacaagcaaaggcacaaucauucgacucacucaaacacugccucuuccucuuccuagagaaacuccaagaggccagaaacuacuacagccacuauaaguacuccgaaucaacaaaagaacccaugcuggaaaaagaacuccuaaagaagauguacaacauauucgaugacaacauucagcuaguaauaaaagacuaccagcacaacaaagacauaaacccagacgaggacuucaaacaccucgaccgaaccgaagaagaguuuaacuacuacuucacaacgaacaagaaggguaacaucaccgccuccggccuccuauucuucgucagucucuuucuagagaaaaaggacgcaaucuggaugcaacagaaacuccgcggcuucaaggacaaccgcgaaagcaaaaagaaaaugacccacgaaguauucugucgcucaaggaugcugcuccccaaacuacgccuagaaagcacacaaacacaagacuggauccuucucgacaugcugaacgaacuuauccgaugccccaaaagccuguacgagcggcugcagggcgaguaccgcaagaaauucaacguccccuuugauagugccgacgaagauuacgacgccgaacaagaaccauuuaaaaacacucugguccgacaucaagaccgguucccauacuucgcccuccgguauuuugacuacaacgaaauauucaccaaccuacgcuuccagauagaccugggcaccuaccacuucagcauauacaaaaagcuaauaggcgggcaaaaagaagaccgccaccuaacccacaaacuuuacggguucgagagaauacaagaguucgcaaaacaaaaccguaccgacgaauggaaagcaauaguuaaagacuucgacaccuacgaaacgagcgaggaacccuacauuuccgaaaccgccccgcacuaccaccuagagaaucagaaaaucgggauucgauuccgcaacgacaacgacgaaaucuggcccagcuuaaaaaccaacggggaaaacaacgaaaaacgaaaauauaaacuugauaaacaauaccaagcugaggccuuccucuccguccacgagcuucugccgaugauguucuacuaccuacuccugaaaaaggaggaaccuaacaacgacaaaaagaacgccuccaucgucgaaggauucaucaaacgagaaauccgagacauauacaaacucuacgacgcguucgcuaacggcgagauaaacaacaucgacgaccucgaaaaguacugcgaagacaagggcauacccaaacggcacuugcccaaacagauggucgccauccucuacgacgagcacaaagacauggccgaagaggcuaaaagaaaacaaaaagaaaugguaaaggacaccaagaaacuccuggccacacuggaaaaacagacgcagggagaaauugaagacgggggccguaacauacggcuccuaaaauccggcgagaucgcccgauggcucguuaacgacaugaugcgcuuccagccaguccaaaaagacaacgaaggaaauccccucaacaacuccaaagcaaacuccacggaguaccaaaugcuacaacggucccucgcgcuuuacaacaaagaagagaaaccuacaagguacuuccgacaggucaaccuaauuaacagcagcaacccacaccccuuccucaaauggaccaaaugggaagaaugcaauaacauccuauccuuuuaccggucauaccucaccaagaaaaucgaguuccugaacaaauuaaaacccgaagacugggagaaaaaccaauacuuccucaaacuaaaagaaccgaaaaccaauagggagacccuaguacaaggcuggaaaaacgguuucaacuuaccccgcggcauauucacagaacccauccgugagugguucaaacggcaccaaaacgacucagaagaguacgagaagguagaaacacucgaccgcgucgggcuaguaacuaaggucaucccccuauucuucaaaaaggaggauuccaaagacaaggaagaauaucucaagaaagacgcccaaaaagagauaaacaauugcguccaaccuuuuuacggcuucccauacaacguaggcaauauacacaaaccagacgaaaaagacuuccuaccauccgaggaacgcaagaagcucuggggcgacaagaaauacaaauucaaaggcuacaaggccaaaguaaaguccaaaaagcuaaccgacaaggaaaaagaagaauaccgcaguuaccucgaguuccaauccuggaacaaguucgaacgcgaacuccgccuuguacgcaaccaggacauagucacauggcuccucugcacagaauuaauagacaaacuaaaagucgagggccucaacguagaagaacucaagaaacuccgcuuaaaagacauugacacugacaccgcuaaacaagagaaaaacaauauccucaaccgggucaugccaaugcaacugccggugacagucuacgagauagacgacucccacaacauagucaaagacaggccacuucacacaguauacaucgaagaaaccaaaacaaaauuacucaaacaaggcaacuucaaagcauuagucaaggaucgacgccuaaauggacucuucagcuucgucgacaccucgagcgaaaccgagcucaaaucaaaccccauauccaaaucccucgucgaauacgaacugggagaguaccagaacgcccgcaucgaaacgaucaaagauaugcugcuccucgaggaaacccucaucgaaaaguauaaaacccugccuacugacaacuucagcgacaugcuaaacggcuggcuagaaggaaaagacgaggcagacaaggccagauuucaaaacgacguuaagcuccuagucgcagugcgcaacgccuucagccauaaccaguacccuaugcgcaaccgcaucgccuucgcaaacauaaaccccuucucccuaucaucugccgacacgagugaagaaaagaaacucgacaucgcaaaccaacuaaaagacaaaacccacaaaaucauaaaacgaaucauagagauagaaaagcccauagaaacgaaggaauaa

SEQ ID NO: 11694 - RNA, 3381 nt, Artificial Sequence
  Cas13b variant__Prevotella intermedia__WP_036860899.1__Cas13b
auggaagacgacaaaaagacaaccgacagcaucagauacgaacucaaggauaagcacuucugggcagccuuccucaaucuagcccgucacaacgucuauaucacggucaaccacauuaacaaaauacucgaagaaggcgaaaucaaccgggacggauacgaaaccacguugaaaaacaccuggaacgagaucaaggacaucaauaagaaagaccgccucucgaaguugauaauaaagcacuuccccuuucucgaagccgccacauaccgacuuaaucccacggacacgaccaaacaaaaagaggaaaaacaagccgaagcacaaagccucgagagucucagaaaaaguuucuucgucuucaucuauaaacuccgagaucuucgcaaccacuacucacacuacaaacacuccaagagccucgaacgcccaaaauucgaagaaggccuacucgaaaagauguacaauaucuucaacgcaucgauacgccuagucaaagaagacuaccaauacaacaaagacauaaacccggacgaggacuucaaacaccucgaccgcacggaagaagaguucaacuacuacuucaccaaagacaacgaaggcaacaucacagaaagcggccuacucuucuucgucucgcucuuucucgaaaagaaagacgcaaucuggaugcaacagaaacucaggggguucaaagacaaccgcgaaaauaaaaagaaaaugaccaacgaagucuuuugccgcagccgcaugcuccucccgaaauuacgacuucaaaguacccaaacccaagacuggauccuacuagauaugcucaaugagcucauccgcugcccaaaaagccucuacgaacgccuacgagaggaagaccgcgagaaauuccgcgucccaauagaaaucgcagacgaagacuacgacgcugagcaggaacccuucaagaacacccuaguaagacaccaggaucgauuccccuacuucgcccuccgcuacuucgacuacaacgaaaucuucacgaaccuccgguuccaaauagaccuaggcaccuaccacuucagcauauacaagaaacaaaucggagacuacaaagaaagccaucaccugacccacaaacucuauggguucgaacgcauacaagaguucaccaaacaaaaucgcccagacgaauggcgcaaguuugucaaaacauucaacagcuucgaaacgucaaaagaaccguacauccccgaaacgacaccccacuaccacuuagaaaaccagaaaaucggcauaagguucaggaacgacaacgacaaaauuuggccaucccuaaagaccaacagcgagaaaaaugaaaaaucaaaguacaaacucgacaagagcuuccaagcggaagcguuucugucuguacacgaacucuugcccaugauguucuacuaccuccuccugaagaccgaaaauacagacaacgacaacgaaaucgagaccaagaagaaagagaauaaaaacgacaaacaagaaaaacacaaaaucgaagaaaucauugagaacaaaauaacggagauuuacgcacucuacgacacuuucgccaacggcgaaaucaaauccauugacgagcuggaagaauacugcaaaggaaaggacauugaaauaggacaccuacccaaacaaaugaucgcaauacuaaaggacgaacacaaagucauggccaccgaggcugaaagaaagcaggaagaaaugcuggucgacguccagaagucccucgaaagccuggacaaccagauuaacgaagagauagaaaacguagagcggaaaaacuccucccugaaaaguggcaaaaucgcaucguggcuagucaacgacaugaugagauuccaacccguccagaaagacaacgagggaaaaccgcucaacaacucgaaagccaacaguaccgaauaccagcuccugcagcgcacccuagcauucuucggcucagagcaugaacgccucgccccguauuucaaacaaacgaaacucauagagagcucaaacccccauccauuccucaaagacacagaaugggaaaaaugcaacaacauccucucauucuaccgcaguuaucuagaggccaagaagaacuuccucgagagccucaaaccagaggacugggagaaaaaccaauacuuccucaagcucaaagaacccaaaacuaagccaaaaacgcuaguacaaggauggaagaacggauucaaccuuccccgcggaaucuucacagaaccgauccgcaaaugguuuaugaaacaccgggaaaacauaacggucgccgaacugaaacgaguugggcucgucgccaaggucaucccccucuucuucagcgaagaauacaaagauucgguccaaccguucuacaacuaccacuucaacguaggaaauaucaacaagcccgacgagaagaacuuucucaacugcgaagaaaggcgagaacuacuacguaagaagaaagacgaguucaaaaagaugaccgacaaagaaaaagaagaaaaccccuccuaccuggaguucaagaguuggaauaaauucgaacgagaacugcgccuaguccgaaaccaggacauaguaacguggcuccucugcauggaacucuucaacaaaaagaaaaucaaagaacucaacguagagaaaauuuaucuuaaaaacauaaacaccaacaccaccaaaaaggaaaagaacaccgaagagaaaaacggagaagagaaaaacaucaaagagaaaaacaacauacuaaaccgcauuaugcccaugcgccuccccaucaagguguacggccgagaaaacuucagcaaaaacaaaaagaagaaaauacgacgaaacaccuucuucacaguguacauagaagagaaaggaaccaaacugcucaaacaaggaaacuucaaagcccuggaacgggaucgccgccugggaggccucuucucguucguaaaaaccccgagcaaagcugagucaaagagcaacacaauuuccaagcucagagucgaauacgaacuaggcgaauaccaaaaggcacgaaucgaaaucaucaaagacaugcucgcccucgagaaaacacucaucgacaaguacaacagccuugacacggauaacuucaacaaaaugcucacggacuggcucgaauuaaaaggagaaccagacaaagcaucauuccaaaacgacguagaccuccuaaucgccguccgcaacgcauucucccacaaccaauaccccaugcguaauagaauagcauucgccaacauaaaccccuucagucucagcagcgcaaacaccagcgaagaaaaaggacugggaaucgccaaccaacucaaagacaaaacacacaagaccauagagaaaauuaucgaaauagaaaagcccaucgaaacgaaagaauaa

SEQ ID NO: 11695 - RNA, 3363 nt, Artificial Sequence
  Cas13b variant__Prevotella intermedia__WP_061868553.1__Cas13b
auggaagacgacaaaaagacgacagacucgauccgauacgaacucaaagacaaacacuucugggccgccuuccuuaaccucgcaagacacaacgucuacauaaccguaaaccacaucaacaaaauacucgaggaggacgaaauuaaccgagauggguacgaaaacacgcuugaaaacagcuggaacgaaaucaaagacaucaacaaaaaggaccgacucagcaaacucauaauaaaacacuuccccuuccucgaagcgacaacauaccgucaaaaccccacggacacuacaaagcaaaaggaggaaaagcaggcagaggcucagagccucgaaucccucaaaaagagcuucuucguguucaucuacaaacuccgagaccuacgcaaccacuacagccacuacaaacacagcaaaucacucgaacgccccaaauuugaagaggaccuccagaacaaaauguacaauaucuucgacguaagcauccaauucgucaaggaggacuacaagcacaacacagacauuaaccccaagaaagacuucaaacaccuggaccgaaaaagaaaaggcaaauuccacuacuccuucgccgacaacgaaggaaacauaacagagagugggcuccucuucuucguaucccucuuccucgaaaagaaagacgcaauuuggguacaaaagaaacuagaaggguucaaaugcucuaacaaaucauaccagaaaaugaccaaugaggucuucugcaggucaaggaugcugcuccccaaacuccgacuagaaucaacccaaacacaagauuggauccuccuagacauguuaaacgaacucaucagauguccgaaaucccucuacgagcgacuacaaggcguaaaccgcaaaaaguucuacgucagcuucgauccagcagacgaagacuacgacgcagaacaggaacccuucaaaaacacgcuaguaaggcaccaggaccgguucccuuauuucgcccugcgauacuucgacuacaacgagguauucgcaaaccugcgcuuccagaucgaccuuggcacuuaucauuucagcaucuacaagaagcuaauuggcggacaaaaagaagaccgccaccuaacccauaagcucuacggauucgagcggauucaggaguucgacaaacagaaucgcccagacgaauggaaagccauagucaaggacuccgacacguuuaagaaaaaggaagaaaaagaagaagaaaagccguacauaagugagacaacaccgcacuaccaucucgaaaacaagaaaaucggaaucgccuucaaaaaccacaacaucuggcccuccacccaaacagaacucaccaacaacaaaagaaagaaauacaaccucggcacaagcauaaaagcggaggccuuucugagcgugcacgagcugcuaccgaugauguuuuacuaccuacugcuaaaaacugaaaacacgaaaaacgacaacaaaguaggcgggaagaaagaaaccaagaaacaaggcaaacauaagauagaagccauaauugaaagcaaaauaaaagacaucuaugcgcucuacgacgccuuugccaauggcgaaaucaauagcgaagacgagcucaaggaguaucuaaaggggaaagacauaaagaucguacaucugccgaaacaaaugaucgcaaucuuaaagaacgaacacaaagacauggccgagaaagcggaggccaaacaagagaaaaugaaacuagcaacagaaaaccgccuaaaaacccuggacaagcaacucaaagggaaaauccaaaacggaaaacgcuacaauucagcaccuaaaagcggcgaaaucgccagcuggcuggucaaugacaugaugcgcuuccagcccgugcaaaaagacgaaaauggggagagccucaacaauucaaaagcaaacuccacggaguaccaacuccuccaacgaacgcuugccuucuucggcuccgaacacgaacgucuagcacccuacuucaaacaaacaaagcucaucgaaucgucgaacccccaccccuuccugaacgacacggagugggagaaaugcuccaacauacucucauucuaccgcagcuaccuaaaggcccgcaaaaacuuccucgaaagccugaaacccgaggacugggaaaagaaccaauacuuccugauguugaaagaacccaaaaccaaccgugaaacccuagugcagggauggaaaaauggauucaaccuaccacgcggcuucuucaccgaacccauccgcaaaugguucauggaacacuggaagucgaucaaaguagacgaccugaagcgcgucggccuggucgcaaaaguaaccccacuauucuucucagaaaaguacaaggacucugugcagccauucuacaacuacccauucaacgugggagacgucaacaaaccuaaggaggaagacuuccuacacagagaagaacgcaucgaacugugggacaaaaagaaagacaaguucaaaggauauaaggcaaagaagaaguucaaagagaugaccgauaaagaaaaagaggaacaccgaucuuaucuggaguuccaauccuggaacaaguucgaacgagaacucagacucguccggaaucaggacaucgucaccuggcugcuuugcaccgagcucaucgacaaacucaaaaucgacgagcucaacaucaaagaacucaagaagcuaaggcuuaaagacauaaacaccgacacugccaaaaaggaaaagaacaacauccucaacagagucaugccgauggagcuacccgucaccgucuacaaagugaacaaagggggcuacauaaucaaaaacaaaccccugcacacaaucuacauaaaggaagcagaaaccaagcuccuaaaacaaggaaacuucaaggcgcucgucaaggacagacgacugaauggacucuucuccuucguaaaaacacccagcgaggccgaguccgaaucgaacccgaucucaaaacugagaguagaauacgaacuggguaaguaccagaacgcccgucuagacaucauagaagacaugcuagcacuugaaaagaagcucaucgacaaauacaacucccuagauacagacaacuuccacaacaugcugacuggauggcuagaacuaaagggcgaagccaagaaggcaagauuccaaaacgacgucaaacuacugaccgcgguaagaaacgccuucucgcacaaccaauaccccauguacgacgaaaaccuauucggcaacaucgaacgcuucucacugucaagcuccaacaucaucgaaagcaaaggacuugacaucgccgccaaacucaaagaagaggucucaaaagcagcgaaaaagauucaaaacgaggaagacaacaagaaggaaaaggaaaccuag

SEQ ID NO: 11696 - RNA, 3378 nt, Artificial Sequence
  Cas13b variant__Prevotella intermedia__KJJ86756.1__Cas13b
augaaaauggaggacgauaagaaaaccaccgagucaaccaauaugcuggacaauaaacacuucugggccgcguuccugaaccuagcgcgacacaacgucuacaucaccgugaaccacaucaacaaagugcucgaacucaaaaacaagaaagaccaagacaucauaauugacaacgaccaagacauccuugccaucaaaacacacugggaaaaagucaacggcgaccucaacaaaacugaacgccucagagagcucaugaccaaacacuucccguuccucgaaacggccaucuacaccaaaaacaaagaggacaaagaagaggucaaacaagaaaaacaagccgaagcccaaucccucgaaucacugaaagacugccuauuccuauuccucgaaaaacuucaagaggcucguaacuauuacucgcacuacaaauacagcgaaucaaccaaagagccaaugcuagaggagggacuccuggagaaaauguacaacaucuucgacgacaauauccagcuagucauuaaggacuaccaacacaacaaagauaucaaccccgacgaagacuucaaacaccuugaccguaaggggcaauucaaauacucauucgccgacaacgagggaaacaucaccgaaagcggccuccuauucuuuguaagccuguuccucgagaagaaagacgcaauauggaugcagcaaaaacugacaggcuucaaagacaaccgagaaucgaaaaagaaaaugacgcacgagguauucugccggcgccgcaugcuccucccgaaacucaggcucgaauccacccaaacacaagacuggauccuccuagacaugcuaaaugaacuaauaagaugccccaaaagccucuacgaaagacuccaaggagaauaccggaagaaauucaacguacccuucgacucagcggacgaggacuacgacgcggaacaagaaccauucaaaaacacgcucgucaggcaccaagacagauuccccuacuucgcccucagauacuucgacuacaacgaaaucuucaccaaucuccgcuuccaaaucgaccuugggaccuaccacuucuccaucuacaagaaacucaucggaggacagaaagaagaccgccaccugacacacaaacuauacggcuucgaaagaauccaagaguucgcgaaacaaaaccggcccgacgaauggaaagcccucgucaaagaccucgacacauacgaaacuuccaacgaaagauacauaucagaaaccacuccccacuaccaccucgaaaaccagaaaauuggcauacgcuuccgcaacggcaacaaagaaauauggcccucgcugaagaccaacggggaaaacaacgagaaauccaaguauaaacucgauaaaccauaccaggcagaagcauuccuuagcguccaugaacuccucccuaugauguucuacuaccuccuccuaaagaaagaggagccgaacaacgacaagaaaaacgccuccauagucgaaggauucaucaaacgcgagauucgagacauguacaaacucuacgaugcuuucgccaacggagaaauaaacaacaucggggaccuggaaaaauacugcgaagauaaagguaucccgaaacgccaucugccaaaacagaugguggccauacucuacgacgagcccaaagacaugguaaaagaagccaagagaaagcaaaaagagauggugaaagacaccaaaaagcuacucgcgacacuagagaaacagacccaagaagaaaucgaggacggcggacgcaacauccgccugcucaaaucaggagaaaucgcccgcuggcuagugaaugacaugaugcgauuccaacccgugcaaaaagacaacgaagggaacccucugaacaauuccaaagccaacucaacggaguaccaaaugcuccaacgcucccuugcacucuacaauaaagaagagaaacccacccgauacuuccgccagguuaaccucaucaacuccagcaacccgcaccccuuccucaaauggaccaaaugggaagagugcaacaacauacuaucguucuaccgaaauuaccucaccaagaaaauagaguuccugaauaagcugaaacccgaagauugggaaaagaaccaauacuuccucaaacuaaaggaaccuaagacaaaccgagagacacuuguccaaggcuggaagaauggguucaaucucccccggggcaucuucacagaaccaauccgagaaugguucaaacggcaccaaaaugacucgaaagaauacgaaaaaguggaggccuuaaaacgcgugggccucgucaccaaggucauaccacucuucuuuaaagaagaauacuuuaaggaagaugcgcaaaaggaaauuaacaacugcguccagcccuuuuacagcuucccauacaauguaggaaacauacacaaacccgacgaaaaagacuuccugcccagcgaggaacgcaaaaagcuguggggugacaagaaggacaaauucaagggauacaaagcaaaagucaaaagcaaaaagcuaacagacaaggagaaggaagaauaccgauccuaccuagaguuucagaguuggaacaaguucgagcgcgagcuacggcuagugcgaaaccaggacauugucacauggcuccucuguacagaacugauagacaaaaugaaaguagaaggacuaaacgucgaggaacugcagaaacuucgacucaaagacaucgacacugacaccgccaagcaagaaaagaacaacauccugaaccgcaucaugccaaugcagcucccagugaccgucuaugaaaucgaugacucccacaacauagucaaggaccgcccacuccacaccgucuacauagaagaaacaaagacuaaacuccuaaaacaaggaaacuucaaagcccuaguaaaagaccgacgacucaacggcuuauucucauucguagacacaaguagcaaggcagaacucaaggacaagcccauaucgaaguccgugguagaauacgaacugggagaauaccagaacgcccgaaucgaaaccauaaaagacaugcuccugcucgaaaagacacugaucaaaaaguacgaaaagcugccaacagacaacuucagcgacaugcucaauggcugguuggaaggcaaagaugaauccgacaaagcgcgauuccagaacgacgucaagcuacucguagcaguccggaacgccuucucccacaaccaauaccccaugcgcaaccgcauagcguucgccaacaucaacccguucagccuaucaucggccgacauaucagaagaaaagaaacuggacauagccaaccaacucaaagacaaaacccacaaaaucaucaagaaaauaauagaaaucgagaaacccauagagaccaaagaguga

SEQ ID NO: 11697 - RNA, 3378 nt, Artificial Sequence
  Cas13b variant__Prevotella pallens__EGQ18444.1__Cas13b
augaaagaggaggaaaaaggcaaaacacccgucgucucgaccuacaauaaagacgacaaacacuucugggcggcauuucucaaccuggcaaggcacaacguauacauaaccgugaaccacaucaacaagauccucggcgaaggagaaauaaaccgcgacggcuacgaaaacacgcuagaaaaguccuggaacgagauaaaagacauaaacaagaaagaccgccucagcaaacuaaucaucaagcacuucccguuccuggaagugaccacauaucagcgaaacagcgcugauaccacaaagcaaaaagaggagaaacaagccgaagcccagucccuggaaucccucaagaaauccuucuucguauucaucuacaaacuacgagauuugcgaaaucacuacagccacuacaaacacucaaaaucucuagaacgcccaaaauucgaagaagaccuucaagagaagauguauaacauuuucgacgccagcauacagcuagucaaagaagacuacaaacauaacaccgacaucaagacggaagaggacuucaagcaccuagaccgcaaaggacaauucaaauacuccuuugccgacaacgagggcaacaucacagaaagcggccuccuguucuucgugagccucuuccuggagaagaaagacgccauauggguccagaagaaauuggaaggcuuuaaaugcucaaacgagagcuaccagaaaaugaccaacgaaguauuuugcaggucccgcaugcuccuucccaaacucaggcuccaaucaacccaaacccaagauuggauucuccuagacaugcugaacgaacucauacgcugcccaaaaucacuuuacgagagacuacgcgaagaagaccgcaagaaauuccgagucccgauugaaauagcugacgaggacuacgacgcagaacaagaaccguucaaaaacgccuuagugagacaucaagaccgcuuccccuacuucgcccucagauacuucgacuacaacgagaucuuuacgaaccuccgcuuccaaauagaccucggcacauaccacuuuuccaucuacaagaaacaaauuggcgacuacaaagaaucacaccaccucacacacaaacuauacggcuucgaaaggauccaagaguucacaaaacaaaaccgcccagaugaauggcgcaaauucgugaaaaccuucaacucauucgaaacauccaaggagccauacaucccagaaaccacaccccacuaccaucuggaaaaccagaaaauaggcauccgauuccgcaaugacaacgacaaaauuuggccaucccugaaaaccaacucggaaaagaacgaaaaaucaaaauacaaacucgacaaaucuuuccaagccgaagcauuccucuccguacacgagcuacugccgaugauguucuacuaccuccugcucaagaccgaaaacaccgacaacgacaacgaaauagaaacgaaaaagaaagaaaacaaaaacgacaaacaagagaagcacaaaaucgaagaaaucauagaaaacaaaaucaccgagauauacgcccuguacgacgccuucgccaacgguaaaaucaauuccaucgacaagcucgaagaguacugcaaggggaaggacaucgagaucggacaucuaccaaagcaaaugauagccauccuaaaaagcgaacacaaagacauggccacagaagcaaagcgcaaacaagaagaaaugcucgcagacguacaaaagucucuugagagcuuggauaaucaaaucaacgaagaaauagagaacgucgaacgcaaaaacucgucccugaaauccggcgaaaucgcgucauggcuggucaacgacaugaugcgcuuccaaccaguccaaaaagauaacgaaggcaacccgcucaacaacuccaaagccaacuccaccgaauaccaaaugcuccaacgcucccucgcacuguacaacaaggaagaaaaaccgacccgguacuucaggcaagucaaccugaucgagagcucaaacccccaucccuuccuuaacaacaccgagugggaaaaaugcaacaacauccucucguucuaucggucuuaccuugaagccaagaaaaacuuccucgaaagucucaaaccagaggacugggagaaaaaccaauacuuccucaugcugaaagaacccaaaacgaacugcgaaacacuuguacaaggguggaaaaacggauucaaccucccgcgcgggauauucaccgaaccgauacggaaaugguuuauggaacaccgcaaaaacauaacagucgcggaacucaagcgcgugggucucguggcaaaggucaucccccuguucuuuagcgaagaguacaaggauaguguacaaccguucuacaacuaccuuuucaaugucggaaacaucaacaaacccgacgaaaagaauuuccucaacugcgaggaacgccgcgaacuacuccgcaaaaagaaagacgaguucaaaaagaugacggacaaagaaaaagaagaaaaccccuccuaccucgaguuccagaguuggaacaaguucgaacgagaacuccgacucguccgaaaccaagacaucgucacuuggcuccuaugcauggaacucuuuaacaaaaagaaaauaaaagaacucaacgucgaaaagaucuaccucaaaaacauuaacaccaauacgaccaagaaagagaaaaacacggaagagaaaaacggggaagagaaaauaaucaaagagaaaaacaacauacuuaaccggaucaugccuaugaggcugccgauaaaagucuacggccgcgaaaacuucucgaaaaacaaaaagaagaaaauacgccgcaauacauucuucacagucuacaucgaagaaaaagggacaaaacuguuaaaacagggcaacuucaaagcucuugaacgggaucgacggcucgggggccuauucucauucgucaaaacgcacucgaaagcggaauccaaaagcaauaccaucuccaaaagccgaguagaauacgagcuuggcgaguaucaaaaagcccgcaucgagauuaucaaagacauguuagcccuugaagaaacacuaauagacaaauacaacagccuagacacggacaacuuccacaauaugcucaccggauggcugaaacugaaagacgagccagacaaagccagcuuccaaaacgacgucgaccuccugauagcgguacgaaacgccuucucacauaaccaauacccgaugcgcaaccgcaucgcguucgcgaauaucaaucccuucagccucuccagcgccaacacgagcgaagaaaaaggccuaggcauagcgaaccaacucaaagauaaaacccacaaaacgauagagaaaauaauagaaaucgaaaagcccauagaaaccaaagaauag

SEQ ID NO: 11698 - RNA, 3453 nt, Artificial Sequence
  Cas13b variant__Prevotella saccharolytica__EKY00089.1__Cas13b
augauggagaaggaaaacguucaaggcucacauauauacuacgaaccaaccgacaaaugcuucugggccgccuucuacaaccuggcacgccacaacgcauaucuuaccaucgcacacaucaacucguucgucaacucgaagaaaggcaucaacaacgacgacaaaguccuagauauaauagacgacuggagcaaauuugacaacgaccuucucaugggugcccgccuaaacaaacugauccuuaaacacuuccccuuccuaaaggcuccccuguaccaacucgcaaagcgaaaaacccgcaagcaacaaggaaaagaacaacaggacuacgaaaagaaaggugacgaagacccggaaguuauacaagaagcaauugccaacgccuucaagauggcuaacguacguaagacacugcacgcuuuccucaaacagcucgaagaccuacgcaaccacuucagccacuacaacuauaacucccccgccaagaaaauggaagucaaauucgacgacggcuucugcaacaaacuuuacuacgucuucgacgccgcacuacagaugguuaaagacgacaaccguaugaacccugaaaucaacaugcaaacagauuucgaacaucuuguacgacuuggucgaaaccggaagaucccgaacaccuuuaaauacaacuucaccaacucagacggcaccaucaacaauaacggacuccuauucuucguaucccuauuccucgaaaaacgagacgcaauauggaugcagaagaaaaucaaaggguucaaaggcggcaccgaaaacuacaugcgaaugaccaaugagguuuucugccgaaaccgcaugguaaucccaaaacuccgacucgaaaccgauuacgauaaccaccaacucauguuugacaugcuaaacgagcuaguccgcugcccccuaagccuguacaaaagacuaaaacaagaggaccaagacaaauuccgcguaccaauagaguuccucgacgaagacaacgaagcagacaaccccuaccaagagaaugcaaauucugacgaaaacccgacagaagagaccgacccacucaaaaauacucuaguuagacaccaacaccguuucccguauuucguccugagguauuucgaccucaacgaagucuucaaacaacuccgauuccagaucaaccucggcugcuaucacuucuccauauacgauaaaacaaucggagaacgcacugaaaaacgccaucucacaagaacccuuuuuggguucgaccgccuucagaacuucagcguaaaacuucagccagaacacuggaagaacauggucaaacaucucgacacggaagaauccuccgauaagccauaccucagcgacgcgaugccccacuaccagaucgagaaugagaaaaucgggauccacuuccucaaaaccgacaccgaaaagaaagagacaguauggcccagucucgaagucgaagaagucuccuccaacaggaacaaauacaaaagcgagaaaaacuuaacagcagaugcguuccuauccacccacgaacuccucccaaugauguucuacuaccaacuucucucgagcgaagagaaaacccgugccgccgcaggcgacaagguucaaggaguccuccaguccuaccgcaagaaaauauucgacauauaugacgacuuugccaacggaaccauuaacuccaugcagaaacucgacgagcgccuagcaaaggacaaccuacuccggggcaacaugccccaacagaugcuggccauccucgagcaucaagaaccugacauggagcaaaaagccaaggagaagcucgaccgacucaucacggagacaaagaaaagaaucggcaaacuggaggaccaauuuaaacaaaaaguacgcaucgguaaacgucgcgcggaccuacccaaagugggcagcauagccgacuggcucguaaacgacaugaugcgcuuccagccugcuaaaagaaacgcagacaacacuggaguccccgauuccaaagccaacucaaccgaauaccggcuacuccaggaagcgcucgccuuuuauucugcuuacaaagauagacuagagccguauuuccgacaaguuaacuuaaucggcggaaccaacccccaccccuuccuccaccggguagacuggaagaaaugcaaccaccuacucuccuucuaccacgauuaccucgaagcgaaagaacaauaucucucccaccucagccccgcagacuggcaaaagcaucagcacuuucuccuacucaaagucagaaaggacauccaaaacgagaagaaagacuggaagaaaagccucgucgcgggcuggaaaaacggauucaaccuccccagaggccucuucaccgaauccaucaaaacgugguucuccaccgacgcagacaaaguccaaaucaccgacacaaaacuauuugagaaccgagucggccucauagcgaagcucauaccgcuuuauuaugacaaagucuacaacgacaaaccacagccauuuuaccaauaccccuucaauaucaacgauagauacaagcccgaagauacacggaaacgauucaccgccgccuccagcaaacucuggaacgagaagaaaauguuguacaaaaacgcucagccagacucuucagacaagaucgaguauccgcaauaccucgacuuccuauccuggaagaaacuugaacgggaacuacguaugcuacgaaaucaagauaugauggucuggcuuaugugcaaagaccucuucgcccaaugcacaguagaaggcgucgaauuugccgaucucaaacugucacaacuggaagucgacguaaacguccaggacaaucucaacguccugaauaacguaagcucaaugauccuaccacucucggucuacccaucugacgcacaaggcaacguccuucggaauagcaaaccacuacacacgguguacguccaagaaaacaacaccaaacuauuaaaacaaggaaacuucaagucccuccucaaggaccgacgccucaacggucuauucuccuucaucgccgcagagggagaagaucugcaacaacacccacucaccaagaaccgacuagaauacgaauugucgauauaccaaacuaugcgcauaagcguauucgaacaaacccuccaacucgagaaggcaauccucacgaggaacaaaaccuugugcggcaacaacuucaacaauuuacucaauuccuggagcgaacaccgaaccgacaagaaaacucuccaacccgacauagacuuccuaauagcagugcgcaacgccuucucccacaaccaauaccccaugaguaccaacaccgugaugcaaggcaucgaaaaauucaacauccaaacacccaaacuugaggaaaaagauggccucggaaucgccucucaacuagcaaagaaaacaaaagacgccgcgagccgacuacaaaacaucaucaacggcggcacuaauuaa

SEQ ID NO: 11699 - RNA, 3969 nt, Artificial Sequence
  Cas13b variant__Prevotella sp.__WP_036929175.1__Cas13b
auguccaaggagugcaagaaacaacgccaggaaaagaaacgacgcuugcaaaaagccaacuucuccaucucccugaccggaaagcacgucuucggcgccuacuucaacauggcucgaacgaacuucguaaaaaccauaaacuacauucugccuauugccggagucaggggaaauuacucugagaaccaaaucaauaaaaugcuucacgcccuguuccucauacaagccggcagaaacgaggaacucacgaccgaacagaaacaaugggaaaagaaacuccgccuaaaccccgagcagcagacaaaauuccagaaacuccucuucaagcacuucccaguacuaggaccaaugauggccgacgucgccgaccacaaagcguaucucaacaagaaaaagucgacaguacaaaccgaggacgagaccuucgcaaugcuuaaaggcgucucacucgccgacugccuugacaucaucugccucauggcugacacacucaccgaauguagaaacuucuauacacacaaagaccccuacaacaaaccaucccagcucgcagaccaauaccuccaccaagaaaugaucgcgaaaaagcucgacaaaguggucgucgcaucccgccgaauccucaaagaccgggaggggcucagcgugaacgaaguagaauuuuugacgggcaucgaccaccuccaccaggaaguacugaaagacgaguucggaaacgccaaaguaaaagacggcaaaguaaugaaaacguucguugaauacgacgacuucuacuucaaaaucuccggcaaacgacuggucaacggguauacagucaccaccaaggacgauaagccggucaacgucaacacgaugcuaccggcacucucagauuucggacuccuauacuucugcguuuuauuccucuccaaacccuacgcgaaacuauuuaucgacgagguaagacucuucgaauacucaccguucgacgacaaagaaaacaugaucauguccgagaugcucucuaucuaucggaucagaacccccagacugcacaaaaucgacagucacgacucgaaagcuacccucgcaauggacaucuucggcgagcuacgacggugcccgauggaacucuacaaccuucuagacaaaaacgcgggccagccauucuuccacgacgaaguuaaacacccaaacagccacacucccgacgucuccaaacgccugagauacgacgacagguuccccacacucgcucuacgauacauagacgaaaccgaacucuucaaacgcauccguuuucagcuccaacuuggcuccuuccgguacaaauucuacgauaaagaaaauugcaucgacgggcggguccgagugcgccggauucaaaaagaaaucaacggcuacggccgaaugcaagaagucgcugacaaaagaauggacaaauggggcgaccugauacaaaagcgggaggaacgauccguaaagcucgaacacgaagaacuauacauaaaucucgaccaauuccucgaagauacagcagacuccacacccuacgucaccgaucgucgaccagcuuacaacauccacgcaaaccggauaggucucuauugggaagacucacaaaacccaaaacaauacaaaguauucgacgaaaacggaauguacaucccagaacuggucgucacagaagacaagaaagcacccaucaaaaugccagccccacggugcgcacuuucuguauacgacuuaccggccaugcuauucuacgaauaccuccgagaacagcaagauaacgaauuucccucggccgagcaaguaaucaucgaguacgaagacgacuaucguaaauucuucaaagcgguugcagaaggaaaacuaaagcccuucaaaaggccgaaagaguuccgcgacuuccucaagaaggaauacccaaaacuaaggauggccgacauucccaagaaacuacaacucuuccucugcucgcacggccuaugcuauaacaauaaacccgaaacagucuaugaacgcuuggaccgccuaacacuccaacaccucgaagaacgcgaacuacacauccaaaacagguuagaacacuaccaaaaagaccgggacaugauuggcaacaaagacaaccaguacgguaagaagucauucucugacguuagacacggagcacucgcacgcuaccucgcccaauccaugauggaauggcaaccgacaaaacucaaagacaaagagaaaggacacgacaaauuaaccggccucaacuacaacguccucacggcguaccuggcaacguacggccacccacagguccccgaagaaggauucacccccagaacgcuagagcaaguucugauaaacgcccacuuaauuggcggauccaauccucaccccuucauuaacaagguacuagcccucggaaaucggaauaucgaagaauuguaccuccacuaccuagaagaggaacuuaaacacauccgaucacgcauccaaucccucagcagcaaccccagcgacaaagcgcuuagcgcacuucccuucauacaccacgaccgaaugagauaccaugagagaacuagcgaagaaaugauggcacucgcagcaagauacacaacgauccaacuucccgauggucuauuuacucccuacauccuugaaauacuccaaaaacauuauacggaaaacagcgaccuccaaaacgcucucucucaggaugucccugucaagcugaacccaaccugcaacgccgcauaucucauaacccucuucuaccagacaguacuuaaagacaacgcacaacccuucuacuuauccgacaagacguacacgcgaaacaaagacggcgaaaaagccgagucauucucuuucaagcgugccuacgaacuauucucaguguugaacaacaacaagaaagacaccuucccguucgagaugaucccacucuuccuaaccucagacgaaauccaagaaagacuguccgcaaaauugcucgacggagauggaaauccggugcccgaagugggcgagaaaggcaaacccgccaccgacagccagggaaauacaauauggaaacggcgaauuuacucagaagucgacgacuacgccgaaaaacuuaccgaucgagacaugaagaucagcuucaaaggggaaugggaaaagcuccccagauggaaacaagauaaaauaaucaaaagacgggacgagacgagacgccaaaugagggaugaacuacuccaacguaugccacgcuauauacgagacaucaaagacaacgaacguacccugcgacgauauaaaacgcaagacaugguccuauuccuacucgccgaaaagauguucacaaacaucaucagcgaacaaagcucugaguucaacuggaaacagaugcgacucucgaaggucugcaacgaagcguuccuccgucaaacccucacauuccguguaccggugacaguaggcgaaacaacuauauacgucgaacaagagaacaugucccucaaaaacuacggcgaguucuaucgcuuccuaacggacgacaggcucaugucucuccuuaacaacaucguagaaacccucaaaccaaacgaaaacggggaccuaguaauacgacacacagaccugauguccgagcuagcagcguacgaccaauaccgcagcacuauauucaugcucauacaguccauagaaaaccuaauaaucacgaacaacgcuguucuagacgacccugacgcagacgguuuuugggucagagaggaccugccaaaacgaaacaacuucgccucucuacuggaacuaaucaaccaacucaauaacguagagcugacugacgacgaacgcaaacuccuuguagcaauaagaaacgcauucagccacaacucguauaacauugacuucagccucaucaaggauguaaagcauuugcccgaaguugcaaaaggcauccuccaacaccuucaaagcaugcucggggucgaaaucaccaaauaa

SEQ ID NO: 11700 - RNA, 3384 nt, Artificial Sequence
  Cas13b variant__Prevotella sp.__WP_007412163.1__Cas13b
augcaaaagcaggacaaacucuucgucgaccguaagaaaaacgccaucuucgccuuccccaaauacaucaccauaauggaaaaucaagaaaaaccagaacccaucuacuacgagcugacugacaaacacuucugggcagcuuuccucaaccuagcacgccacaacgucuacaccacaauaaaccacaucaauagacgccucgaaaucgcagagcugaaagacgacggcuacaugaugggcaucaaagguagcuggaacgagcaggcgaaaaagcuagauaagaaaguccgacuucgugaccuaauaaugaaacacuucccguucuuggaggcagccgcuuacgaaauaaccaacagcaaaucccccaacaauaaagaacaacgagagaaggaacaauccgaagcauuaucccuaaacaaccuaaagaauguacucuucaucuuccuagagaaacuacaaguacuccgcaacuacuacucgcacuacaaauacagugaagaguccccaaaaccaaucuucgaaacaucgcuacucaaaaauauguacaaaguauucgaugccaacguccgucuagucaagcgagacuauaugcaccacgaaaacaucgacaugcaacgggacuucacccaccuuaaucgcaagaaacaagucggucgcaccaaaaacaucauagacucaccaaauuuccacuaccacuucgccgacaaagaaggcaauaugacaaucgccggccugcucuuuuucguaucgcuauuucuagacaagaaagacgccaucuggaugcaaaagaaacuaaaaggcuucaaagacggacgcaaccuccgcgaacagaugaccaacgaaguauucugccgaucgcguaucagccugcccaaacuaaaacucgagaacguacaaaccaaagacuggaugcagcuagacaugcucaacgagcuuguucggugcccaaaaagccucuacgagagacugcgcgaaaaggaccgcgagagcuucaagguacccuucgacauauucucggacgacuaugacgcugaagaagaacccuuuaaaaacacacucguacgccaccaagaccgcuucccauacuucguccuccgcuacuucgaccucaacgaaauauuugaacaacuacgcuuccagauugaccucggcaccuaucacuucagcaucuacaacaaacggauuggugacgaagacgaaguacgacaccucacccaccaccuauacggcuuugcuagaauccaagacuuugcaccccagaaccaacccgaagaauggcgcaagcuaguaaaagaccuagaccacuucgaaaccucccaagaacccuacaucagcaaaaccgcgccccacuaccaccuugagaacgagaaaaucggcaucaaguucuguagcacccacaacaaccuauucccaucccucaaacgcgaaaagaccugcaauggccgcagcaaauucaaccucggaacgcaguucacggccgaagccuucuuaagcguacacgaacuacuccccaugauguucuacuaucuucuacucacaaaagacuacucaagaaaagaguccgcugacaaggucgaaggcaucauacguaaggaaauauccaacaucuacgccauauacgacgcauucgcaaacaacgaaaucaacucaaucgcagaccuaaccugccgccuccagaaaaccaauauccuccaaggacaucugcccaagcagaugaucuccauccuggaaggucggcaaaaagauauggaaaaagaagcagaacgcaaaaucggcgaaaugauugacgacacccagcgccgccucgaucuccucugcaaacaaacaaaccagaaaauucgcaucggcaagaggaacgcaggccugcucaaaucaggcaaaaucgcggacuggcugguaucagauaugaugcgguuccaacccguccaaaaagacacgaauaacgcccccaucaacaacucgaaggcaaauucaaccgaguaccgaaugcuccaacacgcccuggcucucuucgguuccgaaaguuccagacuaaaggcuuacuuccgacaaaugaaucuggucggaaacgcaaacccccacccauuucucgccgagacccaaugggaacaccaaacaaacauccuauccuucuaccgcaacuaccucgaggcaaggaagaaauaccuaaaaggucucaaaccgcagaacuggaaacaguaccaacacuuucucauccucaaaguccagaagaccaaccggaacacccucguaacgggcuggaaaaauagcuucaaccucccccgaggcauuuuuacacagccaauacgcgaaugguucgaaaagcacaacaacucaaaacggaucuacgaccaaauauugagcuucgaccgaguaggcuucguagcgaaggccauaccgcucuacuucgcggaggaauacaaggacaacguccagcccuucuacgacuacccguucaacauuggcaacaaacucaagccccaaaaaggacaauuccucgacaaaaaggagcgcguugaacucuggcaaaagaacaaggaacuguucaaaaacuacccuagcgaaaagaacaaaacagaccucgcguaccucgacuuccucuccuggaaaaaguucgaaagagaacuacgcuugaucaaaaaccaagacaucguaaccuggcucauguucaaagaacucuucaaaaccacuacggucgaaggccucaagaucggagaaauccaccucagagacauagauacaaacacugccaacgaagaaucaaacaauauccuuaaccgaaucaugcccaugaaacucccugucaagacauaugaaacagacaacaaagguaacauacucaaagaacgccccuuggcuacuuucuacauagaagaaacggaaacaaaaguccugaagcaaggcaacuucaaaguccucgcaaaagaccgaagacucaacggccuucuaucauucgcggaaacaaccgauauagaccuggagaaaaacccaaucaccaagcuaucaguagauuacgaacucaucaaguaccagaccacccgcauuuccauauucgaaaugacccuuggccuugaaaagaaacugaucgacaaauacuccacccuccccaccgacucauuccgcaacaugcucgagcgcuggcuucaaugcaaagccaaccguccugaacucaaaaacuacguaaacucccuuaucgcgguccgcaacgccuucucccacaaccaguacccuauguacgacgccacccucuuugccgaggucaaaaaguucacccuuuucccaagcguagauaccaagaaaauagaacugaauaucgccccgcaacuccucgaaaucguaggcaaagcgaucaaagaaauagagaaguccgaaaacaaaaacuaa

SEQ ID NO: 11701 - RNA, 3273 nt, Artificial Sequence
  Cas13b variant__Prevotella sp.__WP_044072147.1__Cas13b
augaacauccccgcccuagucgagaaccaaaagaaauacuucggaacauacucugucauggcaaugcucaaugcccaaaccguacuggaccauauacagaaaguggccgacauugaaggagagcaaaacgagaauaaugagaaccucugguuccaccccguaaugucccaccuauacaacgccaagaacgguuacgacaaacagcccgagaaaaccauguucaucaucgaacgacuccaaagcuacuucccuuuucucaaaauuauggccgaaaaccaacgggaauacucaaacggcaaguacaaacagaaccgcgucgaagucaacagcaacgacaucuucgagguccucaaacgugccuucggcguccuuaaaauguaccgcgaccaagccagucauuacaaaacuuacgaugaaaaacucauagacggaugcgaguuccugacaaguacugaacagccgcuguccggcaugauaaacaauuacuacacugucgcccuccgcaacaugaacgaacgcuacggauacaagaccgaggacuuagcauucauccaagacaaaagauuuaaauucgucaaggacgcuuacgggaaaaagaaaagccaagucaauacaggauucuuccucagccuacaggauuauaauggcgauacacaaaagaaacuacaccucagcggagucggcaucgcacuccucaucugcuuauuccuagauaaacaauacaucaacaucuuucuuucucgacucccaauauuuagcuccuacaaugcgcaaagcgaagaacgccgcaucauaauccgcagcuucggcaucaacagcaucaaacagccaaaagaucgcauccacucagaaaagagcaauaagucaguagccauggacaugcucaacgaaaucaaacgcugccccaaugaauuauucgaaacccuuucagccgaaaaacaaagccgauuccgcauuaucagcaacgaucacaacgaagugcucaugaaaagauccucggaccgcuucgucccccuccuccuacaauacauagacuacggcaaacucuucgaccacaucagguuccauguaaacaugggcaagcuccgguaccuucuaaaagccgacaaaacaugcauagacggccagacacgcgugcgaguaaucgaacagccgcuuaacggguucggacgucuugaagaaguggaaaccaugcgcaaacaagaaaacgggaccuucggaaacagcgggaucaggaucagggacuuugaaaacaugaaacgggacgacgccaacccagcaaacuacccguacaucgucgacacauacacgcacuacauacuggagaacaacaagguggagauguucaucuccgacgaagaaaccccggccccacuauugcccgucauagaagacgaccgcuacgucgucaagaccauuccgagcugccgaaugagcacacuagagauaccagcgauggccuuccacauguuccucuucggaagcaagaaaacagagaaacuaaucguagacguacauaaccgcuacaagcgccuauuuaaggccaugcaaaaggaagaaguaacggccgaaaauauagcaucguucggcaucgcugaauccgaccucccgcagaaaauaauagaccucaucuccggcaacgcgcacggcaaagacguagacgcguuuauaaggcucaccgucgacgacaugcuagcggacaccgaacgccgaauuaaacgauucaaagacgaccgaaaaaguauccgaucggccgacaacaaaauggggaagagaggcuucaagcaaaucuccacagggaaacuagccgacuuccucgcuaaagacaucguccuuuuccaacccucugucaacgacggagaaaauaagauaaccggccuaaacuaccgcauuaugcaaagcgccauagcggucuacaauuccggcgacgacuacgaggcaaagcaacaauuuaaacucauguucgaaaaagcccgacucauaggaaaaggcacuaccgaaccacaccccuuccucuacaaaguauucgucagaagcauaccagccaacgccguagauuucuaugaacgcuaucuuaucgaaaggaaauucuaccucaucggacucucaaaugaaaucaaaaagggaaaccgcguagacgucccauucauccgccgagaccaaaacaaauggaaaacccccgcgaugaagacccuaggccgcaucuacgacgaagaccuacccguagagcugccaagacagauguucgacaacgagauuaaaagccaccucaagucacuaccccaaauggaagggauagacuucaacaacgcaaacguaaccuacuuaaucgccgaauacaugaaacgaguccuaaacgacgacuuccaaaccuuuuaccaauggaagcgcaacuacagguacauggacaugcuccgaggagaauaugaccgcaaaggcucacuccaaagcuguuucacaucagucgaagaacgcgaaggccucuggaaagaacgcgcgagccgcaccgaaagauaucgcaagcucgcauccaacaagauccgcuccaaccgccaaaugagaaacgcguccucagaggaaaucgaaacaaucuuagacaagcgccuauccaacagcagaaacgaauaccagaaaagcgaaaaaguaauacgaagguaccgcguacaagaugcccuccuguuccuccuggccaaaaagacccucaccgagcuagccgacuucgauggcgagcgauucaaacucaaagaaaucaugccagaugccgagaaaggaauccucuccgagauaaugcccaugagcuucaccuucgaaaaagggggcaaaaaguacacaauaaccuccgaaggaaugaaacuuaaaaacuacggagacuucuuuguccucgcuuccgacaaacgaauuggaaaccuccuagagcuggucggcagcgacaccgucagcaaagaagacaucauggaggaguucaagaaauacgaccaaugucgccccgaaauaagcaguaucgucuucaaccuagagaaaugggcuuucgacaccuauccggaacuaagcgcgcgcgucgaccgcgaagaaaaaguagacuucaagucgauccucaaaauccuucucaacaacaagaacaucaacaaggaacaaagcgacauccuccggaaaauacgcaacgccuucgaccacaacaacuaccccgacaagggcgugguagaaauccgcgcccugcccgaaaucgcaaugagcaucaagaaagcauucggcgaauacgccauaaugaaauag

SEQ ID NO: 11702 - RNA, 3273 nt, Artificial Sequence
  Cas13b variant__Prevotella sp.__WP_042518169.1__Cas13b
augaacaucccagcacucgucgagaaccaaaagaaauacuucggaacauacagcgugauggccaugcuuaacgcccaaacagucuuagaccacauccagaaggucgccgacauagaaggagagcagaacgagaacaacgagaaccuaugguuccaucccguaaugucccaccuauacaaugccaaaaacggcuacgacaaacagccggaaaagacaauguucaucaucgaaagacuacaaucauacuucccauuccuaaaaauaauggcagaaaaccaaagagaauacucuaauggaaaauacaaacaaaacaggguagaaguaaacuccaacgacaucuucgagguguuaaaacgcgccuucggcguacucaaaauguaucgagacuuaaccaaccauuacaagaccuacgaggaaaaacugaucgacggcugugaguuccuaaccucaaccgagcagccccuuuccggcaugauaucgaaauacuacaccgucgcgcuacgaaacacuaaagaacgcuacggcuacaaaaccgaagaccuggccuucauccaggacaauaucaagaaaauaaccaaagacgccuacggaaaacgaaaaagccaagucaacacaggcuuuuuccucagccuccaggacuacaacggagacacccagaagaagcuccaucucuccggcguggggauagcccuccucaucugccuauuccucgacaaacaauacaucaauauauuccucucccgccucccaaucuucucgucauacaacgcccaaagugaagaacggcgcauaauaauacgcagcuucggcauaaacagcaucaaacuaccgaaagaccgcauccacuccgagaagaguaauaaaagcguagcgauggacaugcucaacgagguaaaacggugcccugacgaacuguucaccacgcuaagcgccgagaaacaguccagguucaggaucaucucggacgaccacaacgagguacucaugaagcguagcacggaccgcuucgucccacuccuccugcaguacauagacuacggaaaacucuucgaccacauaagauuccacgugaauaugggcaaacuaagguaccuacuaaaggcagacaaaaccugcauagacggccaaacacgcguccgcgucauugaacaaccccugaacggauucggacgacuagaagaggcagaaacgaugagaaaacaagagaacggcacauucggcaacucagguauccgcauccgagacuucgaaaacgucaaaagagacgacgccaaccccgcgaauuacccauacaucguggacacuuacacacacuacauacuagaaaacaacaaagucgaaauguucaucucagacaaagguagcucagcgccccuacuaccgcuaauagaagacgaccgauacguuguaaaaacaauacccuccugccguauguccacccucgagauccccgccauggcauuccacauguuccuauucggcagcaaaaagaccgaaaaacugaucgucgacguucacaaccgcuacaaaagacucuuccaggcgaugcaaaaagaggagguaacagccgaaaacauagcuucauuuggcauagcagaauccgaccucccgcagaaaauacucgaccucaucagcggcaacgcucauggaaaagacguggacgccuucauacgucucaccgucgacgacaugcugaccgacacagaacguagaaucaaacgguucaaagacgaccggaaaucgauacgcucagccgacaacaaaaugggaaaacgaggguucaaacaaauuucgacgggaaagcucgcagauuuucucgccaaagacaucguucucuuccaaccgagcgugaacgauggcgaaaacaaaauaacaggacugaauuacaggauaaugcaauccgcgaucgcggucuacgacuccggagaugacuaugaagcuaaacaacaauucaaacucauguuugaaaaagcacgccuaaucggaaaaggaaccaccgaaccccauccguuccuauacaagguauucgcccgcucaauccccgcgaaugccgucgacuucuacgagcgcuaccugaucgaaagaaaguucuaccucaccggccucugcaacgaaaucaaacgcggaaaucgcgucgacgugccauucaucaggagagaccagaacaaguggaaaacaccagcgaugaaaacccucggccgcaucuacuccgaagaucucccaguugaacucccucgccaaauguucgacaacgagauaaaaucgcaccucaaaagccucccgcaaauggaagguauugacuucaacaacgcgaacgucacauaccugaucgccgaauacaugaaacgcguccuaaacgacgacuuccaaacauucuaccaguggaaacgcaacuaccacuacauggacaugcucaagggcgaauacgacagaaagggcagccugcaacacugcuucacauccguugaagaacgcgagggacuguggaaagagcgcgcuucccgcaccgaacgauaccggaaacucgcaagcaacaagauccguucuaacagacaaaugagaaacgccuccuccgaagaaaucgagacaauacuggacaaacgacucagcaacugccgcaacgaauaccaaaaauccgaaaaggucauccggcgcuaccgcguacaagacgcccuccucuuucuccuggcgaagaaaacccucaccgaacuggcagauuucgacggcgaaagauucaaacucaaagaaauaaugccagacgcggaaaaaggcauccucagcgagauaaugccaauguccuucacauucgagaaaggagggaaaaaguacacuaucaccuccgaagguaugaagcucaagaacuacggcgauuucuucguccucgccucggauaaacgaaucggcaaucugcucgaauuaguaggaagcgacaucguaagcaaagaggacauaauggaggaguucaacaaguacgaccaaugccgaccugaaaucagcagcaucgucuucaaccucgaaaaaugggcguucgacacguaucccgagcuaucagcccgaguagaccgcgaagaaaagguggacuucaaaucgauucuaaagaucuuacucaacaacaaaaacaucaacaaagaacagagcgacauccuucgcaagauacgaaaugccuucgaccacaacaacuacccggacaagggcaucgucgaaaucaaagcacuaccagaaaucgccaugucuauuaaaaaggccuuuggggaauacgccaucaugaaauag

SEQ ID NO: 11703 - RNA, 3273 nt, Artificial Sequence
  Cas13b variant__Prevotella sp.__WP_044074780.1__Cas13b
augaacauacccgcccuggucgaaaaucaaaagaaauauuucggcaccuacucagugauggccaugcucaacgcacaaaccguacuggaccacauacagaaagucgccgacauagaaggagaacaaaaugaaaacaacgaaaaccuuugguuccaccccguaaugagccaccucuacaacgccaaaaacggcuaugacaaacaaccugagaaaaccauguucauaaucgaacgccuccaaagcuacuucccguuccucaagauuauggccgagaaccaacgagaauacagcaacggaaaauacaagcaaaaccgagucgaaguaaacagcaaugacauauucgagguacuaaagcgggccuucggaguccucaaaauguaccgggaccuaacgaaccacuauaaaacauacgaggaaaagcuaaucgacgggugcgaguuccugacuucuaccgaacaaccauuuagugggaugaucaguaaauacuacaccgucgcccuaaggaacaccaaagaaagauacgguuacaaagcagaagacuuggccuucauacaagacaaccgauacaaguucacaaaagacgcauacggaaaacgaaagagucagguaaauacaggcuccuuucugagccuacaagacuacaacggggacaccaccaaaaagcuacaccuaucagguguaggcaucgcccuucugaucugucuguuccucgacaagcaauacaucaaccucuuccucucgcgccuacccauauucuccucguacaacgcacaaucggaagaacgccgcauuaucauccgcagcuucggaauaaacagcauaaaacagcccaaggacagaauacacuccgaaaaauccaacaaaagcguggcgauggacaugcucaacgaagucaaaagaugccccgacgaacucuucacaacccuguccgccgagaaacagagccgcuucaggauuaucucagacgaccacaacgaaguacuaaugaaacguuccuccgaccgguucgucccacuucuacugcaguacauugacuacggcaagcuguucgaccacauacgcuuucacgugaacaugggcaaacuccgauaccugcucaaagccgacaagaccuguauagacggacaaacacguguaagggucaucgagcagccucuuaauggguuuggcaggcucgaggaaguggagaccaugcgcaagcaagaaaacggcacguucggaaacuccggcauccgcauaagggacuucgaaaauaugaaacgugacgacgccaaccccgcaaacuacccguacauaguagaaacauacacgcacuacauccucgagaacaacaaaguagaaauguucaucuccgacgaagaaaacccaacaccccuccuacccgugaucgaggacgaucgcuacgucguuaagacgauaccgagcugccggaugucgacccuagaaauaccagcgauggcguuccacauguuccuauucggaagcgagaagacagaaaaacugauaauagacguucacgaccgcuacaagcgacuauuccaggccaugcaaaaagaagaagucaccgcggagaauaucgcgagcuucggcaucgcagaguccgaccuaccccagaaaauaauggaccuaauaagcggaaacgcgcacggcaaagacguagacgccuucauccgucuaacaguagaugacaugcuaaccgacaccgagcgcagaaucaaaagauucaaggacgaccgcaagagcauacgcagcgccgacaacaaaaugggcaagcggggauucaagcaaauauccacaggcaaacuggccgacuuccuggccaaagauauaguacucuuccaaccuuccgugaacgacggcgaaaacaagauaacaggccucaacuaccgaauaaugcaaagcgcgaucgccguauacgacucgggcgacgacuacgaagcgaaacagcaguucaaacucauguucgaaaaagcacgacuuaucggcaagggcacgacagaaccccaccccuucuuauacaaagucuucgucagauccauccccgccaacgccguagauuucuacgagagguaccuaauagaacgaaaauucuaucucauaggucucucaaacgaaaucaagaaaggcaaccgcguggacgucccguucaucaggagggaccagaauaaguggaaaacacccgcgaugaaaacacuaggacgcauauacuccgaagaccuccccgucgagcugccaagacaaauguucgauaacgaaaucaaaucccaccuuaaaucgcugccacaaauggaaggcauagacuucaauaacgcgaacgucacauaccucauagccgaauacaugaaacgcguccuaaacgacgacuuccaaacguucuaccaauggaaacgaaacuacagguacauggacaugcuucgaggagaauacgaccgcaaagggagccuccagcacugcuucacauccaucgaagaacgcgaaggucuauggaaagaacgcgccucccgcacugagcgguaccggaagcuggccagcaacaaaauccgcagcaaccgccagaugcgcaaugcaucauccgaggagauagaaaccauccucgacaaacgacucucaaacugccguaacgaguaccagaaguccgagaaaaucauccgccgcuaccgaguacaagacgcccugcucuuucuacucgcuaagaagacccucacagaacuagcagacuucgacggagaacgauuuaaacuuaaagaaaucaugccagacgccgaaaaaggcauacucucugagauaaugccuaugagcuucaccuuugaaaaaggcgggaaaaucuacaccaucacauccggcgggaugaaacucaagaauuacggggacuucuuugugcucgccucugauaaacggaucggaaaccuccucgagcuuguaggauccaauaccgucucaaaggaagacauaauggaggaauuuaagaaauacgaccagugccgccccgaaaucuccucaauugucuucaacuuggaaaaaugggccuucgacacauacccagaacuaccagccaggguagaccgcaaagaaaaagucgacuucuggucgauacuugacgugcucagcaacaacaaagacauaaacaacgaacaaagcuacauccuacguaagauaaggaacgccuucgaucacaacaacuacccagacaaggguauagucgaaauuaaagcgcucccggaaaucgcgaugagcaucaagaaagcauucggagaauacgcaaucaugaaauaa

SEQ ID NO: 11704 - RNA, 3438 nt, Artificial Sequence
  Cas13b variant__Psychroflexus torquis__WP_015024765.1__Cas13b
auggaaucgauuauaggccugggccucagcuucaaucccuacaaaacugccgauaaacacuacuucggcucauuccugaaccuagucgagaacaaccucaacgccguguucgccgaguucaaagagcgcaucuccuacaaggccaaagacgaaaauaucagcagccuaaucgaaaagcacuucaucgacaacaugucaauugucgacuacgagaaaaagaucagcaucuugaacggguaccuccccauaauagacuuccuugacgacgagcuggaaaacaaccuuaacacgcgagucaaaaacuuuaagaaaaauuucaucauacuugcggaggccauagaaaaacucagagacuauuacacccacuucuaccacgaccccaucaccuucgaagacaacaaagaaccacuccucgagcuccuggacgaaguacuacugaaaacuaucuuggaugugaagaaaaaguaccugaaaacagacaaaaccaaagaaauccucaaagacagccuucgcgaggaaauggauuuacucgugauaaggaagaccgacgagcuacgcgagaagaagaaaacaaaucccaaaauacaacauaccgacuccagccaaaucaaaaacagcaucuucaacgacgcuuuccaaggccuccucuacgaggacaaaggaaacaacaagaagacucagguaucccaccgcgcaaaaacacgauugaaccccaaagacauacacaaacaagaggaaagagacuuugagaucccccugucuacguccggccucguauuccuaaugucccuguuccucucaaagaaagaaauugaagacuucaaauccaacaucaaaggcuucaaaggcaaaguagucaaagacgagaaccacaacucccucaaauacauggccacccaccgcguauacuccauccuggccuucaaggggcucaaguauagaauaaagaccgacacauucuccaaagaaaccuuaaugaugcaaaugaucgacgagcuuuccaaaguccccgauugcguauaccaaaaccuauccgaaacgaagcaaaaggacuucaucgaagacuggaacgaguacuuuaaagacaacgaggagaacacugagaaccucgaaaacagccgugucguccacccuguaauccguaaacgguacgaagacaaguucaacuacuucgcaauacgcuuccucgacgaauuugcuaacuucaaaacgcuuaaauuccaagucuucauggguuacuacauccacgaucagcggaccaaaacaauaggaacgacaaacauaacaacggaacggacaguaaaggaaaagauaaacgucuucggcaaacuuuccaagauggauaaccuaaagaaacacuucuucucccaauuauccgacgacgaaaacaccgacugggaguucuucccuaaccccucuuacaacuuucugacucaagcggacaacucgccggcaaacaauauacccaucuaccuagaacucaagaaccaacaaauaaucaaagaaaaagacgcuaucaaagcugaaguaaaccaaacccagaaccgcaaccccaacaaacccucuaaacgagaccuccucaacaaaauccuuaagaccuacgaagacuuucaccaaggugaccccaccgccauccucagcuuaaacgagaucccggcucuccuucaccuguuccucgucaagccgaacaacaaaacgggccaacagaucgagaauaucauacggauaaagaucgagaaacaauucaaggcuauaaaccacccauccaaaaacaacaaaggcaucccaaagucucucuucgcagauaccaacgucagaguaaacgccauaaaacucaaaaaggaccuagaggccgagcuagauaugcuaaauaagaaacacaucgccuucaaagagaaccagaaggcuucgucaaacuacgacaagcuacuaaaggagcaccaguuuacccccaaaaacaaacgccccgaauuaaggaaauacgucuucuacaagagugagaagggagaggaagccacauggcuagccaacgauaucaagcgcuucaugcccaaggauuucaaaaccaaauggaaaggcugccaacacucugaacuccaaagaaaacucgccuucuacgaccgccacacuaagcaggacaucaaagaacuccucuccgggugcgaguucgaccacagccuccuagacauaaacgccuacuuucagaaggauaacuucgaagacuucuucuccaaguaccucgagaacaggaucgaaacacuagaaggaguccugaagaaacuucaugacuucaaaaacgaaccgacaccccucaaaggagucuucaaaaacugcuucaaauuucucaaacgccaaaacuacgucaccgaaagccccgaaaucaucaaaaagcgaauccuugcuaagccaacauuccuuccacgaggaguauucgacgaacgacccaccaugaagaaaggcaaaaacccccuuaaagacaaaaacgaguucgcagaaugguucgucgaauaucucgaaaacaaagacuaccaaaaauucuauaacgcugaggaguacagaaugagagacgcggacuucaagaaaaacgcgguaauaaagaaacagaaacucaaggauuucuacacccugcagaugguaaacuaucuacuaaaagaaguguucggcaaggaugaaaugaaccuccagcucucagaacucuuccagaccagacaagaacgucuaaaacugcaagggaucgccaaaaagcagaugaacaaagaaacaggagacagcagcgagaacacacgcaaccaaaccuacauauggaacaaagacguucccguaucuuucuucaacggaaagguaacaaucgacaaaguuaagcucaaaaacauagguaaguacaaacgcuacgagagagacgaaagggucaaaaccuucaucggcuacgagguagacgagaaauggaugauguaccuaccgcacaauuggaaagaccgcuacucggucaaacccaucaacgugauagaccuccaaauccaagaauacgaagaaaucagaucccacgaacuccuuaaagagauccagaaccuagagcaguacauauaugaucacaccacagauaagaacauccuacuacaggauggcaaccccaacuuuaaaauguacguacuaaauggccuccugaucggcaucaagcaggucaacauccccgacuucauaguccuaaaacagaacaccaacuucgacaaaaucgacuucacaggcaucgccaguugcagcgaacuugaaaagaaaaccaucaucuugauagccaucaggaacaaguucgcccacaaccaauuaccuaacaagaugaucuacgaccuagccaacgaguuccuaaaaaucgagaaaaacgaaacauacgccaauuacuaccuaaaaguacucaagaaaaugaucuccgacuuagccuaa

SEQ ID NO: 11705 - RNA, 2847 nt, Artificial Sequence
  Cas13b variant__Riemerella anatipestifer__WP_049354263.1__Cas13b
auguuuuucucauuccacaacgcgcaacgcgucaucuucaaacacuuauacaaggcuuucgacgcuucacuccguaugguaaaagaagacuacaaagcccauuucaccgucaaccucaccagagacuuugcacaccuuaaccgcaaaggcaaaaacaaacaagauaaccccgauuuuaaccgcuaccgcuuugagaaggacggauucuucacagaaucaggauugcucuuuuucacaaaccucuuucucgacaaacgggacgcauacuggaugcucaaaaagguuuccggauuuaaggcaucccacaaacaaagggagaaaaugaccacagaaguguuuugccgaucccgaauccuacuacccaagcuccgccuagaaucccgguacgaccacaaccaaaugcuccuagacaugcuauccgaacucagccgaugccccaaacuccuauacgaaaagcuguccgaagagaacaagaaacacuuccaggucgaagcagacggcuuccuagacgaaauugaagaagaacagaaccccuucaaagauacccucauacgucaucaagaccgcuucccauacuucgcccuacgcuaccuugaccuaaacgagucguucaagucgauuagauuccaagucgaccugggcaccuaccacuacuguaucuacgacaaaaagaucggugacgaacaagaaaaacgacaccuaacccggacccucuuauccuuuggccgccuccaagacuucacggaaaucaaccgcccccaagaauggaaagcgcucaccaaagaccucgacuauaaagaaacuuccaaucagccauucaucuccaaaaccacaccccacuaccacauaaccgacaacaaaaucggcuuccgccucgguacaagcaaggaauuauaccccagccuagaaaucaaagauggcgccaaccgcauagccaaauaucccuacaauucgggauucguagcccacgccuuuauauccguccacgaacuccuaccccuuauguucuaccaacaucuaaccggaaaaucagaggaccuccuaaaagaaaccgucagacacauccaacgcauuuacaaagacuucgaagaggaacgaaucaacaccaucgaggaccucgagaaagccaaccaaggccgccucccacuaggcgccuuccccaagcaaaugcuaggacuccuccagaacaaacaacccgaccucucagagaaagccaaaaucaagaucgagaaacuaauagcugaaaccaaacuccugagccaccgccucaacacaaaacugaaaagcagcccaaaacuagggaaacgccgggagaaacucaucaagaccgggguccuggccgacuggcucgucaaagacuucaugcguuuccagcccguagccuacgacgcacaaaaccaaccgaucaaguccucaaaagcgaacucgacagaguucugguucauccgcagagccuuagcauuauacggaggcgagaaaaacagacucgaaggcuacuucaagcagaccaaccucaucggcaacaccaauccccaccccuuucugaacaaauucaacuggaaagccugcaggaaccuagucgacuucuaccaacaauaucuugaacaacgcgaaaaauuccuggaagcaauuaagaaucagcccugggagcccuaccaguauugccuccuccucaaaaucccaaaagaaaaccgcaaaaaccuagucaaaggaugggaacagggaggaaucucccucccccgcggccucuucaccgaagccauccgcgagacacucagcgaagaccucaugcucagcaaacccauccgaaaagaaaucaagaaacacggcagagucggguucaucucacgcgccaucacacuguacuucaaagagaaauaucaagauaaacaucaauccuucuacaaccuauccuacaaacucgaagcuaaggccccgcuccuaaagcgagaagaacacuacgaauacuggcagcaaaacaaaccgcaaucaccaacugaaagccaacgccuagagcuccacacaucagaccgauggaaggacuaucucuuauacaagcgcuggcaacaccuugaaaagaaacugagacucuaucgcaaccaagauguaauguuauggcugaugacccuagaacucaccaaaaaccacuucaaagaacuuaaccuaaacuaccaccaacuaaaacucgaaaaccucgcagucaacguacaggaagcggacgccaagcuaaacccccuuaaucaaacacucccgaugguccuacccguaaaagucuaccccgcuacagccuucggcgaaguccaauaccacaagacccccauccgcaccgucuacauucgcgaggaacacaccaaagcccuaaaaaugggcaacuucaaagccuuagucaaagaccggaggcuuaacggccuuuucagcuucauaaaggaagaaaacgacacccaaaaacaccccauaucccaacucagacuccgaagagaacuugaaauauaccaaucucuccgcguggacgccuucaaagagacgcugucucuagaggaaaaacuucucaacaaacacaccagucuauccagccucgaaaacgaguuccgagcgcuccuugaagaauggaagaaagaauacgcagccucaagcauggucaccgacgaacacaucgccuucaucgccuccgucaggaacgccuuuugccacaaccaauaucccuuuuacaaagaagcguuacaugcgccaauuccccucuucaccgucgcacagcccaccaccgaagagaaagacggccuaggcauugccgaagcgcuccugaagguucucagggaauacugcgagaucgucaagagccaaaucuaa

SEQ ID NO: 11706 - RNA, 3288 nt, Artificial Sequence
  Cas13b variant__Riemerella anatipestifer__WP_004919755.1__Cas13b
auggagaaaccccuacugccuaacgucuacacccucaaacacaaguucuuuuggggcgccuuccucaauaucgcacggcacaacgcuuucaucaccauuugccacaucaacgaacaacuuggccucaaaacuccaucgaacgacgacaaaaucguugacgucgucugcgaaaccuggaacaacaucuuaaacaacgaccaugaccuccucaagaaaucacaacucacagaacugauccucaagcacuucccauuucugacggccaugugcuaccacccaccaaagaaagaaggcaaaaagaaaggccaccaaaaagaacaacaaaaagaaaaagaauccgaagcccaaagccaggcagaagcucucaaccccagcaaacuaauagaagcccuugagauccucgucaaccagcuccacagccuacguaacuauuacagccacuacaaacacaagaaacccgacgccgaaaaagacaucuucaaacaccucuacaaagccuuugacgcaucccuaagaauggucaaagaagacuacaaagcccacuucacaguaaaccuuacgcgagacuucgcacaccuaaacagaaagggaaagaacaaacaagacaaccccgacuucaaccgcuaccgcuucgaaaaggacggcuucuucacagaauccggccucuuauucuuuacuaaccucuuccuggacaaaagagacgcauacuggaugcuuaagaaggucucgggcuucaaggccagucacaaacaaagagaaaagaugacuaccgaagucuucugccgcagccgcauccugcugccaaaacuccgacucgagucccgauacgaccacaaccaaaugcugcuagacaugcuaucggaacuaagccgaugccccaagcuccuguacgagaaacucuccgaggaaaacaagaaacacuuucaagucgaagccgauggcuuccucgaugaaauagaggaagaacaaaaccccuucaaagauacacucaucagacaccaggaccgcuuccccuacuuugcacugcgguaccucgaccucaaugaaaguuucaaaucgauacgauuccaaguagaucugggaaccuaccacuacugcauauacgacaagaaaauaggagacgaacaagagaaacgccaucuaaccagaacccuccugagcuucggccgucuacaagacuuuacagaaauaaaccguccccaagaauggaaagcccucaccaaagaccucgacuacaaagaaaccucaaaccaacccuucaucuccaaaacuacaccccacuaccacaucaccgacaacaaaaucggauucagacuugggacauccaaagaacuauauccaagucucgaaaucaaagacggcgcgaaucgcauagccaaauauccuuacaacuccggauucgucgcacacgccuucauaaguguccacgaacuauuaccacucauguucuaccagcaccucaccggcaagucggaagaccuccuaaaggaaaccguacgccacauacagcgaauauacaaggacuuugaagaggaacgaaucaacacaauagaagaccuagaaaaagccaaccaaggacgccucccccucggcgcauuccccaaacagauguuaggccuccuccaaaacaaacaaccagauuuauccgaaaaagcaaagaucaaaaucgagaagcuaaucgcagaaacaaagcuccuaucccaucgccucaacacgaagcucaagagcagccccaaacucggaaaacgccgugagaaacucauuaaaaccggagugcucgcugacugguuaguaaaagacuuuaugcgcuuccagccagucgccuaugacgcccagaaucaacccaucaagagcuccaaagccaacucaacagaguucugguucauucgacgagcacuagcccuguacgguggggagaaaaacagacucgaaggcuauuucaaacaaaccaaccucaucggaaacacgaacccgcaccccuuccuaaacaaauuuaacuggaaagccugccgcaaccugguagacuucuaucagcaguaccuugaacaaagagaaaaauuucucgaagccaucaaaaaccaaccaugggaaccuuaucaauacugccuccuucuaaagauccccaaggaaaaccguaaaaaccucgucaaagguugggaacaaggcggaaucagucucccucgcggccuguucaccgaagcaauccgagaaacccuuagcgaagaccucaugcucuccaaaccaauccgaaaagaaauaaagaagcacggccgcguaggauucaucagccgagccaucacgcuauacuucaaggaaaaauaccaggacaaacaccagucauucuacaaucucucauacaagcuagaggcaaaggccccacuccuaaaacgcgaggaacacuacgaauauuggcaacaaaacaaaccccaauccccaaccgaaucgcaaagacucgaauuacacacauccgauagauggaaagacuaccuacuauacaaacgauggcaacaccucgagaagaaacuacgacuuuaccgcaaccaagacgucauguuauggcucaugacgcuggagcugaccaaaaaccauuucaaagaacuuaaccugaacuaccaccaacugaaacucgagaaccuugccgucaauguacaagaggccgacgcaaaacucaauccacugaaccaaacgcucccaaugguccuaccggucaaagucuauccggcuacagccuuuggagaaguccaauaccauaaaacgccaauccgcacggucuacaucagagaagaacacacaaaagcccucaaaauggggaacuucaaagcucucgucaaagacagacgacucaacggccuuuucagcuucauuaaagaggaaaacgacacccaaaaacaccccaucucucaacuacgacuccgacgcgaacucgaaauuuaccaaagccuacgcguagacgcauucaaagaaaccuuaucccucgaagagaaacuccucaauaaacacaccucccucuccucccucgaaaacgaauuucgagcucuacucgaggaguggaaaaaggaauacgcugccagcuccaugguaaccgacgagcacaucgccuucauagcaucggucaggaacgccuuuugccacaaccaauacccauucuacaaagaagcguugcacgccccgaucccacucuucaccgucgcccaaccgacuacggaggagaaggacggacuaggcaucgcagaggcacuccuaaaagugcuacgcgaauacugcgagauaguuaaaucccagauauga

SEQ ID NO: 11707 - RNA, 3288 nt, Artificial Sequence
  Cas13b variant__Riemerella anatipestifer__WP_064970887.1__Cas13b
auggagaaaccacugccccccaacgucuacacccucaaacacaaauucuucuggggugccuuccuaaauauugcacgacacaacgccuucaucaccaucugccauauaaacgaacaacucggacugaccacacccccuaacgacgacaaaaucgcagacguagucugcggcaccuggaauaacauccugaacaacgaccacgaccuccuuaagaagucgcaacucaccgaacuaauccugaaacacuuccccuuccuggccgccaugugcuaccacccgccaaaaaaagaaggcaaaaagaagggcucccaaaaagagcaacaaaaagaaaaggaaaacgaagcccagucacaagcugaagcccucaaccccucggaacucaucaaaguccuuaaaacccuagucaaacagcuccgcacccuccgcaacuacuacucacaccauucacacaagaaaccagaugcugaaaaggacauuuucaaacaccucuacaaagcauucgacgcgucacugaggauggucaaagaagauuacaaagcacacuucaccgucaaucuaacccaagacuucgcgcaccucaaccgcaaaggaaaaaauaagcaagacaaccccgacuucgacagauaccgauuugagaaagacggcuuuuucaccgaaucaggccuccucuucuucacuaaucucuuccuggacaaacgagacgcauacuggaugcuaaaaaaagucuccggcuucaaagcgucccacaaacagagcgaaaaaaugaccacagaagucuuuugucgaucacgaauccuacuccccaagcuccgacucgaaucccgauaugaccacaaccaaaugcuccucgacaugcuuuccgaacucucgcgauacccaaagcugcucuacgaaaaacucuccgaggaggacaaaaaacguuuucaggucgaagccgaugguuuccuagacgaaaucgaagaagagcaaaaccccuucaaagacacgcuuauuagacaucaagaccgcuuccccuacuucgcacugcgauaccucgaccuaaacgaauccuuuaagagcauccgcuuccaagucgaccucgggaccuaccacuacugcaucuacgacaaaaagauaggcgacgagcaagaaaaacgucaccuaacccgcacccuccucuccuucggcaggcuucaagacuucaccgaaauaaaccgcccacaagaauggaaagcacucacaaaggaccucgacuacaaagagacgucgaaacagcccuucauuucaaaaaccaccccacacuaccacaucaccgacaacaaaaucggcuuucgucucggcacauccaaggagcuauacccaagccucgaagucaaggacggagccaaccgaauugcccaauaccccuauaacuccgacuuuguagcgcacgccuuuauaagcguacaugaacuacucccucucauguuuuaccaacaccugaccgggaaaucagaggaccuacuaaaagaaaccguacgccacauacaacgcauauacaaagacuuugaggaggagcgcaucaacacuaucgaagaccucgaaaaagcuaaccaaggccggcucccucucggcgccuuccccaaacaaaugcuaggccuccuccaaaacaaacagccagaccuaucggaaaaagcgaaaauaaaaauagagaagcucauagccgagaccaagcuccucucacaccgccucaacacuaaacucaaaucgucuccgaaguuaggaaaacgaagggaaaaacucauaaaaaccggcguccuggcggauuggcucgugaaggacuucaugagauuucaacccguagcguacgaugcgcaaaaccagccaaucgagucuagcaaagcaaacucaacagaguuccagcucauccaacgugcacuagccuuauauggaggagagaaaaaccgccucgagggcuauuucaagcaaacaaaccugauugguaauaccaacccgcaucccuuucuaaacaaauucaacuggaaagccugccgcaaccucgucgacuuuuaccaacaauaccuggaacaacgcgagaaauuccucgaggccauaaaaaaccaaccaugggaaccuuaccaauacugccuccuacuaaagaucccgaaagagaaccgaaaaaaucucguaaaagggugggagcaagguggcaucucucuaccgcgaggccucuucacugaagcuaucagagaaacgcuaucgaaagaccucacccucagcaaacccauaagaaaagagauuaaaaagcacggccgcguaggauucauaucacgcgcaaucacccucuacuuccgagaaaaauaccaggacgaccaccaaagcuucuacgaccucccauauaaacucgaagcgaaagcgucaccccuccccaaaaaggaacacuacgaauacuggcagcaaaacaaaccccaaucucccacagaauugcagaggcuagaacuccacaccucagaccgauggaaagacuaccuacuauauaaacguuggcaacaccucgaaaaaaaacugcgccuuuaccgaaaccaagacguaaugcucuggcucaugacccucgaacuaacaaaaaaccacuuuaaagagcuaaaucucaacuaccaccaacucaaacuggagaaucucgccgucaacguccaggaagcagacgcaaaacugaacccucuuaaccagacgcuacccaugguccucccaguaaaagucuacccagccacugccuuuggcgagguccaauaccaagagaccccgauccgcaccgucuacauucgcgaagaacaaaccaaagcccucaaaaugggcaacuucaaagcacucgucaaagaccgucgacuuaacggccuauucucuuuuaucaaagaagagaacgacacacaaaaacauccaaucucacagcuccgacuccgacgugaacucgagaucuaccaaucgcuccgagucgacgccuucaaagaaacucugaaccuagaagaaaaacuccucaagaaacacaccagccuuucaucuguagagaacaaguucaggauccuccucgaggaauggaaaaaagaauacgccgccucaucgauggucaccgacgaacacauugcauuuaucgcgagcguacggaacgccuucugccacaaccaauacccuuucuacgaggaagcccugcacgcacccaucccgcuauucaccguugcacaacaaacuacugaagaaaaggacggccuaggcauagcggaagcacuucugcgcgugcuccgcgaguacugcgaaauagucaaaucacaaaucuga

SEQ ID NO: 11708 - RNA, 2853 nt, Artificial Sequence
  Cas13b variant__Riemerella anatipestifer__WP_061710138.1__Cas13b
auguucuucuccuuccacaacgcccaacgugucaucuucaagcaccucuacaaagcauuugacgcaucccugcggauggugaaagaagacuacaaggcacacuucaccgugaaccucacccgugacuucgcgcaccucaaccguaaaggcaaaaacaaacaggauaaccccgacuucaaccgauaccgauucgaaaaggacggcuucuucacagaaaguggacuacuauucuuuaccaaccuuuuucuagacaagagagacgcauacuggaugcugaagaaagucucgggcuucaaagccagucacaaacaaagcgagaaaaugaccaccgaaguuuucugccgaucccguauccuacucccaaaacuccgccuagaaucgcgauacgaccacaaccaaaugcuacucgacaugcucucagaacucagccgaugccccaaacuccucuacgaaaaacucagcgaaaaagacaagaaaugcuuccaaguagaagccgacggauuccucgacgagaucgaagaggaacaaaaccccuucaaagacacccucauccgacaccaggaccgcuucccauacuucgcccucagauaucucgacuuaaacgaaucguucaaaagcauacgcuuccaagucgaucuuggaacauaccauuacugcaucuacgacaagaaaauaggcuacgaacaggagaaacggcaccucaccagaacccugcuaaauuucggccgacuacaagacuucacugaaaucaacaggccacaagaauggaaagcacucaccaaagaccuagauuacaacgaaacgucaaaucaaccauucaucucuaaaacaacuccucacuaccacaucacagacaacaagaucggcuuccgccuucgcaccucgaaggaacucuaccccagcuuggaaguuaaagacggcgcuaacaggauagccaaauaccccuacaauuccgauuucgucgcacacgccuucauuagcaucucaguucaugaacuccucccccugauguucuaccagcaccucaccgguaaaucggaagaccuccucaaagaaaccguccgucacauccaacgaaucuacaaagacuucgaagaagaacgcaucaacaccaucgaggaccuagaaaaggccaaccaaggucgccucccucugggugccuucccgaaacaaaugcuaggccuacuacaaaacaaacaacccgaucucagcgaaaaagccaaaaucaaaauagagaaacuaauugcagaaacuaagcuccuaucccaccgccuaaacacgaaacucaaguccuccccaaaacucggcaaaaggcgcgagaaacuaaucaaaaccggaguccucgcagacuggcucgucaaagacuucaugcgguuccagcccguuguguacgacgcccaaaaccaaccuaucaaauccucaaaggccaacuccacagagucacgacuaauccgcagagcacucgcccucuacgggggcgagaaaaaccgccucgaaggauacuucaagcaaaccaaccucaucggaaacacuaacccccaucccuuccuaaacaaauucaacuggaaggcuugcagaaaccuagucgacuuuuaccaacaauaccucgaacaaagagaaaaauuccuagaagccaucaaacaccaaccaugggaaccauaucaauacugccuccuucucaaagucccgaaagaaaaccgcaaaaauuuaguaaaaggaugggaacaagggggaauaucccuaccucgcggccuuuucaccgaagccauccgggaaacacuaucgaaagaccuaacccugagcaaaccaauacgcaaagaaauaaagaaacauggccgagucggauuuaucucacgcgcaaucacacucuauuucaaagagaaauaccaagacaaacaccaaucuuucuacaaccucuccuauaaguuagaggcaaaagcuccccugcuuaagaaagaagaacacuacgaauauuggcagcagaacaaaccucaaucccccaccgaaucccaacgccuugagcuccacacuucggaccguuggaaagacuaccugcucuauaaacguuggcaacaccucgaaaagaaacuccgccuauaccgcaaucaagacaucaugcucuggcucaugacacuagaacuaaccaaaaaccacuucaaagagcucaaucuaaacuaccaccaacucaagcucgaaaaccuugccgugaacguccaagaggccgacgccaagcuaaacccacucaaccaaaccuugcccaugguacuacccgucaaaguguaccccaccacagccuucggcgagguccaguaccacgaaacccccauccgcaccgucuacauacgcgaagaacagaccaaagcccucaaaaugggaaacuucaaagcccuagucaaagaccgccaccuaaacggccuguucagcuucauaaaagaggaaaaugacacucaaaaacacccaauaucacaacuucgucugcgccgcgaacucgaaauauaccaaagccuacgcgucgacgcauucaaagaaacccuaucucuggaagaaaaacucuuaaacaaacacgcuagccuaagcagccucgaaaacgaguuccgaacucucuuggaagaguggaaaaagaaguacgccgcauccagcaugguaacagacaaacauauagcuuuuauagcgagcguucgcaacgcguucugccacaaccaauacccauucuacaaagaaacacuacacgcgcccauccuucucuucaccgucgcacaacccaccaccgaagaaaaagacggacuaggcauagccgaagcacuccuccgcguucugcgcgaauacugcgaaauagucaaaucacagauauaa

SEQ ID NO: 11709 - RNA, 2850 nt, Artificial Sequence
  ARMAN Cas9 variant__Candidatus Micrarchaeum acidiphilum__OJI07263.1__Cas9
augagagacucaauaacggcgccccguuacuccucggcccuggcagcacggaucaaggaguucaacagugccuuuaaacuuggcaucgaccucggaaccaaaacaggaggaguagcucucgucaaggacaacaagguacuccucgccaaaacauuccucgacuaccacaagcaaacccuagaagaacgccgcauccacagaagaaaccgccgcagccgccuugccaggcgcaaaagaauagcccgacuccgauccuggauccuccgucaaaagauauacggaaagcaacucccagacccauacaaaauaaagaaaaugcaguuacccaacggagugcguaaaggagaaaacuggaucgaccucguagucucaggcagagacuuaagccccgaagccuucgugcgggcaaucacacuaauauuccaaaaacggggccaacgcuacgaagaagucgcaaaggagaucgaagaaauguccuauaaggaguucucaacacacauaaaggcccugaccuccguaacugaagaagaguucacagcccucgcggccgaaaucgaacgccgccaggacgucguagacaccgauaaggaagcggaacgcuacacucagcuaagcgagcuacuaagcaagguauccgaaucaaaauccgaaagcaaagaccgcgcccaacgcaaagaagaccucggaaaaguagucaacgccuucugcagcgcccacagaauagaagacaaagacaaauggugcaaagaacucaugaaacuccuagaccgcccagugcgacaugcacguuuccugaacaaaguccucauccgauguaacaucugcgaccgcgcuacaccuaaaaagagccguccugauguccgcgaacugcuauacuucgacacaguaaggaacuuccucaaggcaggccgcguagagcaaaacccagacguaauaagcuacuauaaaaagauauauauggacgcagaagucauccgagucaaaauccugaacaaagagaagcucaccgacgaggacaagaaacagaaaaggaaacuagccucggaacuuaacagguacaagaacaaagaauacgucacggacgcacaaaagaaaaugcaagagcaacuaaaaacgcuccuauuuaugaaacucacaggacgcagccgcuacugcauggcacaccuuaaggaaagggccgcaggcaaagacguagaagaaggccugcacggcgucguccaaaaacgccacgaccgaaacauagcacaacgcaaucacgaccuuagagucaucaacuuaaucgaaucacuccuguucgaccaaaacaaaagucuaucggacgcaauucgcaaaaacgggcugauguacgugaccauagaggcaccagaaccaaaaaccaaacacgcaaagaaaggcgccgccguagucagagacccacgcaaacuaaaagaaaaacuguucgacgaccaaaacggagugugcaucuacaccgggcuacaacucgacaaacucgaaauaagcaaauacgaaaaagaccacauuuuccccgacucuagagauggcccaagcauccgcgacaaucucguguugacgacaaaagaaaucaacagcgacaaaggcgaccgaacaccaugggaauggaugcacgacaacccagaaaaauggaaagccuucgaacgccggguugccgaguucuacaagaaaggccgaaucaaugagcgcaaacgggagcuacucuuaaauaaaggcacagaguaccccggugacaacccaacugaacucgcgcgaggcggagcacgcgucaacaauuucaucacagaguucaacgaccgccugaaaacccacggaguacaagaacuccaaacaaucuucgaacgaaacaaaccaaucguacaagucguccguggagaagaaacacaaagacuccggcgccaauggaacgcccugaaccagaacuucaucccacucaaagaccgagcgauguccuuuaaucaugccgaagacgccgcaaucgccgccagcaugccgccgaaguucuggagagaacaaaucuaccgcacggcauggcacuucggcccaucaggaaaugagcgaccagacuucgcccucgcugaacuagcaccccaguggaacgacuucuucaugacaaaaggaggaccaauaauagccguucugggaaagaccaaguacagcuggaaacacucaauaaucgacgacacuaucuacaaacccuucagcaagagcgccuacuacgucggaaucuacaaaaagccaaacgccauaaccuccaacgcaaucaagguccuccgcccaaaacuccuaaauggcgagcauacaaugagcaaaaacgccaaguacuaccaccagaagauagggaacgaacgauuucuaaugaaaagccagaaaggaggguccaucaucacagucaaaccccacgacggaccugaaaaaguccugcaaauaagccccaccuacgaaugcgccguccuaaccaagcacgacggcaaaauaaucguaaaauucaaaccaauaaaaccccuacgggacauguacgcccgaggagugaucaaggccauggacaaagaacucgaaacaagccucagcuccaugucuaaacacgcgaaauacaaagaacuacacacacacgacauaauauaccucccggccaccaagaaacacgucgacggcuacuucauaauaaccaaacucagcgcaaaacacggcauuaaggcgcugcccgagucaauggucaaagucaaguacacccaaaucggaagugaaaacaauagcgaagucaaguugaccaagcccaagcccgaaauaacccuagacagcgaggauaucacgaacaucuacaacuucaccagguga

SEQ ID NO: 11710 - RNA, 2904 nt, Artificial Sequence
  ARMAN Cas9 variant__Candidatus Parvarchaeum acidiphilum__APG80630.1__Cas9
augcuagggagcagccgcuaccugcgcuauaaccuuaccaguuucgaaggaaaggaacccuuccuaaucaugggauauuauaaagaguauaacaaagaguuaucaucgaaagcacagaaggaguucaacgaccaaauauccgaauuuaacagcuacuacaaacuaggaauugaccucggagacaagacgggaaucgccauagugaaaggcaacaaaaucauccucgccaaaacgcucauagacuuacacagccagaagcucgacaaaagacgagaagcacgcagaaaccggcgcacaagacucuccaggaagaaacggcuugcacgccuacgcagcugggucaugaggcagaaagucggcaaucagcgccuccccgacccauacaagauaaugcacgauaauaaauacuggaguaucuauaacaaaagcaacuccgcaaacaagaagaacuggauagaccuccuaauacacuccaacagccucagcgcagacgacuucguccgagggcugacaauaaucuuccgaaaaagaggcuaccucgcauucaaauaccucaguagacuuucggacaaagaguucgaaaaguacauagacaaccucaaaccacccauaagcaaauacgaauaugacgaagaccuagaggagcucagcagccgcguagaaaauggggaaauagaggagaaaaaguucgaaggccucaaaaacaaacuggauaagaucgacaaagaaagcaaagacuuccaagucaaacagcgcgaggaggucaagaaagaauuggaggaccucgucgaccuauucgcaaaauccguggacaacaaaaucgacaaggccagauggaagcgcgagcugaacaaccuccuggacaagaaaguacgcaaaauccguuucgauaaccgauucauacucaaaugcaaaauaaaaggcugcaacaagaacacccccaaaaaggaaaaaguccgggacuucgaacucaagaugguacucaacaacgcccgauccgacuaccaaauuucggacgaggaccugaacucauuccgaaacgaaguaauaaacauauuccaaaagaaagaaaaucuaaagaaaggcgaacugaagggagucaccaucgaagaccugcgcaagcaacucaacaaaacguucaacaaggccaaaaucaaaaaggguauccgcgaacagauccgguccaucguauucgagaaaaucuccggacgcucgaaauucugcaaggaacaucugaaagaguucucagaaaagccagccccaucagaccgaauuaacuacggaguuaacucagcgcgcgaacagcacgauuuccgaguacugaauuucaucgacaagaaaauuuuuaaagacaaacuaaucgaccccagcaagcuacgcuacaucacaauagaaagcccggaacccgaaaccgaaaaacuggaaaagggacagauaucugaaaagagcuucgaaacacugaaagagaagcuagcaaaagagaccgggggaaucgacaucuacacaggggaaaaacucaagaaggacuucgaaauagaacacaucuuccccagagcacgaaugggaccguccaucagagagaacgagguagccucaaaccucgaaaccaacaaagaaaaagccgaccgcacccccugggaaugguucggacaagaugaaaaacgcuggagcgaguucgaaaagcgcgucaacucccuauacuccaaaaagaaaauaagcgaaagaaaacgcgaaauccuccucaacaaaucaaaugaauaucccggccugaacccaacugaacucagccgcauccccagcacacugucagacuucguggaaagcauaaggaaaauguucgugaaauacggauacgaggaaccgcaaacgcucguccagaaaggaaaaccaaucauccaggugguccgcggccgcgacacccaggcguugcgcuggcgcuggcacgcacuagacagcaacauaaucccagagaaggaccgaaaaucauccuuuaaccacgccgaggacgcugugaucgcugcaugcaugcccccauacuaccugagacagaagaucuucagagaagaagccaagaucaaacgcaagguaagcaacaaagaaaaggaggucaccaggccagacaugccaacgaagaaaaucgcccccaacuggagcgaguucaugaaaacucgaaacgaaccagucaucgaagucauaggcaaagucaaacccagcuggaaaaacagcauaauggaccagacuuucuacaaauaccuccuaaaaccauucaaagacaaccucaucaaaauacccaacgucaaaaacaccuacaaauggaucggggucaauggacaaaccgauagccuuagccuccccagcaaaguccuuaguauaucgaacaaaaaggucgacucaaguaccguccuccuaguccacgacaaaaagggaggcaagaggaacugggugccaaagagcaucggaggccuccugguuuacaucaccccgaaggacggcccaaaacgaauagugcaaguaaaaccggcaacccaagggcuccucauauaccgaaacgaagacgggcgaguagacgccguaagggaguucaucaaccccguaauagaaauguacaacaacggaaaacuugcguucguggagaaagaaaacgaagaagaacuacugaaguacuucaaccugcucgaaaaaggccaaaaauucgagcgcauacgccgcuacgacaugauaaccuacaacagcaaauucuacuacgucacaaaaaucaacaaaaaccaccgcgucaccauccaggaagaauccaaaauaaaggcggagagcgacaaagucaaaucgagcagcggcaaggaauacacccgcaaggagaccgaggaacucagccugcaaaagcucgccgagcuaaucucgauauag

SEQ ID NO: 11711 - RNA, 2850 nt, Artificial Sequence
  ARMAN Cas9 variant__Candidatus Micrarchaeum sp.__OJT94500.1__Cas9
augcgagacuccaucaccgccccacgguacagcagcgcgcuagccgcccgcauaaaagaguucaacagugcauucaagcuaggcauagaccucggaaccaaaacagggggaguagcucucgucaaagacaacaaaguccuauuagccaagacguuccucgacuaccacaaacaaaccuuagaagaacgucggauucaccgccgcaaccgacgcucucgccucgcccgccgaaagcgaauagccagacucagauccuggauacuuagacaaaagauauacggcaagcaacuucccgacccauauaaaauaaagaaaaugcaauuacccaacggcguccgcaaaggcgaaaacuggaucgaucuggucguaaguggccgagaccucagccccgaagccuucgugcgcgcgaucacacucaucuuucaaaaacgaggccaaagauacgaagaagucgcuaaagagaucgaagaaauguccuacaaagaauuuuccacacacaucaaagcccuaacaucaguaacagaagaagaguucacggcgcucgcggcagagauagagcgaagacaggauguaguugacacagauaaagaagcagaacgauacacacaguuaagcgaacuacugaguaaagugucagaaucaaaaucagaguccaaggaccgcgcucaaagaaaagaagaucuagggaaaguaguaaaugccuucugcagcgcgcaccggaucgaggacaaagauaaauggugcaaagaacuaaugaagcuacucgaccgacccguuagacacgcccgcuuccucaauaaagugcuaauccgaugcaacaucugugaccgcgcaacgccgaagaaaucaagaccagacgugagagaacuacucuacuucgacacaguacgcaauuuccugaaagcaggccgagucgagcaaaaccccgacgugauaagcuacuacaagaaaauuuacauggacgccgaaguaaucagggucaaaauccucaacaaagaaaaacucacagacgaagacaagaaacaaaaacggaaacuagccucugagcuuaauagguacaaaaacaaagaauacgucacagacgcccagaaaaagaugcaagaacagcuaaaaacacuccuauucaugaagcucaccgggagaucaagauacugcauggcacaccugaaagaacgcgccgcaggcaaagacguagaagaaggccugcacggaguuguacaaaaacggcacgaccgaaacaucgcacaacgaaaucacgaccuccgcgucaucaaccucaucgagucccugcuauucgacccaaacaaaucccugucagacgccaucagaaagaacggauuaauguacgucaccaucgaagcacccgaaccaaagaccaagcacgccaagaaaggcgcagcaguaguacgagacccacgaaaacuaaaagaaaaacuauucgacgaccaaaaugguguaugcaucuacacuggacuacaacuggacaaacucgaaaucagcaaauacgaaaaggaccacauuuuccccgauagcagagacggacccucgauccgagauaaccuaguacucaccacuaaagaaaucaacucggauaaaggagaccgaacaccgugggaauggaugcacgacaaccccgaaaaguggaaagcguucgaacgccgcguagccgaguucuauaagaaaggccgcaucaaugaaagaaaacgugaacuccuacucaacaaggggaccgaauacccgggggauaacccaaccgagcucgcgcgaggcggugcacgaguaaacaacuucauaacugaguucaacgacagacucaaaacacacggaguacaggaacuacaaaccauauucgaacggaauaaacccaucguacaagucguacgcggagaagaaacacaacgccuccgacgacaauggaacgcccucaaccagaauuucaucccccugaaagaccgagcaaugagcuucaaccacgcagaagacgcagccauagcagccucaaugcccccaaaauucuggcgggaacagauauaccgcaccgcuuggcacuuuggucccucaggcaacgaacgccccgacuucgcacucgcagaacuugccccgcaguggaacgacuucuucaugacaaaaggcggcccuauaauagcaguccucggaaaaacaaaguacuccuggaagcacagcaucauagacgacacaaucuauaaacccuucuccaaauccgcauacuacgugggcaucuacaagaaacccaacgccaucacaucuaacgccaucaaaguccuccggccgaaacuacucaacggagagcacacgaugagcaaaaacgccaaauacuaccaccagaaaaucgguaacgaacgcuuccuaaugaaaucacaaaaaggaggguccauaaucaccgucaaaccccacgacggccccgagaaaguccuacaaauaagcccgacauacgaaugcgccgugcucacaaaacacgacggaaaaauaaucgugaaauuuaagcccaucaagccccuccgagacauguacgcacgcggcgucauaaaggcgauggacaaagaacuggaaaccagccuauccuccauguccaagcacgcaaaguacaaagaacuacacacccacgacauaauauaccucccagccacaaagaaacacgucgacggguacuucaucaucaccaaacucagcgcgaaacacggaaucaaagcccuacccgaauccauggugaaggucaaauacacgcaaaucggcuccgaaaacaacucggagguaaaacucaccaagcccaagcccgaaaucacccucgacucugaagacaucacaaacauauacaacuucacgcgguaa

SEQ ID NO: 11712 - RNA, 2961 nt, Artificial Sequence
  CasX variant__Deltaproteobacteria bacterium__OGP07438.1__CasX
auggaaaaacgcaucaacaaaaucagaaagaaacucagcgccgacaacgcaaccaaaccagugucaagaagcggacccaugaaaacgcuccuaguccgaguaaugaccgacgaccucaagaaaagacuagaaaaacgccgaaagaaaccagaaguaaugccccagguuaucuccaacaacgccgccaacaaccuaaggaugcuccuagacgacuacacuaaaaugaaagaggcaauccuccaggucuacuggcaagaguucaaagacgaccacgucggacuaaugugcaaauucgcacaaccggccagcaagaaaauagaucaaaacaaacuaaaacccgaaauggacgaaaaaggaaaccuuaccacagcaggguucgcaugcucacaaugcggccaaccacuauucguguacaaacucgagcaaguauccgaaaaagggaaagcguacacaaacuacuucggucgaugcaacguggcagaacacgagaaacugauacugcucgcgcaacucaaacccgaaaaggacagcgacgaagccgugacguacagccuagggaaauucgggcaacgggcccuggauuucuacagcauacacguaaccaaagaaucaacgcacccagucaagccacuagcccaaaucgcgggcaaccgauacgccucaggacccgucgggaaagcacucagcgacgccugcaugggcacgauagcgucauuccucucaaaauaccaagacaucaucaucgaacaccagaaaguaguaaaaggcaaccaaaaacgacuagagagccuacgggaacuggccggaaaagagaaccuagaauacccaagcguaacgcucccaccacagccccacaccaaagagggagucgacgccuacaacgaggucauagcccgcguccgaaugugggucaaccuaaaccucuggcaaaagcucaagcucucccgcgacgacgcgaagccacuauuacgccuaaaaggcuucccguccuuccccguaguagagagacgcgaaaaugagguugacugguggaacaccauaaaugaaguaaagaaacucauagacgccaaacgcgacaugggaagggucuuuuggagcggggucacggcagaaaaacgcaacaccauacuagaaggcuacaacuaucuaccaaacgaaaacgaccacaagaagagagaagggucacuggaaaacccaaagaaaccugccaaaagacaauuuggagaccuacuacuuuaccuggaaaagaaauacgcgggcgacuggggcaaaguguucgacgaagccugggagcgcauugacaagaaaaucgcagggcuuaccucacacaucgaaagggaggaggccagaaacgcggaggacgcucaaucaaaagccguccucaccgacuggcugcgugcgaaagcaaguuucguacucgaaagacuaaaagaaauggacgagaaagaguucuacgccugcgaaauacaacuccagaaaugguacggcgaccuacgggggaaccccuucgcgguagaagcagaaaaccgaguaguagacauaagcggguucaguauaggcucggacggacacucgauacaauaccgaaaccugcucgccuggaaguacuuagaaaauggcaaacgcgaguucuaccuacucaugaacuacgggaagaagggccgaaucagguucacggacgggaccgacaucaaaaagagcggaaaguggcaaggacuccuauauggaggaggcaaagccaaagugauagaccuaacauuugacccggacgacgagcaacucauaauccucccacuagcauucgggacacgacaagguagagaguucauauggaacgaccuacucucacuggaaacaggacuuauaaaacuagcaaacggaagagucaucgagaaaaccaucuauaauaagaaaauuggccgugacgaacccgcccuuuucgucgcgcuaacuuucgaaaggcgcgaagucguggaucccucaaacaucaaaccagugaaccugauaggcgucgaccgcggagaaaacauacccgccguuauagcucuaaccgaccccgagggcugccccuuaccagaguucaaagacuccuccggaggcccaacggacauccugagaauaggagagggcuacaaagagaaacaacgcgcaauacaggccgccaaagaagucgaacaacgacgcgcgggaggauacucccgcaaauucgcaagcaaaagccggaaccucgcggacgacaugguacgcaacagcgcacgggaccuguucuaccacgccguaacacacgacgccgugcucgucuucgaaaaccucagucguggauucgggcggcaaggaaagaggacauucaugacagaacggcaauauaccaagauggaagacuggcugacugccaaacucgcguaugagggccucaccucaaaaaccuaccuaaguaagacacucgcacaauacacaucaaagacaugcuccaacugcggauucacgaucaccaccgccgacuacgacggaaugcugguaagacucaaaaagaccuccgacggaugggcgacgacacuaaacaacaaggaacugaaagcagagggacagauaaccuacuacaaccgauacaagcgacaaacaguagaaaaagaacuuucggccgaacuagaucgacuguccgaggaauccggaaacaacgacaucagcaaauggacaaaaggacgccgagacgaagcacucuuccugcucaagaaaagauuuucccaccgcccuguccaagagcaguucgucugccucgacugcggacacgagguacacgcagacgaacaagcggcccugaacauagcgcgcaguuggcuguuccugaacagcaacagcacagaguucaagucauacaagagcggaaaacaaccauucgugggcgcguggcaggcauucuacaaacgaagacuaaaagaagucuggaaaccgaacgccuaa

SEQ ID NO: 11713 - RNA, 2937 nt, Artificial Sequence
  CasX variant__Planctomycetes bacterium__OHB99618.1__CasX
augcaagagaucaaacgcauaaacaaaaucaggcgucgccuagucaaagacuccaacaccaagaaagcaggcaaaaccgggcccaugaaaacccuccuaguacgaguaaugacccccgaccuacgagaaaggcuagaaaaccuacgcaagaaacccgagaacaucccccaacccauaucaaauacgagccgagccaaccucaacaaacuccucacugauuacaccgaaaugaagaaagccauccuccaugucuacugggaagaguuccaaaaagacccagugggccucaugagccgcguggcccagccagcgcccaagaacaucgaucaacggaagcucaucccagucaaagacggcaacgaacgccuaaccagcuccggguucgcgugcagccaaugcugccagccacuauacguauacaaacucgagcaggucaacgauaagggcaagccacacaccaauuacuucggccgcugcaacgucagcgaacacgaacgccuaauccuccugagcccccacaaaccagaagcaaacgacgaacucguuaccuauagccugggcaaauucggacaacgagcgcuagauuucuauucuauacaugucaccagagaaagcaaccaccccgugaaaccacucgaacaaaucggaggaaacuccugcgcuucagggccggucggcaaagcacucuccgaugccugcaugggcgcagucgccucauuucucaccaaauaccaggacauaauacuggaacaccaaaaagucauaaagaaaaacgaaaaacgccuagcgaaccucaaagacauagcuagcgcaaacggccucgccuuccccaaaauaacacugcccccacaaccacacaccaaagaaggcaucgaggccuauaacaauguaguggcacagauagucauaugggugaauuuaaaccuuuggcaaaaacucaaaaucggccgcgacgaagcgaaaccccuccaacgucuaaaaggcuuccccuccuuuccccuagucgaacggcaagcaaacgaagucgacuggugggacauggugugcaacgugaagaaauuaaucaacgaaaagaaagaagaugggaaaguauuuuggcaaaaccuagcaggauacaaacgccaagaagcccuguuaccuuaccuaucauccgaggaggaccgcaagaaaggcaagaaauuugcgcgcuaccaauucggagaccugcugcuucaccuagaaaagaaacacggcgaagacuggggcaaagucuacgacgaagcaugggaacgcauugacaagaaaguagagggauuaucaaaacacaucaaacucgaagaggaacgcagaagcgaagacgcacaaucaaaagcagcacucaccgacuggcuacgggccaaagccagcuucgucaucgagggccuaaaagaggccgacaaagacgaguucugucguugcgaauugaaacuacagaaaugguacggcgaccuccgaggcaaaccuuucgcgaucgaagccgaaaacagcauccucgacauaagcggauucuccaaacaauacaacugcgcauucauauggcagaaagacggagucaagaaacuaaaccucuaucucauaaucaauuacuucaaaggaggcaaacuccguuucaaaaagaucaaaccggaagccuucgaagccaacagauucuacaccguaaucaacaagaaaaguggggaaauugucccgauggagguaaacuucaacuucgacgaccccaaccucauaauacucccucucgcguucgggaaacgccaggggcgagaguucauauggaacgaccugcucucacucgagaccggcagccuaaaacucgcgaacggccgugucaucgagaaaacacucuacaaccgaagaaccagacaggacgaaccagcccucuucgucgcacugacauucgaacgacgcgaaguccuagacucaucaaacaucaaaccaaugaaccucauuggcaucgaccggggagaaaacauccccgccgucaucgcucuaacagaccccgaaggcugcccauuaagcagauucaaagacagcuuagggaauccuacucacauacuacgaaucggagaaagcuacaaagaaaagcaacgaacgauucaggcagcaaaagaaguagaacagcgcagagccggaggcuacagcagaaaauacgcaaguaaagcgaaaaaccucgcagacgacaugguaagaaacaccgcacgagaccuccucuacuaugccguaacccaggacgccauguugaucuucgaaaaccuaucgcgcggauucggacgacaggguaaacgcacguucauggcagaacgccaguacacacgcauggaagacuggcuaacugccaaacuagccuacgaaggacuacccagcaaaacguaccuaagcaagacccuagcccaauacaccucaaagacaugcucaaacugcggcuuuaccaucaccagcgccgauuacgaccgcguacucgagaaguuaaagaaaacggccaccgguuggaugaccacaauaaaugguaaagagcucaaagucgagggccaaaucaccuacuacaaccgguacaaaaggcaaaacgucgugaaagaccucagcguggagcuagaccgccugagcgaagagagcguaaacaacgacauaucaagcuggaccaagggccggucaggcgaagcccucagccuccugaagaaacgcuucucccaccgcccgguacaagaaaaauucgucugccugaauuguggguucgaaacccacgccgacgaacaggccgcccuuaacauagcccgcagcuggcuauuccuccguucccaagaauacaagaaauaccagacaaacaaaacaacgggcaacacagacaaacgcgccuucguagaaacauggcaaucauucuaucguaagaaacucaaggaagucuggaaacccgcgguauga

SEQ ID NO: 11714 - RNA, 3378 nt, Artificial Sequence
  CasY variant__Candidatus Katanobacteria bacterium__OJI08769.1__CasY
augagaaagaaacuauucaaaggauacauacugcacaacaagaggcuaguguacaccggaaaagcagccauacgcucgaucaaauacccccugguugccccgaacaaaaccgcccucaauaaccuuucagagaaaauaaucuacgauuacgaacaccucuucggaccccucaacguggccucauacgcccguaacagcaaccgcuacucgcuugucgacuucuggauagacucccuccgcgcaggcgucaucuggcaaagcaaguccacaagccucauagaccucaucucaaagcuggaaggcucaaaaucaccguccgaaaagauauucgaacaaaucgacuucgaacucaaaaacaaauuagacaaagaacaguucaaagacauaauccuacuaaacacuggcauccgcuccuccaguaacguccgcucccugcguggccgcuuccugaaaugcuuuaaggaagaguuccgggauacagaagaagucaucgcguguguggacaaaugguccaaagaucucaucguggaaggcaaauccauccucgucuccaagcaauuucuuuacugggaggaagaguucggaaucaaaauauucccccacuucaaagacaaccacgaccucccgaagcugacauucuucguagaaccaagccuugaauuuagcccacaccuaccacuugccaacugucuugaacgacucaagaaauucgacauaagccgagagucccuccucggacucgacaacaacuuuagcgcguucagcaacuacuucaacgaacuguucaaccuacuaagccgcggagaaaucaagaaaaucgucacagccguccucgcagucuccaagucaugggagaacgaaccugaacucgaaaagcggcugcacuuccucuccgagaaagcgaaacuccuaggauacccaaagcucaccucuucaugggcagacuaccgaaugauaaucggcggaaaaaucaaaagcuggcauucgaacuacaccgaacaacuaaucaagguccgagaagaccuaaagaaacaccagauagcccuggacaaacuccaggaagaccuuaagaaaguaguagacagcagccuccgcgaacagaucgaagcccagcgcgaagcccuccucccacuccuggacaccaugcucaaagaaaaggacuucucagacgaccuagaacuauaccgcuucauuuugucagacuucaaaucucuccucaacggaucguaucaacgcuacauacaaacggaagaagaacgaaaagaggaucgagaugucaccaaaaaguacaaggaccucuauagcaaccuccgcaacaucccgcgcuucuucggcgaaagcaagaaagaacaguucaacaaauucauaaacaagagcuugccgaccaucgacgucggccugaaaauccucgaagacauccgcaaugcgcuagaaacgguaucaguaagaaaacccccaucgaucaccgaggaguacguaaccaaacaacucgagaaacuuucacgcaaauacaaaaucaacgcguucaauuccaaccgcuucaaacagaucaccgaacaaguccuacgaaaguacaauaacggcgaacuucccaaaaucagugaggucuucuacagauacccacgcgagucgcauguugccauacgcauacuaccuguuaaaaucagcaacccacggaaagacaucuccuaccugcucgacaaguaccagaucucgcccgauuggaaaaacaguaaccccggugaagucguagaccucaucgagaucuauaaacuaacgcugggguggcuccucagcuguaacaaagacuucucaauggauuuuagcagcuaugaccuaaaacuguucccagaggcggcgaguuugauaaagaacuucggguccugccugucaggguacuaccugaguaaaaugauauucaauugcaucaccagcgaaauuaaaggaaugaucacccucuacacgcgggacaaguucguagucagguacgucacacagaugauaggcucaaaccaaaaguucccgcuacuaugccucgucggcgaaaaacaaaccaaaaauuucucccgcaauuggggcguacuaaucgaagagaaaggagaccucggagaagagaaaaaccaagaaaagugucuaaucuucaaggacaagaccgacuucgccaaagcaaaagaagucgaaauauucaaaaacaacaucuggagaauccguaccuccaaguaccaaauucaauuccucaacagacucuucaagaaaacaaaagagugggaccucaugaaucugguccucucagaaccaagccuaguccuugaggaggaguggggcgugagcugggacaaagacaaacuccugccgcuccucaagaaggagaaaucaugcgaagaaagacucuacuauucguuaccgcucaaccuggucccugccaccgacuacaaagagcagucagccgagauagagcaacguaacacauaccuaggccuggacgucggugaguucggugucgccuacgcggucguccggauagugcgagaucgaaucgagcuacuaucauggggcuuccucaaagacccagccuuaagaaaaauccgcgagcgcguccaggacaugaagaagaagcaagucauggccguauucagcuccuccagcacggcggucgcccgcguccgcgaaauggccauacacagccucagaaaccaaauccauagcauugcccucgccuacaaagcaaagauaaucuacgagaucagcauuagcaacuucgaaaccggcgguaaccgcauggcaaagauuuacaggucaauaaaaguuuccgacgucuaccgcgagagcggcgccgacacauuagucagcgagaugaucuggggaaagaaaaacaaacaaauggggaaccacaucagcagcuacgcaaccuccuauaccugcugcaacugcgcccgcaccccguucgagcuaguuaucgacaacgacaaagaauacgagaagggaggcgacgaauuuaucuucaacgucggggacgaaaagaaaguacgcggcuuccugcagaaauccuuacucgguaagaccaucaagggcaaagaaguacuaaaaucaauaaaagaauacgcccguccgccaauacgagaaguccuccucgagggagaagacgucgaacaacuccuaaaacgacgggguaacucauacauauaccgaugccccuucugcgguuacaagacggacgccgacauccaagcagcucugaacauugccugucgaggauacaucagcgacaacgcaaaggacgccguaaaagagggggagcggaagcuggacuacauacuggaaguccgaaaacucugggagaaaaacggagccguccugcgcuccgccaaauuccucuaa

SEQ ID NO: 11715 - RNA, 3864 nt, Artificial Sequence
  CasY variant__Candidatus Kerfeldbacteria bacterium__OGY82221.1__CasY
augaaacgaaucuuaaacagucucaaagucgcggcacuacgccuacuuuuccggggaaaagguagcgaacucgucaagacagucaaauacccacucgucaguccaguccagggcgcagucgaggaguuggcugaagcgauccgccaugacaacuuacaccuguucggccagaaagaaauaguagacuugauggagaaagacgaggggacucaggucuacucuguagucgauuucugguuagacacccuacggcuugggauguucuucagccccagcgcaaacgcgcuaaaaauaacccuuggcaaguucaacucagaccaaguaucacccuuccgcaaagugcucgaacagucuccauucuuucucgcgggcagguuaaaaguagagcccgccgaacgaauccuaucaguggaaauaagaaaaaucggaaaacgagaaaaccgggucgaaaacuacgcagcagauguagaaacauguuucaucggccagcugagcagcgacgaaaaacaaucuauacagaaacuugccaacgauauaugggauagcaaagaucacgaggaacaaaggaugcucaaagccgacuucuucgcaaucccccucauaaaggaccccaaagccgucacagaagaagacccagagaacgaaacagcaggaaagcagaagcccuuagaacuaugcgucugccuaguucccgaacuguauacccgcggauucggguccaucgcggacuuccuggugcagcgucugacccuacuccgagacaaaaugagcacagacaccgcagaagacugccuggaauacguaggcaucgaggaagaaaaaggcaacggaaugaacagccugcuaggcacauuccucaaaaaccuacaaggagacggauucgaacaaauuuuucaguucaugcucggcaguuacgucggcuggcagggaaaagaagacguacuccgggaacggcuagaccuacucgcagaaaaagucaaacgacucccaaaaccuaaauucgcgggagaauggagcggccaccggauguuccuccacggucaacuaaaauccugguccuccaacuucuucagauuguucaacgagacacgagaacugcuagaauccauuaagagcgacauacagcacgcgaccaugcucauuuccuaugucgaagaaaaaggcggguaucacccccaacugcuaagccaauacagaaaacuaauggagcaauuacccgcccuacgaaccaagguccuagaccccgagaucgaaaugacccauaugucagaagccguccgcagcuacauaaugauucacaagagcguagccggguuccuccccgaccuccucgaaucccuggaucgcgacaaagacagagaguuccuacuaagcaucuucccccgcauacccaagaucgacaagaaaacuaaagaaaucguagcgugggaacuccccggcgagcccgaggaaggauaucucuucacugcuaacaaccucuuccgcaacuuccucgagaacccaaagcacgucccccgcuucauggcagaacgaaucccggaagacuggacacgacuccgaagcgccccagucugguucgacggaauggugaaacaguggcaaaaaguggugaaccagcucgucgaaucgcccggggcacuauaccaauucaacgaaucauucuuacgacaacgcuuacaggcgaugcuaaccgucuacaaacgcgaccuucagaccgaaaaguuuuuaaaacuccuggccgacgucugccgaccgcuaguagacuuuuucggguuaggggguaacgacaucaucuucaaauccugccaagacccgcguaaacaauggcaaacagugaucccucugagcgucccggcagacgucuacaccgcgugcgaaggacucgcaauacgucuacgcgaaacauugggguucgaguggaagaaccuaaaaggccacgaacgagaagacuucuuacgccuccaccaacuccucggaaaccuccuuuucuggauacgcgacgccaagcucguggucaaacucgaagacuggaugaauaacccguguguacaagaauacguagaagcucgaaaggccauagaccucccccuagagauuuuuggauuugaaguaccgauauuccugaauggauaccucuucucagagcuaaggcaacucgaacuacuucuaagacgaaaauccguaaugacaucguacuccgucaaaaccacaggauccccgaaccgccuauuccagcuaguauaccucccacugaacccuuccgaccccgagaagaaaaauucaaauaacuuccaagaacgccuagacacaccaacaggacucucccgaagguuccuggaccuaacgcucgacgccuucgccggcaagcugcugacugaccccgugacucaagaauugaaaacaauggcuggcuucuacgaucaccuauuuggauucaaacuacccuguaaacuagcagcaaugagcaaccaccccggcuccagcucaaaaauggucguucucgcgaagcccaagaaaggagucgccucaaacauaggauucgagcccauccccgacccggcacaccccguauucagaguccggagcagcuggccggaguuaaaauaucucgaagggcuacucuaccuccccgaagacaccccacucacgauagagcuagcugaaacauccgucagcugccaaucagucagcuccguggccuucgaccucaaaaauuuaaccacaauccucgggcgcgucggagaguuccgaguaaccgcggaccagccuuucaaacuaaccccgauaauaccagaaaaagaagagagcuucaucgggaagaccuaccucggccuagacgccggagaacgcaguggagucggcuucgccaucguaaccgucgacggugacgguuacgaaguacaacgucuugggguucacgaagauacccaauugauggcucuccagcaaguagccagcaaaucauuaaaagaacccguauuucaaccgcuccgcaagggaaccuuccgacaacaggagaggauccggaaaucccuccgaggaugcuacuggaacuuuuaccacgcacuaaugauaaaauaucgcgcgaaaguugugcaugaagagagcguaggaucgucgggccucguagggcaguggcuccgcgcauuccaaaaagaccuaaagaaagcagacguccucccgaagaaaggagggaaaaacgggguagacaaaaagaaacgggaaaguagcgcccaagacacgcucuggggcggcgcguucuccaagaaagaagaacaacaaauagccuucgagguacaagcugcaggcuccagucaauucugcuuaaaaugcggcuggugguuccaacucggcaugcgcgaagugaaucgcgugcaagaaagugggguggugcuagauuggaaucguuccauugucacguuccucauagaaagcuccggggaaaaaguauacggcuucuccccacaacaacuagaaaaaggauucagacccgacauagaaacguucaagaaaaugguaagagauuucaugcgcccacccauguuugacaggaaaggacgcccggcggccgcauacgagcgauuuguccuuggccguaggcaccgacgauacagguucgacaaagucuucgaggaacguuucggacgcuccgcacucuucauaugcccucgcgugggcuguggaaacuucgaccacagcuccgaacagucagcggugguccuggcacuaaucggauacaucgcugacaaagaagggauguccggcaagaaacucguguacguucgucuugcagaacuaauggccgaauggaaacuaaagaaacuggaacgauccagaguagaggaacaaagcuccgcccaguaa

SEQ ID NO: 11716 - RNA, 3579 nt, Artificial Sequence
  CasY variant__Candidatus Komeilibacteria bacterium__OJI06454.1__CasY
auggcagagagcaaacaaaugcaaugccgaaaaugcggggccagcaugaaauacgaagucauaggacucggcaagaaaucaugccgauauaugugcccggacugcgggaaucacacaagcgcgcgcaaaauacaaaacaaaaagaaacgggacaagaaauacggcuccgccagcaaagcgcaaucacaacgcaucgccguugccggagcccucuaccccgacaagaaagugcagacaauaaaaaccuacaaauacccagcggaccugaacggagaaguacacgaccgagggguagcagagaaaauagaacaagcuauccaagaagacgagauaggccuguuaggacccagcagugaauacgcgugcuggauagcgagccagaaacaguccgagccguacucagugguagacuucugguucgacgccgucugcgcgggcggagucuucgccuacucgggagcccgacuccucagcacaguacuacaacucucgggagaagaaagcguacuaagagcagcgcuagcaucaagccccuucgucgacgacaucaaccuggcgcaggcagaaaaauuccuggcaguauccagacgaaccggacaagacaaacuaggcaaacgcauaggcgagugcuucgccgaaggccgacuggaagcauuaggcauaaaagaccggaugcgcgaguucguccaagcaaucgacguagcccaaacggccggacagagauucgcagcaaagcucaaaaucuucggaaucagccagaugccagaggccaagcaauggaacaacgauagcgggcuaaccguuuguauacucccggacuauuacgugcccgaagaaaaccgcgcagaccaacucgucguccuacugcgccggcucagagagauagccuacugcaugggaauagaggaugaagcgggauucgaacacuuaggaaucgacccaggcgcgcuuucaaacuucagcaacgggaacccaaagaggggauucuuagggcgacuacucaacaaugacauaauagccuuagcaaacaacaugagcgcgaugacacccuacugggaagggcgaaaaggagagcucaucgaacgacuugcauggcuaaaacaccgagcggagggccuauacuuaaaagaaccacacuucggaaauucaugggcagaucaucgcagccgcaucuucagcaggauagccggcuggcugucaggcugcgcaggaaaacucaaaauagcaaaagaccaaauaagcgggguacggacagaucuguuccuacugaaaaggcuacuagacgccguuccccaguccgcucccucaccagauuucaucgcaucuauaagugcacuggaccgguuccucgaagccgcagaaagcucgcaggaccccgcagagcagguccgagcgcucuaugcauuccaccuaaacgccccugcaguccgcucaauagccaacaaagcgguacaaagaucagacagccaagaauggcuaaucaaggaacuggacgcgguagaccaccuagaguucaauaaagccuuuccguucuuuucagacaccgggaaaaagaaaaagaaaggcgcaaacuccaacggcgcacccagcgaagaagaauacaccgaaaccgaaagcauccaacaaccagaagacgccgaacaagaagucaacggucaggaagggaacggugcaagcaaaaaccaaaagaaauuucaaaggauuccgcgguucuucggagagggaucacgguccgaguaccgcauucuaacagaagcgccgcaauauuuugacauguucuguaacaacaugagagcaauauucaugcaacuggaaagccaaccccggaaagcuccacgagacuucaaaugcuuccuccaaaacagacuccagaagcuguacaaacaaacauuccuuaacgcccggucgaacaaaugcagagcucuccuggaaagcgugcuuaucagcuggggagaguucuacacauacggggccaacgaaaagaaauucaggcuaaggcacgaagccucagaacgaaguagugacccagacuacguggugcaacaagcgcuggaaauugcccgcagacuauucuuauucggauucgaauggcgugacugcucagcaggcgaaagggucgaucucguagagauacacaagaaagcgaucagcuuccuacucgcgauaacgcaagccgaagugucagugggcucauacaacuggcuaggcaauucaacagucucaagguaucuaucgguagcaggcacggauacccucuacgggacgcaacuggaagaguucuuaaacgccacaguccucucucaaaugcgggggcuagcgauacgacucagcucgcaggaacuaaaagacggcuucgacguucagcucgaaucauccugccaagacaaccuacaacaccucuugguguaccgcgcaucacgagaccuagcggcaugcaaaagagcgacaugcccagccgaacucgacccaaaaauacucguucuaccagcaggcgcauucauagccagcgucaugaaaaugauagaaagaggagaugagccacuugccggagcauaucugcgccaccgaccccacucauucggguggcagaucaggguccgcggaguagccgagguaggaauggaccaaggcaccgcucuggcauuccaaaaaccgacggagagcgagccauucaaaaucaaaccauucuccgcgcaauacgguccgguacuauggcuaaacagcagcaguuacagccagagccaauaucucgacggcuuucucucucagcccaaaaacuggagcaugcgaguacuaccacaagcaggauccguacgagucgaacaacgagucgcacucauauggaaucugcaagcaggcaaaaugcgacucgaaaggucgggcgccagagcauucuucaugccaguaccauucagcuuccgccccucgggcucgggagacgaagccguccucgcacccaacagauaccuaggacucuucccacacagcggaggaauagaauacgcuguuguagacgugcuagacagcgcaggguucaaaauucuagagagaggcacaaucgcagucaacggauucucccaaaaacgaggcgaacgacaagaagaagcacaucgcgagaaacaaagacgcggcauaucagacaucggacgaaagaaacccguccaggccgagguagacgccgcaaacgagcugcaccgcaaauacaccgacguagccacucgccuaggaugccgaauagucguacaaugggcuccacaaccgaaaccuggaacagcuccuaccgcacaaaccguguaugcacgagccguaagaacagaagccccacggagcggcaaccaggaggaccacgcacgcaugaaaucuucauggggcuacacauggucaaccuacugggaaaaacguaaacccgaggacauccugggcauuuccacacaaguauacuggacgggaggaaucggagaaagcuguccagccguagccguugcccuccucggccacaucagagccacaucaacacaaaccgaaugggagaaagaagaagucgucuucggccgccucaaaaaguucuucccaucauga

SEQ ID NO: 11717 - RNA, 3633 nt, Artificial Sequence
  CasY variant__Candidatus Parcubacteria bacterium__APG80656.1__CasY
augagcaaaaggcacccccgcauuuccggagugaagggcuaccgacuacacgcccaacggcuugaauacaccggcaaaagcggcgcaaugcgcaccaucaaauacccacuguacagcucccccaguggcggccggacagucccucgcgagauaguguccgccauuaacgacgacuacgugggauuguacggacuaucgaacuucgacgaccuauacaacgcagaaaagcgcaacgaagagaaaguauacucaguccuugacuucugguacgauuguguacaauauggcgcaguauucuccuacaccgcccccggacuccuuaagaacguagcugaaguacgaggcggcagcuacgaacucaccaaaacauuaaagggaucccaccucuaugacgaacuucagaucgacaaggugaucaaauuccuaaacaagaaagaaauaagccgcgccaacggcuccuuagacaaacugaagaaagacaucaucgauuguuucaaagccgaguaccgcgagcgccacaaagaccaaugcaacaaauuagcggacgacaucaaaaacgcaaagaaagacgccggcgccagccucggugagcggcaaaagaaacuguuccgugauuucuucgggauaucggaacagagcgagaacgacaaacccagcuucaccaauccacuuaacuuaacaugcugccuacuuccauucgacacaguaaacaacaacagaaacagaggcgaaguauuauucaacaagcuaaaggaauacgcccaaaaacuagacaaaaacgaaggcagccuugaaaugugggaguacauuggcauuggcaacagcgggaccgcauuuuccaacuuccuaggcgagggauuccuggggcgucuaagagaaaacaaaaucacugagcugaagaaagccaugauggacaucaccgacgcguggcgaggacaagagcaagaggaggaacuggaaaaacgacuacgcauccucgccgcccuaaccaucaaauuaagagaacccaaauucgacaaccacuggggcggauaccguucagacauaaacggcaaacuaagcuccuggcuccagaacuauauaaaccaaaccgucaagaucaaggaagaccuaaagggccacaagaaagaccugaagaaagccaaagaaaugaucaaccgcuucggcgaguccgacaccaaagaagaggccgucguaucaagccugcuggaaucaaucgagaagaucguccccgacgacucugcugacgacgagaagccggacauaccagccaucgcgauauauagaagauuccuaagcgacggccgacucacacucaaccgcuuuguacaacgggaggacguacaagaagccuuaaucaaggaaagacuagaggcugaaaagaaaaagaaacccaaaaagcgcaaaaagaaaucagacgccgaagacgaaaaagagacuauugacuucaaagaacuauuuccacaucucgcgaaaccccucaaauugguuccaaacuucuacggagacagcaaacgcgagcuauacaaaaaguacaaaaacgcagcuauuuacacagaugcccuauggaaggcagucgagaaaaucuacaaaucagccuuuucaagcagccucaaaaacagcuucuucgauacagacuucgacaaggacuucuucauuaaaagacuacagaaaaucuucagugucuaccgacgcuucaauaccgacaaauggaaacccauagucaaaaacuccuuugcucccuacugugacauaguuucccuagccgaaaaugaaguucuauacaaaccaaaacaaucgcgcucacgcaaaucagcugccaucgacaagaaccgcgugcgacuucccuccacugaaaauaucgcaaaagccggaaucgcccuagcacgcgaacuauccguggccggauucgacuggaaagaccuacuaaagaaagaagaacacgaggaauacauugaccucaucgagcuccauaagaccgcacuagcacuccuauuagcggucacggagacccaacuagauaucuccgcccuagacuucguggaaaaugggacggugaaggacuucaugaagacccgcgacggcaaccucguacucgaaggccgcuuccucgagauguucagccaauccauaguauucagcgaacuaaggggccuagcaggcuuaaugucccgaaaagaguucauaacacgaucagccauacaaaccaugaaugggaagcaagcagaacuccuauauaucccacacgaguuccaaagugccaagaucacaacuccuaaagaaaugagccgggccuuccucgaccuagcucccgcggaauuugcgacuagccucgaacccgaaucgcucagcgaaaaaucucuacuaaaacugaagcaaaugcgcuacuacccccacuacuucggcuacgaacucacccggaccggccaagggauugacgggggcgucgccgaaaaugcccuccgacucgaaaagucgcccguuaaaaagcgcgaaauaaagugcaaacaauacaaaacacuaggucgcggacaaaacaaaauaguauuauacguacgcaguucauauuaucagacccaguuccuagaaugguuccuccacagaccgaaaaacguacaaaccgacgucgccgucagcggguccuuccucauagacgagaaaaaggucaaaacccgguggaacuacgaugcacucacaguagcguuagaaccaguauccggcagcgaaagaguguucgucucgcaacccuucacuauauucccugaaaagucagcagaggaagaaggacaaagauaccucggcauugacaucggggaauacggaauagccuacacagcgcuggaaauaaccggcgacuccgcaaagauccuugaccagaacuucaucucagauccacagcugaaaacccuccgggaagaaguaaaagggcucaagcuagaccaacgcagaggcacguucgccaugccgucaacaaagauagcccgaauaagagaaucacucguccacagccugcgaaaucgcauccaccaccuagcccuuaaacacaaggcaaaaaucgucuacgagcucgagguaagccguuucgaagaaggaaaacagaaaaucaagaaaguauacgcaacacucaagaaagcagacgucuacucagaaaucgacgccgacaaaaaccuccaaacaacaguauggggcaaacucgcagucgccagcgagaucucugcauccuacaccagccaguucugcggcgcaugcaagaaacucuggcgcgccgaaaugcaagucgacgagacaaucacgacccaagaacucaucggaaccgucagagucauuaaaggcggcacacugaucgacgcaaucaaagacuucaugaggcccccaauauucgacgaaaacgacacgccguuucccaaauacagagacuucugcgacaaacaccacauuagcaagaaaaugcgcgguaacagcugccuauucauuugcccguucugccgagcaaacgccgaugcggacauacaagcuagccaaaccauagcccuccucagguacgucaaagaagaaaagaaaguggaagacuacuucgaacgauuucgcaaacugaaaaacauaaagguacuaggacagaugaagaaaauauga

SEQ ID NO: 11718 - RNA, 3681 nt, Artificial Sequence
  CasY variant__Candidatus Vogelbacteria bacterium__OJI07455.1__CasY
augcagaagguccgcaaaacacucagcgaaguacauaaaaauccguacgggacaaaaguccgcaacgcaaaaacgggauacucccugcagauagaacgccucagcuacacagggaaagagggcaugcggagcuucaagauaccccuggagaacaaaaacaaagaaguuuucgacgaguucgucaaaaagauccggaaugacuauauaagccaaguaggacuauugaaccucucugacugguacgaacacuaccaagaaaaacaggagcacuacucacuagcggacuucuggcuagacucccuccgcgcaggcgucauuuucgcucacaaggaaacggaaaucaaaaaucucauauccaagaucaggggagauaagucgauaguagacaaauucaacgcaagcaucaaaaagaaacacgccgaccuguacgcccucguagacauaaaagcgcucuacgacuuccucaccuccgacgcacggaggggccuuaaaacagaggaggaguucuucaacagcaaaaggaacacccucuucccuaaauuccggaaaaaggacaacaaagcgguagaccuaugggucaagaaauucauagggcuggauaacaaagacaaacuaaacuucacgaagaaauucauaggauuugacccaaauccccaaaucaaauacgaccacaccuucuucuuucaccaagacauaaauuucgaccuugaaagaaucaccaccccaaaagaauuaaucucaaccuacaagaaauuccugggcaaaaacaaagacuuauacggcagcgacgaaacuaccgaagaccaacuaaaaaugguccucggcuuccacaacaaccacggcgcauucucuaaauacuucaaugcaucccuugaagccuuucgagggcgcgacaacagcuugguagaacagaucaucaacaacuccccauacuggaacagccaccgaaaagagcucgaaaaacggaucaucuuccuccaaguucaauccaagaaaaucaaagaaacagaacucgggaagccacacgaguaccuggcuuccuucgggggcaaguucgagagcugggucucuaacuaccuccgccaggaagaggaggucaaacgacaacuauucggguacgaggagaauaaaaaggggcaaaagaaauucaucgucggcaacaaacaggaacucgauaaaauaauccgcggaacugaugaguacgaaaucaaagcaauaucaaaagagaccauuggccuaacacaaaaaugccucaaacuacuagaacaacuaaaggacuccgucgacgacuacacccucagccucuaccgccagcuaaucguagaacuccgcauccgauuaaacgucgaguuccaggaaacguaccccgaacuaaucggcaagagcgaaaaggauaaagaaaaagacgccaaaaacaaacgagccgacaaaagguacccccagaucuucaaagauauaaaacuuauacccaacuuccucggggagacaaagcaaauggucuacaagaaguucauccgcagcgccgacauccucuaugaaggaauaaacuucaucgaccaaaucgacaagcagaucacgcagaaucucuuaccuugcuucaaaaacgacaaggagagaaucgaguucaccgaaaaacaauucgaaacacuccgccgcaaauacuaccuaaugaacagcagccgcuuccaccacguaaucgagggaauaaucaacaaccgcaaacugaucgaaaugaagaaacgagagaacucagaacucaaaacauucuccgacagcaaauucgugcucucaaaacuguuccuaaagaaaggaaagaaauacgagaacgaaguguacuacaccuucuacaucaacccgaaagcccgagaccaaagacggaucaaaauaguccucgacauaaacgggaacaacagugucgggauccuccaagaccucguacaaaaacucaaacccaagugggacgauaucaucaagaaaaacgacaugggcgagcuaaucgacgcaauagaaauagagaaagucagacucggcauccuaaucgcccucuacugcgagcacaaauucaaaauuaagaaagaacuccucucgcuggaccuauucgcaagcgccuaccaguauuuagaacuagaagacgaccccgaggagcugagugguaccaaccuaggccgauuccugcaaagucucguaugcuccgaaaucaaaggggccauaaacaaaaucucccgcaccgaguauauagaacgcuauacaguccaacccaugaacacggagaaaaacuacccccuccucaucaacaaagaaggaaaagcgacuuggcacaucgcagcaaaagacgaccugaguaagaagaaaggcggcggcaccgucgcaaugaaucagaaaaucgggaaaaacuucuucggcaaacaagacuacaagacgguguucaugcugcaagacaagcgauucgacuuacucaccaguaaauaccaccuucaauuccuauccaagacccucgacacgggcggaggcagcugguggaagaacaaaaacaucgaucucaacuuaagcucguacagcuucauauucgaacaaaaagugaaagucgaaugggaccucacuaaccuagaccacccuaucaagaucaaacccagcgaaaauagcgaugacagacgccuuuucguaagcaucccguucguuauaaaacccaagcaaacaaaaagaaaggaccuccaaacccgcguaaacuauaugggaaucgacauaggcgaauacggccucgccuggacaaucaucaacauagaucucaaaaacaagaaaaucaauaaaaucagcaaacaagguuucaucuacgaaccccuaacccacaaggugcgggacuacgucgccacaaucaaagacaaccaaguccgcgguacauucggaaugccugacacgaaacuagcccgccuccgcgagaaugccaucaccucccuccgcaaccaaguacacgacauagcgaugcgauacgacgccaaaccagucuacgaguucgaaauuucgaacuucgaaaccggcagcaacaaaguuaaagucauauacgacucgguuaaacgcgcagacauaggccgcggacaaaauaacaccgaagccgacaacacggaagucaacuugguuuggggcaagaccagcaaacaguucggaucacaaauuggcgccuacgcgaccuccuacauaugcucauucugcggauacucccccuauuacgaguucgagaacaguaaguccggcgacgaagaaggagccagagauaaccuauaucaaaugaagaaacugucccgacccagucuggaggauuuccuacagggcaaccccguauacaaaacauuucgcgacuucgacaaauauaaaaacgaccagcggcuccagaaaacgggcgacaaagacggcgaauggaaaacacaccgcggcaacacagcuaucuacgccugccagaaauguagacauaucucagacgcggacauucaagccuccuacuggaucgcgcuuaaacaagugguccgagacuucuacaaagacaaagaaauggacggcgaccugauccaaggcgacaauaaagacaaacgcaaaguuaacgagcuuaaccgccuuaucgggguacauaaggacguccccauuauuaacaagaaccugauuacaagccuggacauaaaccuccucuag

SEQ ID NO: 11719 - RNA, 3603 nt, Artificial Sequence
  CasY variant__Candidatus Vogelbacteria bacterium__OJI09436.1__CasY
augaaggccaaaaagagcuucuauaaccaaaaacgcaaauucgggaaacgcggcuaccgccuccacgacgaacgcauagccuacucagguggcaucggaagcaugagaagcaucaaauacgagcugaaagacuccuaugggauagccggccugcggaaccguaucgcagacgccaccaucagcgacaacaaauggcucuacgguaacauaaaccucaacgacuaccuggaguggagaucauccaagacggacaaacagauagaggacggcgaucgggaaagcagccugcugggcuucuggcuagaggcccuccgucugggguucguauucagcaaacaaucacacgcccccaacgacuucaacgagacggcacugcaagacuuguuugagacguuggacgacgaccucaaacacguccuagacaggaagaaguggugcgacuucauaaaaauaggaacgcccaagaccaaugaucaaggacggcuaaagaaacagaucaaaaaccugcucaaaggcaacaaaagggaggaaauagagaaaacacuuaacgaaucagacgacgagcucaaagagaaaaucaaucgcauagcggauguauucgccaaaaacaaauccgacaaauacaccaucuucaaacuggacaaacccaacaccgagaaguacccccgaaucaacgacgugcaagucgccuuuuucugccaccccgacuucgaagagaucaccgagcgagacaggaccaaaacccuagaccuaauuauaaaucguuucaacaaacgguaugagaucacggaaaacaaaaaggaugacaaaaccagcaaccgcauggcacuguacucccuaaaccaaggguauauaccacggguucugaacgaccucuuccucuucguaaaagacaacgaagacgacuucagccaauuccuuucagaccuggagaacuucuucagcuucuccaacgagcagauaaaaaucauaaaagaacggcugaagaaacuaaagaaauacgcagagccaauaccgggcaaaccacaacucgcagacaaaugggacgacuaugcaucagacuucggcggcaaacuugaauccugguacucgaaccgaauugaaaaacucaagaaaaucccagaaagcgugucggaucuaagaaacaaccuggagaaaauacgcaacguacucaaaaagcagaacaaugcguccaaaauacucgaacuaagccagaaaauaaucgaauacauacgcgacuacggcgugucauucgaaaaacccgaaaucaucaaauucagcuggaucaacaaaaccaaagacgggcaaaagaaagucuucuacguggcaaaaauggcggaccgggaguucauagaaaaacucgaccucuggauggccgaccuacgaucccaacugaacgaauacaaccaagauaacaaggugucguucaagaaaaagggcaaaaagauagaagaacugggcguguuagacuucgcacugaacaaggcaaagaaaaacaaaucgaccaaaaacgaaaacggauggcaacaaaagcucuccgaaucuauccagagcgcaccccuauucuucggcgaaggaaaccgcguacguaacgaggagguguacaaucucaaagaccuccucuucucagaaauuaaaaacguagaaaacauauugauguccagugaagccgaagaccugaaaaacauaaaaauagaauacaaggaagacggcgccaagaaagggaacuauguauuaaacgucuuagcaagguucuacgcacgguuuaaugaagacggguacggaggcuggaacaaagucaaaacaguccuagaaaacaucgcaagagaagcggggaccgauuuuagcaaauacggcaauaacaauaaccgaaacgccggccguuucuaccuaaacggccgcgagcgacaaguauucacucugauaaaauucgaaaagucaauaaccgucgagaagauacuagaacuggugaaacucccaucgcuccucgacgaggccuaucgagacuuagucaacgaaaacaaaaaccacaaacugcgcgacguaauccagcugucaaaaaccaucauggcccucguccucucucacagcgacaaggaaaaacaaaucggcggaaacuacauucauagcaagcucagcggauacaaugcacuaauaagcaaacgagacuuuauaaguagguauucgguccagacaaccaacggaacccagugcaaacucgcgauaggcaaaggaaaaagcaaaaaggggaacgaaaucgaccgcuacuucuacgcauuccaauucuucaagaacgacgacucaaaaauaaaccucaaagucauaaagaacaacagucacaaaaacaucgacuuuaacgacaacgaaaacaaaaucaacgcccuccaggucuacucauccaauuaccaaauccaguuccucgacugguucuucgaaaagcaccaagguaagaaaacaagccuggaagucggcgggagcuucacaauagcagaaaaaucgcucacaaucgauuggucaggaagcaacccccgagucggauucaagcgcucagacacagaggagaagcgggucuuugugucacagccauucacucucaucccggacgacgaagacaaagaacgacgcaaggaacgaaugaucaagaccaaaaaccgauucauaggaaucgacaucggcgaauacggccuagcauggucucuaauugaaguagauaauggcgacaaaaacaaccgugggauccgccaacuugaaagcggauucaucacggacaaucagcaacaaguacuaaagaaaaacgucaaaagcuggcgccagaaccagauccgccaaaccuucacgucgcccgacaccaaaauagccagacuccgcgaaagccugaucggcucguacaaaaaccaacuagaaagucucauggucgcgaagaaagccaaccuauccuuugaauacgaaguaagcggauucgaggugggcgguaaacggguagccaaaauuuacgacagcaucaagaggggaucgguccggaagaaagacaacaacagccaaaacgaucaguccugggguaagaaagggaucaacgaauggaguuucgaaaccaccgcagccggaacgucccaauucugcacacacugcaaacgcugguccucacucgcaaucguagacauagaagaguaugaacucaaagacuacaacgacaaccucuucaaagugaaaauaaacgacggugagguccgacuacucggcaagaaaggauggcgaagcggggagaagauaaaggggaaagaacucuuuggccccgucaaagacgccaugcgaccgaacgucgacggccucggaaugaagauaguuaaaaggaaguaccuaaaacucgaccucagagauuggguaucccgcuacggcaacauggccaucuucauaugucccuacgucgauugccaccacaucagccacgcggacaaacaagccgcauucaacaucgccguccgaggguaccuuaagucuguaaacccagacagagccaucaagcacggggacaaggggcuuucacgugacuuccucugucaagaagaaggaaaacuuaacuucgagcagaucgggcugcucuga

SEQ ID NO: 11720 - RNA, 3462 nt, Artificial Sequence
  CasY variant__Candidatus Vogelbacteria bacterium__PIP58309.1__CasY
augcaaaagguaagaaagacccugucugagguccacaaaaacccauacggcacgaaaguucgaaacgcaaaaacaggcuacucacuccaaaucgaacgccucuccuauaccggaaaagagggaaugagguccuuuaagauaccacucgaaaacaagaacaaggaagucuucgacgaguucgugaagaaaauccgcaacgacuacaucagucagguuggccuacucaaccuguccgacugguacgaacacuaccaagaaaaacaagaacacuacucccuagccgacuucuggcucgacucacuacgggcaggcgucaucuucgcacacaaggagacugaaaucaaaaaccuaaucuccaagauccgcggcgacaaaagcaucguugacaaguucaacgcaucaaucaagaagaaacacgcugaccucuacgcccucgucgauaucaaagcacuguacgacuuccucacgagcgacgcacgucgcggccuaaagacugaagaagaauuuuucaacagcaaacggaacacccucuuccccaaauuccgcaagaaagacaacaaagcagucgaccuauggguaaagaaauucaucggacuagacaacaaagacaaacugaacuucacaaagaaauucaucggcuucgaccccaacccccaaaucaaauacgaccacaccuucuucuuccaccaagacaucaacuucgaccucgaacgcaucacgacacccaaagaacuuaucuccaccuacaagaaauuccucggcaaaaacaaagaccuguacggcucagaugaaaccaccgaagaccagcugaaaaugguccugggauuccacaacaaccauggagccuucuccaaguauuucaacgcaagucuggaagccuuccgaggcagggacaacucgcuagucgaacaaauaaucaacaacucgcccuacuggaacucccaccgaaaggagcuagagaagcgcauaauuuuccuccaaguacaaagcaagaaaauaaaagaaacagaacucggaaaaccgcacgaauaccuagccagcuucgggggaaaauucgaaucaugggugagcaacuaccuccgccaagaggaagaagucaaacgccaauuauucggcuacgaggaaaacaagaaaggacaaaagaaauucaucguagggaacaaacaagagcucgacaaaaucauccgcggcacugacgaguacgaaauaaaagcuauauccaaagaaacaaucggccuaacccaaaaaugccucaaguuacuggaacagcugaaagacagcgucgacgauuacacccuuucucuauacaggcagcucauagucgagcuaaggauacgauuaaacguggaguuccaagaaacguauccagaacucauagguaaaagcgaaaaagacaaagaaaaagacgcgaaaaacaagagggcagacaagcgcuacccccagaucuucaaagacaucaaacuaaucccuaacuuccuaggcgaaaccaagcagaugguauacaagaaauucauaaggagcgcagacauacuauacgaaggcauaaacuucaucgaccagaucgacaaacaaauaacacaaaaccuacuaccaugcuucaaaaacgacaaagagcggaucgaguucacagaaaaacaguuugagacccucagacgcaaauacuaucuaaugaacuccucaagguuucaccacguaaucgagggcauaaucaacaacagaaaacuuaucgaaaugaaaaagagggaaaacucugaacucaagacauucucugacuccaaauuuguccucagcaaacuguuccucaagaaaggcaaaaaguacgaaaacgaagucuauuauaccuucuauaucaaccccaaggcacgcgaccaaagaaggauaaagaucguccuagacauaaacggcaacaacucagugggcauacuacaagaccuaguccaaaaacugaagccaaaaugggacgacauaaucaagaaaaacgauaugggggagcuuaucgacgccaucgagaucgagaaaguacgacucggcauccuuaucgcccucuacugcgaacacaaauucaagauuaagaaagagcuacuaucccuagaccucuucgccuccgcguaccaguaccuggagcuagaagacgaucccgaggaauuauccggcacaaaccuagggcgguuccuccagagccucgucugcagcgaaaucaaaggcgccaucaacaaaauuagcaggacagaguacauagaacgauauacaguccaaccgaugaacacagagaagaauuacccccuacuuauaaacaaggaaggcaaggcaaccuggcacauugcggcaaaagaugaccuauccaagaagaaaggcggaggcacgguagcuaugaaccagaaaauaggcaagaacuucuucgggaagcaagacuacaaaaccgucuucaugcuacaagacaaacguuucgaccuccuuacuucaaaauaccaccuccaauuccuaaguaagaccuuagacacgggcgggggcuccugguggaagaacaagaauauagaccucaaccuuaguuccuacuccuucaucuucgagcagaaaguaaaagucgagugggaccucaccaaccucgaccauccaauaaagaucaaaccaagcgaaaacuccgacgaucggagacucuucgucagcaucccauuuguaaucaaacccaaacaaacaaaacgcaaggaccuacaaacccgaguaaacuauaugggaaucgauauaggugaauacggacuggccuggacaaucauaaauauagaucucaaaaacaaaaagauuaacaaaauuucaaaacaaggcuucaucuacgaaccacucacccacaagguacgcgacuacgucgcgacuaucaaggacaaccaggugcggggaaccuucggaaugccggacacgaaacuagcgaggcuacgggaaaacgccauaaccucccuacgcaaccaaguacacgacaucgcgaugagguacgacgcuaaaccagucuacgaguucgaaauaagcaacuucgagacgggaagcaacaaagucaaagugauauacgacucagucaagagggcagacaucggacgagggcaaaacaacacugaagcagacaauaccgaagucaaccuagucuggggaaagacuucuaagcaauucggcucucagaucggugccuacgcaacaucuuauaucugcuccuucugcggcuacucucccuacuaugaguucgagaacagcaagucaggagacgaagagggggcccgcgacaaccuauaccaaaugaagaagcugucaagaccuagccucgaagacuuucuccagggaaaccccgucuauaaaacauucagggacuucgacaaguacaaaaacgaccaacggcuccagaagaccggcgacaaagacggagaauggaagacccaccgaggaaacaccgccaucuacgccugccagaaaugcuga

SEQ ID NO: 11721 - RNA, 3480 nt, Artificial Sequence; identical to SEQ ID NO: 11131
  Cas13a variant__Leptotrichia buccalis__WP_015770004.1__Cas13a

SEQ ID NO: 11722 - RNA, 3480 nt, Artificial Sequence; identical to SEQ ID NO: 11132
  Cas13a variant__Leptotrichia buccalis__WP_015770004.1__Cas13a(R472A,H477A)

SEQ ID NO: 11723 - RNA, 3480 nt, Artificial Sequence; identical to SEQ ID NO: 11133
  Cas13a variant__Leptotrichia buccalis__WP_015770004.1__Cas13a(R1048A,H1053A)

SEQ ID NO: 11724 - RNA, 3480 nt, Artificial Sequence; identical to SEQ ID NO: 11134
  Cas13a variant__Leptotrichia buccalis__WP_015770004.1__Cas13a(R472A,H477A,R1048A,H1053A)

SEQ ID NO: 11725 - RNA, 3480 nt, Artificial Sequence; identical to SEQ ID NO: 11135
  Cas13a variant__Leptotrichia buccalis__WP_015770004.1__Cas13a(R1079A)

SEQ ID NO: 11726 - RNA, 3480 nt, Artificial Sequence; identical to SEQ ID NO: 11136
  Cas13a variant__Leptotrichia buccalis__WP_015770004.1__Cas13a(E299A)

SEQ ID NO: 11727 - RNA, 3480 nt, Artificial Sequence; identical to SEQ ID NO: 11137
  Cas13a variant__Leptotrichia buccalis__WP_015770004.1__Cas13a(K310A)

SEQ ID NO: 11728 - RNA, 3480 nt, Artificial Sequence; identical to SEQ ID NO: 11138
  Cas13a variant__Leptotrichia buccalis__WP_015770004.1__Cas13a(N314A)

SEQ ID NO: 11729 - RNA, 3480 nt, Artificial Sequence; identical to SEQ ID NO: 11139
  Cas13a variant__Leptotrichia buccalis__WP_015770004.1__Cas13a(R1072A)

SEQ ID NO: 11730 - RNA, 3480 nt, Artificial Sequence; identical to SEQ ID NO: 11140
  Cas13a variant__Leptotrichia buccalis__WP_015770004.1__Cas13a(D1078A)

SEQ ID NO: 11731 - RNA, 3480 nt, Artificial Sequence; identical to SEQ ID NO: 11141
  Cas13a variant__Leptotrichia buccalis__WP_015770004.1__Cas13a(R1079A,K1080A)

SEQ ID NO: 11732 - RNA, 3480 nt, Artificial Sequence; identical to SEQ ID NO: 11142
  Cas13a variant__Leptotrichia buccalis__WP_015770004.1__Cas13a(K1080A)

SEQ ID NO: 11733 - RNA, 3480 nt, Artificial Sequence; identical to SEQ ID NO: 11143
  Cas13a variant__Leptotrichia buccalis__WP_015770004.1__Cas13a(K1082A)

SEQ ID NO: 11734 - RNA, 3480 nt, Artificial Sequence; identical to SEQ ID NO: 11144
  Cas13a variant__Leptotrichia buccalis__WP_015770004.1__Cas13a(K1087A)

SEQ ID NO: 11735 - RNA, 4170 nt, Artificial Sequence; identical to SEQ ID NO: 11145
  Cas13a variant__Leptotrichia shahii__WP_018451595.1__Cas13a

SEQ ID NO: 11736 - RNA, 4170 nt, Artificial Sequence; identical to SEQ ID NO: 11145
  Cas13a variant__Leptotrichia shahii__WP_018451595.1__Cas13a

SEQ ID NO: 11737 - RNA, 4305 nt, Artificial Sequence; identical to SEQ ID NO: 11147
  Cas13a variant__Leptotrichia shahii__WP_018451595.1__Cas13a(long)

SEQ ID NO: 11738 - RNA, 4158 nt, Artificial Sequence; identical to SEQ ID NO: 11148
  Cas13a variant__Leptotrichia sp. oral__WP_021744063.1__Cas13a

SEQ ID NO: 11739 - RNA, 3459 nt, Artificial Sequence; identical to SEQ ID NO: 11149
  Cas13a variant__Leptotrichia wadei__WP_021746774.1__Cas13a

SEQ ID NO: 11740 - RNA, 3459 nt, Artificial Sequence; identical to SEQ ID NO: 11150
  Cas13a variant__Leptotrichia wadei__WP_021746774.1__Cas13a(G403D)

SEQ ID NO: 11741 - RNA, 3909 nt, Artificial Sequence; identical to SEQ ID NO: 11151
  Cas13a variant__Leptotrichia wadei__WP_021746774.1__6xHis-Tag/Twin-Strep/SUMO_Cas13a(G403D)

SEQ ID NO: 11742 - RNA, 3459 nt, Artificial Sequence; identical to SEQ ID NO: 11152
  Cas13a variant__Leptotrichia wadei__WP_021746774.1__Cas13a(R474A,R1046A)

SEQ ID NO: 11743 - RNA, 5073 nt, Artificial Sequence; identical to SEQ ID NO: 11153
  Cas13a variant__Leptotrichia wadei__WP_021746774.1__XY_Cas13a(R474A,R1046A)_EGFP_ZF-CCR5T_KRAB -A _NLS

SEQ ID NO: 11744 - RNA, 3549 nt, Artificial Sequence; identical to SEQ ID NO: 11154
  Cas13a variant__Leptotrichia wadei__ERK53440.1__Cas13a

SEQ ID NO: 11745 - RNA, 4158 nt, Artificial Sequence
  Cas13a variant__Clostridium aminophilum__WP_031473346.1__Cas13a
augaaguuuucgaagguagaccacacccgauccgccgucgggauccagaaggccaccgacagcgugcacgguaugcuguacacggaccccaagaagcaggagguuaacgaccucgacaagcgguucgaccagcugaacgucaaggcgaagcgccuguacaacguguucaaucaguccaaggccgaagaggaugacgaugagaagcgguucgggaagguggucaagaagcucaaccgcgagcugaaggacuuacuguuccaccgcgaagugagccgcuacaauucaaucgggaacgcaaaguacaauuacuacgguaucaagagcaacccggaggaaaucgugucgaaccugggaauggucgagagccugaagggcgagcgggacccccagaaggugaucuccaagcuccugcuguacuaccuccgcaagggccugaagccugggaccgacggccugcggaugauccucgaggcaagcugugggcugcgcaaacuguccggcgacgagaaggagcucaagguguuccugcagacccucgaugaggacuucgagaagaagaccuucaagaagaaccucauccggagcaucgagaaccagaacauggccguccagcccuccaacgagggcgacccgaucaucggcaucacgcagggccgcuucaacagccagaagaaugaggagaaguccgcgaucgaacggaugaugagcauguaugcagaccugaacgaggaucaucgcgaagaugugcugcggaagcuacgccggcugaacgugcuguauuucaacgucgacaccgagaagaccgaggagcccacccuacccggggagguggacacgaaucccguauuugaagucuggcacgaccacgagaaggggaaggagaacgaccgccaguucgccaccuucgccaagauccugaccgaggaccgggagacccgcaagaaagagaagcuggcggugaaggaggcccugaacgaccugaaguccgccauccgggaccacaacaucauggccuaccgcugcagcaucaaggugacggaacaagacaaggacggacuauucuucgaggaccagcguaucaaccgguucuggauccaccacaucgaguccgcagucgagcgcauccucgcgagcaucaacccggagaagcuguauaagcugcggaucggcuaccucggcgaaaagguguggaaggaccugcugaacuacuuaagcaucaaguacaucgccguggggaaggccguuuuccauuucgccauggaggaccuuggcaagaccgggcaggacaucgagcuggggaagcucucaaacagcguguccgggggccugaccagcuucgacuacgagcagauccgcgccgacgagacccugcagcggcagcucuccgucgagguggcguucgcagccaacaaccuguuccgcgccguggucgggcagacgggaaagaagaucgagcagagcaaguccgaagagaaugaggaggacuuccugcucuggaaggccgagaagauagcggagagcaucaagaaggaaggcgaggggaacacccugaaguccauccugcaguucuucggcggggcaagcucaugggaccugaaccauuucugcgccgccuacgggaacgagucauccgccuugggcuacgaaaccaaguucgcggaugaccugcggaaagcaaucuauagccugcguaaugagacauuucacuucacuacccucaacaagggguccuucgacuggaacgccaagcugaucggcgacauguucagccacgaggcggcuaccgggauagccguggagcguacccgcuucuacuccaacaaccugccgauguucuaccgggagagcgaccuaaagcgcaucauggaccaccuguacaacaccuaccacccccgcgcaucccagguacccagcuucaacagcgucuuugugcgcaagaacuuccgacuuuuccucuccaacacccugaacaccaacaccucguucgauacggagguguaccagaaaugggagucaggggucuauuaucuguucaaggagaucuacuacaacagcuucuugccguccggggacgcccaccaucuguucuucgagggccugcgcaggauccgcaaggaggccgacaaccuccccaucgugggcaaagaggccaagaagcggaacgccgugcaggacuucgggcgccgcugcgacgagcugaagaaccuuagccucuccgccaucugccagaugaucaugaccgaguacaacgagcagaacaacgguaaccggaaggucaagucaacccgcgaggacaagcggaagcccgacauauuccaacacuacaagaugcugcugcuccgcaccuugcaggaagcguucgccauuuacaucaggcgcgaagaguucaaguucaucuucgaccugcccaagacgcucuacgugaugaagccgguggaggaguuccugccuaacuggaagucggggauguucgacucucuggucgagcgggugaagcagucccccgaccuccagcgcugguacgugcugugcaaguuccugaacggcagauugcugaaccagcugagcggcgugauccgcucuuacauacaguucgcuggggacauccagcggcgcgccaaggccaaucacaaccggcucuacauggacaacacccagcggguggaauacuacagcaacgugcuggaggucgucgacuucugcaucaagggcaccucccgguucaguaacguguucuccgacuacuuccgcgacgaggacgccuaugcugacuaccuggacaacuaccuccaguucaaagacgaaaagaucgcggaaguaagcagcuucgccgcccugaagacauucugcaacgaggaggaggugaaggccgggaucuauauggacggcgagaaccccguuaugcagcggaacauagucauggcgaaacuuuucgggccggacgaggugcucaagaacguggucccaaaggugacgcgcgaggaaauugaggaguacuaccagcuugagaagcagaucgcccccuaccggcagaacggcuacugcaagucagaggaggaccagaagaagcugcuucgcuuucagcggaucaagaacaggguggaguuccagaccaucaccgaguucagcgagaucaucaacgagcuucugggacagcucaucuccuggagcuuucugcgcgaacgggaccugcucuacuuccagcugggguuccauuaucuaugucuacacaacgacaccgagaagccagcagaauacaaagagaucucacgcgaggacggcaccgucauccggaaugccauucugcaccagguggccgcgauguacgucggaggccugccgguguacacgcucgccgauaagaagcuggccgccuucgaaaagggggaggccgacugcaagcuaagcaucagcaaagacaccgcgggcgccggcaaaaagaucaaggacuucuuccgcuacucaaaguacgugcucaucaaagaccggaugcugacugaccagaaccagaaguacaccaucuaccuggccgggcucgaacucuucgagaacacagacgagcacgacaacaucaccgacgugcgcaaguacgucgaccacuucaaauacuacgcuaccuccgacgagaacgccaugagcauccuggaccucuauuccgagauccacgaccgguucuucaccuacgacaugaaguaccagaagaacguagcgaacaugcuggagaacauccugcuccgccacuucgugcugauccggcccgaguucuucacgggcagcaagaaagucggggagggaaagaagaucacguguaaggcccgcgcccaaaucgagaucgccgagaacggaaugcgguccgaggauuucaccuacaagcugagcgacggcaagaaaaacaucuccacgugcaugaucgcggcuagagaccagaaauaccucaacaccguggccaggcugcuguacuacccccacgaggccaagaaauccauaguggauacccgcgagaagaagaauaacaagaagaccaaccggggcgacgggaccuucaauaaacagaagggcaccgcccgcaaggagaaggacaacgggccccgggaguucaaugauaccggcuucagcaacaccccguucgcgggauucgaccccuuccgcaacagcuga

SEQ ID NO: 11746 - RNA, 4035 nt, Artificial Sequence; identical to SEQ ID NO: 11156
  Cas13a variant__Eubacterium rectale__CVRQ01000008.1__Cas13a

SEQ ID NO: 11747 - RNA, 3858 nt, Artificial Sequence; identical to SEQ ID NO: 11157
  Cas13a variant__Herbinix hemicellulosilytica__CRZ35554.1__Cas13a

SEQ ID NO: 11748 - RNA, 4314 nt, Artificial Sequence
  Cas13a variant__Lachnospiraceae bacterium__WP_022785443.1__Cas13a
augaagaucagcaaggugcgcgaggagaaccggggcgccaagcugaccgucaacgccaagaccgcgguaguauccgagaaccgcagccaggaggggauucucuacaacgaccccagccgguacggcaagagccgcaagaacgacgaggaccgggaccguuacaucgaaucccggcucaagagcuccgggaagcuguaccgcauauucaacgaggacaagaacaagcgggagacagacgaauugcagugguuccugagcgagaucgucaagaagaucaaccgccggaacggcuuagugcucuccgacaugcugagcguggaugaccgcgccuucgagaaggccuucgagaaguacgccgagcuguccuacaccaaccggcgcaacaaggugagcgggucccccgccuucgagaccugcggcguggacgcggccaccgccgagcggcucaagggcaucaucagcgagacgaacuucaucaaccgcaucaagaacaauaucgacaacaagguguccgaggacaucaucgaccggaucaucgccaaguacuuaaagaagucccugugccgcgagcgggucaagcgcgggcucaaaaagcugcugaugaacgcguucgaccuccccuacagcgaccccgacaucgacguucagcgggacuucaucgacuacgugcuggaggacuucuaccacguccgcgccaaaagccaggugucccgcagcaucaagaacaugaacaugcccgugcagcccgagggcgacgggaaguucgccaucaccgucagcaagggcgggaccgaguccggcaacaagcggagcgccgagaaggaggccuucaagaaguuccuguccgacuacgcgucgcucgacgagcgcgugcgggacgacaugcugcgccgaaugcgccggcuggugguccucuacuucuacggcuccgacgacagcaagcuguccgacgugaacgagaaguucgacgugugggaggaccacgccgcccgccgggucgacaaccgcgaguucaucaagcugccccucgagaacaagcuggccaaugggaagaccgauaaggacgccgagcggauccgcaagaacacggugaaggagcuguaccggaaccagaacauuggcugcuaccgccaggcggugaaggccgucgaggaggacaacaaugggcgguacuucgacgacaagaugcucaacauguucuucauccaccgcaucgaguacggcguggagaagaucuacgccaaccugaaacaagucacagaguucaaggcuagaaccggcuaccucagcgagaagaucuggaaggaccucaucaacuacaucuccaucaaguacaucgccauggggaaggcgguguacaacuacgccauggaugagcugaacgccagcgacaagaaggagaucgagcugggcaagaucuccgaggaguaccucagcgggaucuccagcuucgacuacgaguugauuaaggccgaggagaugcugcagcgcgagaccgccguguacgucgcguucgccgcgcggcaccucuccagccagacgguggagcuggacuccgagaacagcgacuuccugcuccugaagcccaagggcaccauggacaagaacgacaagaacaagcuggccuccaauaacauccucaacuuccugaaggacaaggagacccugcgcgacaccauccuccaguacuucgggggccacagccuguggacggacuuccccuucgacaaguaccuggcgggcgggaaggacgacguggacuuccucaccgaccugaaggacgucaucuacagcaugcgcaacgacuccuuccacuacgccaccgagaaccacaacaacggcaaguggaacaaggagcugaucagcgccauguucgagcacgagaccgagcggaugacgguggugaugaaggacaaguucuacuccaacaaccugccgauguucuacaagaacgacgaccucaagaagcugcugaucgaccucuacaaggacaacgucgagcgcgccagccaggugcccuccuucaacaagguguucguccggaagaauuuccccgcccuggugcgcgacaaggacaaccuggggaucgagcucgaccugaaggcggacgccgacaagggcgaaaacgagcugaaguucuacaacgcccucuacuacauguucaaggagaucuacuacaacgccuuucugaacgacaagaacgugcgggaacgcuucaucaccaaggccaccaaggucgcggacaacuacgaccggaacaaggagcgcaaccugaaggaccggauuaagagcgccggguccgacgagaaaaagaagcuccgcgagcaacugcagaacuauaucgccgagaacgacuucggccagcggaucaagaacaucguccaggugaaccccgacuacacccuggcccagaucugccagcucauuaugacugaguacaaccagcagaacaauggcugcaugcagaagaaguccgccgcgcgcaaggacaucaacaaggacagcuaccagcacuacaagaugcugcugcuugugaaccugcggaaggcauuccuggaguucaucaaggagaacuacgccuucgugcucaaaccguacaagcacgaccugugcgacaaggccgacuucgugcccgacuucgcgaaguacgucaagcccuacgcgggccugaucagccgcguggccggcuccagcgagcuccagaagugguacaucgugucccgguuccugagccccgcccaggccaaccacaugcugggcuuccuccacaguuauaagcaguaugucugggacaucuaccgccgggcgagcgagaccggcaccgagaucaaccacuccaucgccgaggacaagaucgccgggguggacaucaccgauguggacgccgucaucgaccugagcgugaagcugugcggcacgaucaguuccgagaucagcgacuacuuuaaggacgacgagguguacgccgaguacaucuccagcuaccucgacuuugaauacgacggcgggaacuacaaggacucccugaaccgcuucuguaacagcgacgcggucaaugaccagaagguggcccuguacuacgacggcgagcacccgaagcucaaccggaacaucauccuguccaagcuguacggggagcgccgguuccucgaaaagaucaccgaccgcgugagccgcuccgacaucgucgaguacuacaagcugaagaaggaaaccagccaguaccagaccaagggcaucuucgacuccgaggacgagcagaagaacaucaagaaguuccaggagaugaaaaacaucguggaguuccgggaccugauggacuacagcgagaucgccgacgagcuccagggccagcugaucaacuggaucuaccugcgcgagcgggaccucaugaacuuccagcugggguaccacuacgccugccugaacaacgacuccaacaagcaggccacguacgugacccucgacuaccagggcaagaagaaccgcaagaucaacggagcgauccuguaucagaucugcgccauguacaucaacggccugccccucuacuacgucgacaaggauagcuccgaguggaccgugagcgacgggaaggaguccaccggcgccaaaaucggcgaguuuuaccgguacgccaagagcuucgagaacacauccgacugcuacgcgagcgggcuggagaucuucgagaacaucagcgagcacgacaacaucaccgagcugcgcaacuacaucgagcacuuccgguacuauuccagcuucgaccgcuccuuccucggcaucuacagcgagguguucgaucgguucuucaccuacgaccugaaguaccgcaagaacguccccaccauccuguacaacauccuccugcagcacuucgugaacguacgguucgaguucgucuccgggaagaagaugaucggcaucgacaagaaggaccgcaagaucgccaaggagaaggagugcgcccggaucaccauccgcgagaagaacgggguguacagcgaacaguucacguacaagcugaagaacggcaccguguacgucgacgcucgggacaagcgcuaccuccaguccaucauccggcugcuguucuaccccgagaaggugaacauggacgagaugaucgaggugaaggagaagaaaaagccgagcgacaacaacaccggcaagggguacuccaagcgcgaccggcagcaagaccgcaaggaguacgacaaguacaaggagaagaagaagaaggagggcaacuuccucagcgggaugggcgggaacaucaacugggacgagaucaacgcccagcugaagaacuga

SEQ ID NO: 11749 - RNA, 3156 nt, Artificial Sequence; identical to SEQ ID NO: 11159
  Cas13a variant__Listeria newyorkensis__WP_036091002.1__Cas13a

SEQ ID NO: 11750 - RNA, 3363 nt, Artificial Sequence; identical to SEQ ID NO: 11160
  Cas13a variant__Listeria seeligeri__WP_012985477.1__Cas13a

SEQ ID NO: 11751 - RNA, 3465 nt, Artificial Sequence
  Cas13a variant__Paludibacter propionicigenes__WP_013443710.1__Cas13a
augcgcgugagcaaggucaaggugaaggacggcgguaaggacaagauggugcugguccaucggaagaccaccggcgcucagcuaguguacuccgggcagcccgugagcaacgagacguccaacauccugccggagaagaagaggcagagcuucgaccuguccacccucaacaagaccaucaucaaguucgacaccgccaagaagcagaagcugaacgucgaucaguacaaaaucguggagaaaaucuuuaaguacccaaagcaggagcugcccaagcagaucaaagcggaggaaauccuccccuuccucaaccacaaguuccaggagccgguuaaguacuggaagaacggcaaggaggagagcuucaaccugacccuccugaucgucgaggccguccaggcccaggacaagcggaagcugcagcccuacuacgacuggaagaccugguacauccagaccaaguccgaccuccugaagaaaucaauagagaacaaccgcaucgaucugaccgagaaccucagcaagcggaagaaagcucuuuuggccugggaaacagaguucacagcgagcggguccaucgaccucacccacuaccacaagguguacaugaccgauguccugugcaaaaugcugcaggaugugaagccccucacggacgacaagggcaagaucaauaccaacgccuaccaccgaggcuugaagaaggcccuccagaaccaucaacccgccaucuucgguaccagggaagugccgaacgaggcgaaccgcgcggacaaccagcucucaaucuaccaccuggaggucgugaaguaccuggagcacuacuucccgaucaagaccuccaagcggcgcaacacggccgacgacaucgcgcacuaccucaaggcccagacccugaaaaccaccaucgagaagcagcuggugaaugcgauccgggccaacauuauccagcagggcaagacgaaccaccacgagcucaaggccgacaccacgagcaacgaccugauccggaucaagaccaacgaggccuucguccugaaccucacggggaccugcgccuucgcggccaacaacauccggaauaugguugacaacgagcagaccaacgacauccugggcaagggggacuucaucaagucccugcuuaaggacaacaccaacucacagcucuacuccuucuucuucggcgagggccugagcacgaacaaagccgagaaggagacccagcucugggggauccgcggcgccgugcagcagauccggaacaacgucaaccacuacaagaaggacgccuuaaagaccguguucaacaucuccaacuucgagaaccccaccaucacggacccaaagcagcagaccaacuacgcggacaccaucuauaaggcccgcuucaucaacgagcuggagaagaucccggaggccuucgcccagcagcuaaagaccgggggcgccgucagcuacuacacgaucgagaaccucaagagccugcugaccaccuuccaguucucccucugccggagcaccauccccuucgcgcccggcuucaagaaggucuucaacgguggcaucaacuaccagaacgccaagcaggacgaguccuucuacgagcugaugcucgagcaguaccugcgcaaagagaacuucgccgaggaaagcuacaacgcccgguacuucaugcugaaacuuaucuacaacaaucucuuccugccgggguucaccacggaccgcaaggcguucgcugacuccgugggcuucguccagaugcagaacaagaagcaggccgagaaggugaacccgcggaagaaggaggcguacgccuucgaagcggugcgccccaugaccgccgccgacaguaucgccgacuacauggccuacguccaguccgagcugaugcaggagcagaacaagaaggaggagaagguggcggaggagacgcgcaucaauuucgagaaguucgugcuccaggucuucaucaaggguuucgacagcuuucugcgggccaaggaguucgacuucgugcagaugccccagccccagcuuaccgcuacggccuccaaccagcagaaggccgacaagcucaaccagcuggaagcgagcaucaccgccgacugcaagcugaccccgcaguacgccaaggcagacgacgcgacccacaucgccuucuacguguucugcaagcuccuggacgccgcccaccugucgaaccuccgcaaugagcugaucaaguuccgggagagcgucaacgaguuuaaguuccaccaucucuuggagaucaucgagaucugccugcuuuccgccgacgugguacccacggacuaccgcgaccuuuacagcuccgaggcggacugccuggcccggcugcgccccuucaucgagcagggcgccgacaucaccaacuggagcgaccuuuucguccaauccgacaagcacagccccgucauccacgcuaacaucgagcuguccgugaaguacggcaccaccaagcugcucgaacagaucaucaacaaagacacgcaguucaagaccaccgaggccaacuucaccgcguggaacacggcccagaaguccaucgagcagcugauuaaacagcgggaggaccaccaugagcagugggucaaagccaagaaugccgacgacaaggagaagcaggagcgcaagcgggagaaguccaacuucgcccagaaguucaucgagaagcacggggacgacuaccuggacaucugcgacuacaucaacaccuacaacuggcucgacaacaagaugcacuucguccaucugaaccgccuacacggccucaccaucgaacuccuggggcggauggcgggcuucguggcccucuucgaccgcgacuuccaguucuucgacgagcagcagaucgccgacgaguucaagcugcacggguucgucaaccuccacucuauagacaagaagcucaacgaagugccgaccaagaagaucaaggagaucuacgacauacggaacaagauuauccagaucaacggcaacaagaucaacgagagcguacgcgccaaccugauccaguucaucagcagcaagcggaacuauuacaacaacgcguuccuccaugucuccaacgacgagaucaaggagaagcagauguacgacaucagaaaccacaucgcccacuucaacuaucucacgaaagacgccgccgacuucagccugauagaccugauuaacgagcuccgcgagcugcugcacuacgacagaaagcucaaaaacgccguguccaaggccuucauugaccuguucgacaagcauggcaugauccugaaacucaagcugaacgccgaccacaagcugaagguugagagccucgagcccaagaagaucuaccaccuggggucuagcgccaaggacaagcccgaguaccaauacugcaccaaccaggucaugauggccuacugcaacaugugccggucccugcucgagaugaagaaauga

SEQ ID NO: 11752 - RNA, 3858 nt, Artificial Sequence
  Cas13a variant__Rhodobacter capsulatus__ETD76934.1__Cas13a
augcaaaucggaaaaguccagggccguacgaucucagaguucggcgaccccgccggcggccucaaacggaaaauaucaacagauggcaaaaaucgcaaggaacuaccagcccaucucucaagcgacccgaaagcgcugaucgggcaguggaucagcggaauagacaagauauaucggaagccugacagccggaagucggacgguaaagcaauccacagcccaacuccguccaaaaugcaauuugacgcccgagacgaccuaggagaagcauucuggaagcucgucucagaagcaggccucgcgcaagacuccgacuacgaccaauuuaaacgccgacuacacccauacggggacaaauuccaaccggccgauagcggugccaaacuaaaguucgaagcagauccaccagaaccacaagccuuccacggaagaugguacggcgcgaugagcaaacgcggaaacgacgccaaagaacuagcagccgcacuguacgaacaucuccacguugacgagaaacgaauagacggucaaccgaaacggaacccaaaaaccgacaaauucgcccccggccugguaguagcacgagcacugggaaucgagucuagcguguugccacgcggcauggccagacuagcacgaaauuggggcgaggaagaaauccaaacguauuucguagucgacguggcagccagcgucaaagaaguagcaaaagcagcgguaucagcagcccaagcguucgacccgccacgccaaguaucaggaaggucccucucucccaaagucggcuucgccuuggccgagcaccucgaacgagucacaggcucaaaaagaugcagcuuugaucccgccgccggcccaucaguccuagcacuacacgacgaaguaaagaaaacauacaaacguuugugcgcacgaggcaaaaaugccgcccgcgcauuuccggccgacaaaaccgaacuccuagcccugaugagacacacccaugaaaauagagucaggaaucaaauggugagaaugggacgggucuccgaguacagaggacaacaggcuggcgaccuugcacagucacacuacuggaccuccgcgggccagacagaaaucaaagagucggaaaucuucguucgccuaugggucggagcauucgcgcuagcuggccgaagcaugaaggcuuggaucgauccaaugggaaaaaucgucaauaccgagaaaaacgaccgcgaccugacagcagccgucaacauaagacagguuaucagcaacaaagaaaugguagcagaagcaauggcaagacgaggaauauacuucggagagaccccagaacuagaccgacucggcgcagaaggaaacgaaggguucguauucgcacugcuacgcuacuuacgcggaugcagaaaccaaaccuuccaucuaggugcaagagcuggcuuucucaaagaaauaaggaaagaacucgagaaaacccgauggggcaaagcaaaagaagccgaacacgucguccugacagauaaaaccguggccgccauacgagccauaaucgacaacgaugcaaaagcacugggggcacggcuauuggcugaccuguccggcgcuuucgucgcccacuacgcguccaaggaacacuucucgacccucuacagcgaaaucgucaaggcgguaaaagacgcaccagaaguaucgucgggucuaccccgauuaaaacuacugcucaaacgcgcagacggcguccggggauacgugcacggccuacgcgacacacgaaaacacgcuuucgccacgaaacugcccccaccgcccgcccccagggaacucgacgauccagcaaccaaggcacgauacaucgcccugcugcgacuauacgacggaccguucagagcguacgcaagcggaaucaccggcaccgcccucgccggccccgcagcccgcgccaaagaagcagcaacagcucuggcccaaucggucaacgucacgaaagccuacagcgacguaauggaagggcggaguagccgacuccgacccccuaacgacggggaaacguuacgcgaauaccuuucagcacuaacaggggaaacggcaaccgaguuccggguccaaaucggcuacgaaagcgauagugaaaaugcccgaaagcaagccgaguucauagaaaacuaccggagagauaugcuagccuucauguucgaagacuacauaagggccaaaggguucgacuggauccuuaagaucgaaccaggcgccaccgccaugacaagagccccaguccuccccgaacccauagauacacgcggacaguacgaacacuggcaggcagcacuauaccucgucaugcacuucgucccagccagcgauguaagcaaccugcuccaucaacugcgcaaaugggaagcccuacaggggaaauacgaacucguccaagacggggacgcuaccgaccaagcggaugccagacgcgaagcacuugaccuaguaaaacgcuuuagagacgucuuggugcuguuccucaagaccggggaagcccgcuucgaaggcagagcugccccauucgacuugaaaccguuccgagcccuauuugccaacccagcaacauucgacagacuuuucauggcaacgccuacgacggcgcgacccgcagaagacgacccggaaggagacggagcguccgaaccagaacuacgggucgcacgcacacugcgaggacuaagacagauagcccgguacaaccacauggccguacucagcgaccuauucgccaaacacaaagugcgugacgaagaaguagcccgcuuggccgaaauugaggaugaaacccaagaaaaaucacaaauaguagccgcgcaggaacuaagaaccgaccugcacgacaaagucaugaaaugccacccaaaaaccauaucaccugaagaacgacaaucguacgccgcugcaaucaagacuaucgaagaacaccgcuuucuaguaggacgaguauaucuaggugaucaccuaagacugcaccgacucaugauggacgucauagggagacuaauagacuacgccggagccuaugaacgggacaccggaacauuccuaaucaacgcaagcaaacagcuaggcgccggagccgauugggcgguaacuaucgcgggagcugcaaacacugaugcccgaacccaaacaagaaaagaccuagcacacuucaacgugcuggaccgagcggaugggacaccagaccuaaccgcccuagugaacagagcaagagaaaugauggcauacgaccgaaaaagaaagaacgccgucccacgaagcauacuagacauguuagcccgacucggucuaacacucaaauggcaaaugaaagaccaccuacugcaagacgcaacgauaacccaggcugcaaucaaacacuuagacaaaguacggcuuacaguaggaggcccagcggcggucacagaagcgcgauucucccaagacuaccugcaaauggucgccgcugucuucaacggaagcguccaaaacccaaaaccacggcgaagagacgacggcgacgccuggcacaaaccaccaaagcccgccaccgcccaaagccaacccgaccaaaaacccccgaacaaagcaccauccgcaggaagccgccucccaccgccccaggucggggaggucuacgaaggcguagucguaaaagucaucgacaccggcagccucggauuccuugccguagaggggguagccggcaacaucggacuacacaucuccagacugcgccgaauuagggaagacgcuauaauagucggacggcgguacagguuccgcguggaaauauacguaccacccaaauccaauaccagcaaacuaaacgcagccgaccuagugcgcauugacuga

SEQ ID NO: 11753 - RNA, 1578 nt, Artificial Sequence
  Cas13a variant__Corynebacterium ulcerans__WP_038617242.1__Cas13
augccaaaauacugcuugacagcaagauucccgcuaggugucuaccucggccacaccggugacgccaacagggacgccuaccccgaccccgcacgccuccacgccgcacucaugaacgccgccgcccaaggcguacacgccgaagaagacccaaacgaacaucaacuccgucccucccagcaaucucuccaggcacuacaauggcuagaagcucacccaccaaccggacucgcaaugccagaacaacaauggcugucccccgacaccagccgaaugauguaccgcaacgucgguuccgucaaaauugacaaaacaggcguaacccgagccaccgaaaaccgagccguauccgacggcguauccguaaacggcgccuacggcuacaucugggaugaaaugccagucgacaucgccgaagcgaucacagcacuacuccccgacguugccugccucggagaagcaucaucacuugucguacuagaacaacaagaaaucgaggccacccucacacucgacccccaagccacagccuucagcacagagcgcguucagguccgaaucgcacuccccggacgaacccaacaccuuagagaagucuuccacgcccgcuacggcaagaaaccccccuccaaaaaagccgauaaauuccuaaaagacgaccccauccaugaccccccaauuccaaaagaccaccugggaaccgcccgauaccuacgcguaaacgcagccgacaaagaaugcgucacuccauggacaaaaguaauacuacuagaaguccacggcaaacaacucggagccaaagaacaaguccgcgcagccgucgcccuucaccgcgcacuaaucgcccgcauucggaccgacgucucccccgucauuaccggccguuaugcugccggcgcucaacgacccgcgaacaaccuagcaauccaauacaucccccaccgccaccucgaagcacuuggacuaaaaacaucagccuuugcccuccucgucccacaagacgccgacucaacggucuacgaacaauuaaaucaagcccucaccggcccauucccccuacgcuccggcggcaaacuccucugccaacuaaaauacaacggccaugucuuccgcggcgacgcauucuggccagccccacaacccggcaccauccgcaugugggaaccacucaacguuuucaucccagagucccgaccacacaacaaacaacaaggcguacucuggcgacucgccgacgccggucuccucucaguagccuuuguuuggcgagacaacuuccccacaaaagagaccggccccgcucgcuacgucgaacuccgagacgcagccuacaacgccgaugucaggauauuucaugaccaccccgucucccgcaacacccgacguuucguccaccgcaccaaccgcagccuaacaauacaacccuggcgcggacuaguccaccuaggcucccuccagcaagaccgcgccaucauugcccuaggccaauccagacacuuaggcggaggacuacucaucccuguagacauuccacguagcgaauucgaaaccaugaccuccgaaaugacccaugccuaa

SEQ ID NO: 11754 - RNA, 3675 nt, Artificial Sequence
  Cas13b variant__Bergeyella zoohelcum__WP_002664492.1__Cas13b
auggagaauaagaccagccugggcaacaacauauacuacaaccccuucaagccgcaggacaaguccuacuucgccggguacuucaacgcagcgauggagaacaccgacagcguguuccgcgaguugggcaagcggcugaaggggaaggaguacacguccgagaacuucuucgacgccaucuucaaggaaaacauaucccuggucgaguacgagcgcuacgugaaacuccuguccgacuacuuccccauggcccggcugcucgacaagaaggaggugcccaucaaggagcgcaaggaaaacuucaaaaagaacuucaagggcaucaucaaggccguccgggaccugcgcaacuucuacacccacaaggagcauggagagguggagaucaccgacgagaucuucggcgugcuggacgaaaugcucaagucgaccguccuaacggugaagaagaagaaggugaagacggacaagaccaaggagauccugaagaaguccauagagaagcaguuagacauccugugccagaagaagcuggaguaccucagggacaccgcccgcaaaaucgaggagaagcggcgcaaccagcgggagcgcggcgagaaagagcuggucgcgcccuucaaguacagcgacaaacgggacgacuuaaucgccgccaucuacaaugacgccuucgacgucuacaucgacaagaagaaggacucccucaaggagagcuccaaggcgaaguacaacaccaagagcgacccgcaacaagaagagggggaccugaagauccccaucuccaagaacggcgugguuuuccugcucagucuguuccugaccaagcaggaaauccacgccuucaaauccaagauugccggguucaaggccaccgugaucgacgaggccaccgugagcgaggcgacggucucccacggcaaaaacagcauuugcuucauggccacccaugagauauucucacaccucgccuacaagaagcugaaacgcaaggugaggaccgccgagaucaacuacggggaggccgagaacgcggagcaacugagcguguacgccaaggagacccucaugaugcaaaugcuggaugagcugucaaagguccccgacgugguguaccagaaccucuccgaggacguccaaaagacuuucaucgaggacuggaacgaguaccugaaagaaaacaacggcgacguggguaccauggaggaggagcaggucauacaccccguuauacgcaagagguacgaggauaaguucaacuacuucgccauccgcuuccucgacgaguucgcccaguuuccgacccuccgguuccaggugcaucuagggaacuaccugcacgacagcaggccgaaggagaacuugaucuccgaccggcgcaucaaagagaagaucaccgucuucggccgccugagcgagcuggagcacaagaaggcccucuucaucaagaacacggagaccaacgaggaccgggagcacuacugggagaucuucccuaaccccaacuacgauuucccgaaggagaacaucuccguaaacgacaaggacuuucccaucgcggggagcauccuggaccgcgagaagcaacccguggccggcaagaucggcaucaaggucaagcugcucaaccagcaguacgugagcgagguggacaaggccgucaaggcccaccagcugaagcagcggaaggccagcaagcccuccauccagaacaucaucgaggaaaucgugccgaucaacgagagcaaucccaaggaggcgauaguguucgggggccagcccaccgccuaccugaguaugaacgacauccauagcauccucuacgaguucuucgacaagugggagaagaagaaggagaaacuggagaagaagggggagaaagagcugaggaaggagaucggcaaagagcucgagaagaagaucgucgggaagauacaagcccagauccagcagaucaucgacaaggacaccaacgcaaagauccugaagcccuaccaggacggcaacuccacggcgaucgacaaggagaagcugaucaaggaccugaagcaggagcagaacauccuccagaagcugaaggacgagcagaccgugcgggaaaaggaguacaacgacuucaucgcguaccaggacaagaaucgcgagaucaacaaggugcgggaccgcaaccacaagcaguaccugaaggacaaccucaagcggaaguacccggaggcccccgcccgcaaggaggugcuguacuaccgggaaaaagguaagguggccguguggcuggcgaacgacaucaagcgcuucaugcccacggacuucaagaacgaguggaagggggagcagcacagccuacugcagaagucacuggccuacuaugagcagugcaaggaggaacucaagaaccugcugcccgaaaaggucuuccagcaucucccguuuaagcugggcggguacuuccagcaaaaguaccuguaucaguucuacacguguuaucucgacaagcggcuggaauauaucagcggccuggugcagcaggccgagaacuucaaguccgagaacaagguguucaagaaggucgagaacgagugcuucaaguuccucaagaagcagaacuauacgcacaaggagcuggacgcccgcgugcagagcauccugggguacccaaucuuccucgagcggggcuucauggacgagaagcccacuaucaucaagggcaagaccuucaaggggaacgaggcccuguucgcggacugguuccgcuacuacaaggaguaccagaacuuccagaccuucuacgacacggagaacuacccccucguggagcucgagaaaaagcaggccgaccggaagcgcaagaccaagaucuaccagcagaagaagaacgaugucuucacucugcugauggccaagcacaucuucaaguccguguucaagcaggacagcaucgaccaguucagccucgaggaccuguaccagucccgggaggagagacugggcaaccaggagagggcccggcagaccggggagcgcaacacgaacuacaucuggaacaagacgguggaccucaaacugugcgacggcaagaucaccgucgagaacguaaaacugaagaacgugggggacuucaucaaguacgaguacgaccagcgggugcaggccuuccucaaguacgaggagaacaucgaguggcaagcguuccugauaaaggagagcaaggaggaggagaacuacccguacgugguggagagggagauugagcaguacgagaaggucagacgagaggagcuucucaaagaggugcaccugaucgaggaguacauccuggagaaggugaaagacaaggagaucuuaaagaagggcgacaaccagaacuucaaguacuacauccugaacggccugcucaagcagcugaagaacgaagacgucgaguccuacaagguguucaaccugaacaccgagcccgaggacgucaacaucaaccaguuaaagcaggaggcuaccgacuuagagcagaaagccuuugucuuaacguacauccggaacaaguucgcccacaaccagcuucccaagaaggaguucugggacuacugccaggaaaaguauggcaagaucgagaaggagaagacguacgcggaguacuucgccgagguguucaagaaggagaaagaagcccugaucaaguga

SEQ ID NO: 11755 - RNA, 3675 nt, Artificial Sequence
  Cas13b variant__Bergeyella zoohelcum__WP_002664492.1 modified__Cas13b(R116A,H121A,R1177A,H1182A)
auggagaauaagaccagccugggcaacaacaucuacuauaaccccuucaagccgcaggacaaguccuacuucgccggguacuucaacgccgcgauggaaaacaccgacagcguguuccgcgagcucggcaagcgguugaaggggaaggaguacacguccgagaacuucuucgacgccaucuucaaggagaacaucagccuggucgaguacgagcgcuacgugaagcuccuguccgacuacuuccccauggcccggcugcucgacaagaaagaggugcccaucaaggagcgcaaggagaacuucaagaaaaacuucaagggcaucauaaaggccguccgggaccuggccaacuucuacaccgcgaaggagcauggggagguggagaucaccgacgagaucuucggcgugcuggacgagaugcucaagagcaccguccugacggugaagaagaagaagguaaagaccgacaagaccaaggagauccugaagaaguccaucgagaagcagcucgacauccugugccagaagaagcuggaguaccuccgcgacaccgccaggaagaucgaggagaagcgcaggaaccagcgcgagcggggcgagaaggagcuggucgcccccuucaaguacagcgacaagcgcgacgaccucaucgcagcgaucuacaacgacgccuucgacguguacaucgacaagaagaaggacucccucaaggagagcucuaaggccaaguacaacaccaagagcgacccgcagcaggaggagggggaccugaagauccccaucuccaagaacggcguggucuuccugcucagccuguuccuuaccaagcaggagauccacgccuucaaguccaagaucgccggguucaaggcgaccgugaucgacgaggccaccgugagcgaggccacggucucccacggcaagaacagcaucugcuucauggccacccacgagaucuucucccaccucgccuacaagaagcugaagcggaaggugcgcaccgcggaaaucaacuacggggaggccgagaacgccgagcagcucagcgucuacgccaaagagacccucaugaugcagaugcuggacgagcugagcaagguccccgacgugguguaccagaaccucuccgaggacguccagaagacguucaucgaggacuggaacgaguaccugaaggagaacaacggcgacgugggcaccauggaggaggagcaggucauccaccccgugauccggaagcgcuacgaggacaaguuuaacuacuucgccauccgguuccuggacgaguucgcccaguucccuacccuccgcuuccaggugcaccuggggaacuaucugcacgacagccggcccaaggagaaccucaucuccgaccgccggaucaaggagaagaucacggucuucggccgccugagcgagcuggagcacaagaaagcccucuucaucaaaaacacggagaccaacgaggaccgcgagcacuacugggagaucuuccccaaccccaacuacgacuucccaaaggagaauaucuccgugaacgauaaggacuuccccaucgccgggagcauccuggaccgggagaagcagcccguggccggcaagaucggcaucaaggucaagcugcucaaccagcaguacguguccgaggucgacaaggccgucaaagcgcaccagcugaagcagcgcaaggcaagcaagcccucaauccagaacaucaucgaggagaucgugccgaucaacgagaguaaccccaaggaggccaucguguucgggggccagcccaccgccuaccuguccaugaacgacauccacagcauacucuacgaguucuucgacaagugggagaagaaaaaggagaaacucgagaagaagggggagaaggagcugcggaaggagaucggcaaggagcuagagaagaagaucgucgggaagauccaggcgcagauccagcagaucaucgacaaagacacgaacgccaagauccugaagcccuaccaggacggcaacuccacggccaucgacaaggagaagcugaucaaggaccugaagcaggaacaaaacauccuccagaagcugaaggacgagcagaccgugcgcgagaaggaguacaacgacuucaucgccuaccaggacaagaaccgggagaucaacaaggugcgcgaccggaaccacaagcaguaccuuaaggauaaccucaagcgcaaguacccggaggcccccgcgcggaaggagguccuguacuaccgcgagaaaggcaagguggccguguggcuggccaacgacaucaagcgguucaugcccaccgacuucaagaacgaguggaagggggagcagcacagccuccugcagaagucccuggccuacuacgagcagugcaaggaggagcucaagaaccugcugcccgagaaggucuuccagcaccucccguucaagcugggcggguacuuccagcagaaauaccucuaccaguucuacacgugcuaccucgacaagcgccuggaguacaucagcggccuggugcagcaggccgagaacuucaaguccgagaacaagguauucaagaaggucgagaacgagugcuucaaguuccugaagaagcagaacuacacgcacaaggagcuggaugcgcgggugcagagcauacugggguaccccaucuuccucgagcgcggcuucauggacgagaagcccaccaucaucaagggcaagaccuucaaggggaacgaggcccuguucgccgacugguuucgauacuacaaggaguaccagaacuuccagaccuucuacgacacggagaacuacccccugguugaguuagagaagaaacaggccgaccgcaagcggaagaccaagaucuaccagcagaaaaagaacgacgucuucaccuugcugauggccaagcauaucuucaaguccguguucaagcaggacagcaucgaccaguucagccucgaggaccuguaccagucccgcgaggaacggcuuggcaaccaggagcgcgcgcgccagaccggggagcggaacacgaacuacaucuggaacaagaccguggaccucaagcugugcgacggcaagaucaccgucgaaaacgugaagcugaagaacgugggggacuucaucaaguacgaguacgaccagcgcguccaggccuuccucaaguacgaggagaacaucgaguggcaggccuuucugaucaaggagagcaaggaggaggagaacuacccguacgugguggagcgggagaucgagcaguacgagaagguccgccgggaggaacugcucaaggaggugcaccugaucgaggaguacauccuggagaaggugaaggacaaggagauccucaagaagggcgacaaccagaacuucaaguacuacauccugaacggccugcucaagcagcugaagaacgaggacgucgaguccuacaagguguucaaccugaacaccgagcccgaggacgugaacaucaaucagcugaagcaggaggccaccgaccuggagcagaaggcauucguccugacguauaucgccaacaaauucgccgccaaccagcuccccaagaaggaguucugggacuacugccaggagaaguacgggaagaucgagaaggagaagaccuacgccgaguacuucgcggagguguuuaagaaggagaaggaggccuugaucaaguga

SEQ ID NO: 11756 - RNA, 3384 nt, Artificial Sequence; identical to SEQ ID NO: 11166
  Cas13b variant__Prevotella buccae__WP_004343973.1__Cas13b

SEQ ID NO: 11757 - RNA, 3273 nt, Artificial Sequence; identical to SEQ ID NO: 11167
  Cas13b variant__Prevotella sp.__WP_044065294__Cas13b

SEQ ID NO: 11758 - RNA, 4152 nt, Artificial Sequence
  Cas13b variant__Artificial____PspCas13b-GS-HsADAR2DD(E488Q,del984-1090)
augaacauccccgcgcugguggagaaccagaagaaguacuucggcaccuacagcgucauggccaugcucaacgcgcagaccgugcuggaccacauccagaagguggccgacaucgagggcgagcagaacgaaaacaacgagaaccugugguuccacccggucaugucccaccuauacaacgcaaagaacggcuacgacaagcagcccgagaagacgauguucaucaucgagcgccugcagagcuacuuccccuuccugaagaucauggccgagaaccagcgcgaguacuccaacgggaaguacaagcagaacaggguggaggugaacagcaacgacaucuucgaaguccucaagcgagccuucggcguucugaaaauguaccgcgaccucaccaaugcguacaagaccuacgaagagaagcucaacgacgggugcgaguuccugacguccacggagcagccccugagcggcaugaucaacaacuacuacaccguggcccuccggaacaugaacgagcguuacggcuauaagaccgaggacuuggccuucauccaggacaagcgguuuaaguucgucaaggacgccuacgggaagaagaagucccaggugaauacuggcuucuuccugagccuccaggacuacaacggugacacgcagaagaaacugcaccuguccggcguggggauugcgcuccugauaugccuguuccucgacaagcaguacaucaacaucuuccugagccgccugccgaucuucuccucauacaacgcccaguccgaggagcggcgcaucaucauacggagcuucggcaucaacuccauuaagcuccccaaggaccgcauccacucggagaaguccaacaagagcguugccauggacaugcugaacgaggugaagcggugucccgacgagcuguucaccacccucuccgccgagaagcagagccgcuuccggaucaucagcgacgaccacaacgagguguuaaugaagcgcuccagcgaccgguucgucccccugcuccugcaguacaucgacuacgggaaacuguucgaccacauccgcuuccacgugaacaugggaaagcuccgguaccugcugaaagccgacaagaccugcaucgauggccagacgcgcgugcgggucaucgagcagccgcucaacggguuuggucgccuggaggaggcggaaaccaugcguaagcaggagaacggcaccuucggcaacuccggcauccggauccgcgacuucgagaacaugaagcgagacgacgccaaccccgcgaacuaccccuacauuguggacaccuacacgcacuacauccuggagaacaacaagguggagauguuuaucaacgacaaggaggacagcgcgcccuuacugccagucaucgaggacgaccgcuacguggugaagaccauccccuccugccggaugagcacacuggagauacccgccauggccuuccacauguuccucuucggguccaagaagaccgagaaacugaucgucgaugugcacaaccgcuacaaacggcuguuccaggccaugcagaaagaggaggucacggccgagaauaucgccagcuucggcaucgccgaguccgaccucccccagaagauccuggauuuaaucagcgggaacgcgcauggcaaggacguggacgccuucauccgccucaccguggacgacaugcuaaccgacaccgagcggcgcaucaagcgguucaaggacgaccgcaaguccauccggagcgccgacaacaaaaugggcaagcgcggguucaagcagauuuccacgggcaagcuggccgacuuccuggccaaggacaucguccucuuccagccgagcguuaaugacggggaaaacaagaucaccggucugaacuaccggaucaugcaguccgcgaucgccgucuaugauagcggggacgacuacgaggccaagcagcaguucaagcugauguucgagaaggcccgccucaucggcaagggcaccaccgagccccacccuuuccuauacaaggucuucgcacgguccaucccagcaaacgccguggaguuuuacgaacgcuaccugaucgagcggaaguucuaccucacagggcugagcaacgagauaaagaaaggaaaccgcguggacgucccauucauccgccgggaccagaauaaguggaagacccccgcaaugaagacccugggucgcaucuauuccgaggaccuccccgucgagcugccccggcaaauguucgacaacgagaucaagagccaccucaagagccucccgcagauggagggcaucgacuucaacaacgcaaacgugaccuaccugaucgcggaguacaugaagcgcguccuugaugacgacuuucagacguucuaccaguggaaccggaacuaccguuauauggacaugcucaagggggaguacgaucggaagggcucccugcagcacugcuucaccagcguggaggagcgcgagggccuguggaaggagcgggccucccgcaccgagcgguaccgcaaacaggccagcaacaagauccgguccaaccgccagaugcggaacgccagcuccgaggagaucgagaccauccucgacaagcgccugagcaacucccggaacgaguaucagaaguccgagaaggugauccgccgguaccgcgugcaggacgcccugcuuuuccuacuggcgaagaagacguuaaccgagcuggccgacuuugacggggagcgguucaagcugaaagagauuaugcccgacgccgagaagggcauccugagcgagauuaugccgaugagcuucacauucgagaagggcggcaaaaaguacaccaucaccuccgagggaaugaagcuaaagaacuauggggacuucuucgugcuggccucugacaagcgcaucgguaaccucuuagaacugguuggguccgacaucgucagcaaggaggacggaucucuccaacugcccccucuggagcgccucacgcuggggagccagcugcaccucccccaagugcuggccgacgcggugagccggcugguccucggcaaguucggugaccugaccgacaacuucuccagcccccacgcccgccggaaggugcuggcugggguggucaugaccaccggcacggacgugaaggacgccaaggugaucuccguguccaccgggaccaagugcaucaacggcgaguacauguccgaccgcgggcuugcgcugaacgacugucacgccgaaaucauaagccggcguucccugcuccgguuccuauacacccagcuggagcuguaccugaacaauaaggacgaccagaagcgcagcaucuuccagaaguccgagcggggcggcuuccgccugaaggagaacgugcaguuccaccuauacaucagcacguccccgugcggggacgcccggauuuucagcccccacgagcccauccuggaggagcccgccgaccgccacccgaaccggaaggcccgcggccagcugcggaccaagaucgaguccgggcaggguaccauccccguccgcagcaacgcuuccauccagaccugggacgggguccuccaaggggagcggcugcugacgaugagcugcuccgauaagaucgcccgcuggaacguggugggcauccagggcagccuccugucaaucuuuguugagccaauauacuucagcagcaucauccugggcucccucuaccacggggaccaccugagccgggccauguaccagcgcauuuccaacaucgaggaccugcccccgcuguacacccugaacaagccacugcuaagcggcaucuccaaugcagaggcccgccagcccgggaaggcgccgaauuucagcgugaacuggaccgugggcgacuccgcuaucgaggucaucaacgccaccaccggcaaggacgagcuggggcgggccagccgccugugcaagcacgcccuauacugccgguggaugcgcgugcacggcaaggugccgucccaccuccugcggagcaagaucaccaagcccaacgucuaccacgaguccaagcuggcggccaaggaguaccaggccgccaaggcgcgacuguuuaccgccuucaucaaggcgggucugggcgccuggguggagaagcccaccgagcaggaccaguucagccucacguga

SEQ ID NO: 11759 - RNA, 4152 nt, Artificial Sequence
  Cas13b variant__Artificial____PspCas13b-GS-HsADAR2DD(E488Q,T375G,del984- 1090)
augaacauacccgcccugguggaaaaccagaagaaguacuucggcaccuacagcgucauggcuaugcugaacgcgcagaccgugcuggaccacauacagaagguagccgacaucgagggggagcaaaacgagaacaaugagaacuuaugguuccacccggucaugucccaccucuacaacgccaagaacggauacgacaagcagcccgagaaaacgauguucaucaucgagcgccugcagagcuacuuucccuuccugaagauaauggcagagaaccagcgugaguacuccaacgggaaguacaagcaaaaccgcguggaggucaacagcaacgauaucuucgagguacucaaacgggccuucggcgugcucaagauguaccgcgacuuaaccaacgcguacaagaccuacgaggagaagcucaaugacgggugcgaguuccugaccuccacggagcaaccacugucugggaugaucaacaauuacuacaccguggccuuaaggaauaugaaugagcgcuacggguauaagaccgaggacuuagccuucauccaggacaagcgguucaaguucgucaaggacgccuacgggaagaagaagucccaggugaacaccggcuucuuccugagccuccaggacuacaacggggacacgcagaaaaagcuccaccuguccggcgugggaaucgcgcuccugauaugccuguucuuggacaagcaguacauuaauaucuuucugucgcgccugccgaucuucuccuccuauaaugcccaguccgaggaacggcgcaucaucauccggucuuucggcaucaacuccaucaagcuccccaaagaucgaauccacagcgagaaauccaacaagagcgucgcuauggacaugcugaacgaggugaagcggugucccgacgagcuguuuaccaccuugagcgccgagaagcagagccgcuuccggauuaucagcgacgaccacaacgaggugcugaugaagcgcuccagcgaucgguucguccccuugcuccugcaauacaucgacuacggcaagcuguucgaccacauccgcuuccacgugaacauggggaaguugcgguaccugcugaaggccgacaagaccugcaucgacggacagacccgcgugcgggucaucgaacagccgcucaacggguucggccgucuagaggaagcggagaccaugcgcaagcaggagaacggcaccuuugggaacuccggcauccggauccgcgauuucgagaacaugaagcgggacgacgcgaaucccgcgaacuaccccuacauuguagacaccuacacgcacuacauccuggagaacaacaagguggagauguucaucaacgacaaggaggacagcgcgccccuccugccggugaucgaggacgaccgcuacguggugaagacuauccccuccugccggaugagcacucuggagauuccggccauggcauuccacauguuccucuucgguuccaagaaaaccgagaaacugaucgucgacgugcacaaccgcuacaagcggcuuuuccaggccaugcagaaggaagaggugacggccgagaacaucgccagcuucggcaucgcagaguccgaucugccccaaaagauucuggaccugaucagcgggaacgcacacgguaaagacguggacgccuucauccgccucaccguggacgacaugcugaccgacaccgaacggcgcaucaagcguuucaaggacgacaggaaguccauccgcucggccgacaacaagaugggcaagcgcggcuucaagcaaauuuccacgggcaagcuggccgauuuccuggccaaggauaucguccucuuccagcccagcgugaacgacggggaaaacaagauaaccggccuuaacuaccggaucaugcaguccgcgaucgcaguguacgacagcggggaugauuacgaggccaagcagcaguucaagcugauguucgagaaggcccgccucauaggcaaggggaccaccgagccccacccuuuucuguacaaggucuucgcgcggucuauacccgccaacgccguggaguucuacgagcgcuaccugaucgagcggaaguucuaccuaacggggcuaucaaacgagaucaagaagggaaaccgcguagaugucccguucauacgccgggaccagaacaaguggaagacccccgccaugaagacccugggacgcaucuacuccgaggaccucccgguggaacucccccggcagauguucgacaacgagaucaaaagccaccucaagagccucccgcagauggagggcaucgacuucaacaacgcuaacgugaccuaccugaucgcggaguacaugaaacgcguccuggacgaugacuuccagacguucuaccaguggaaccggaacuaccgcuacauggacaugcuuaagggggaguacgacagaaagggcucccugcagcacugcuucacgucaguggaggagcgcgaggggcuguggaaggagcgggccuccagaaccgagcgguaccgcaagcaagccagcaacaagauccgguccaaccgccaaaugcggaacgccagcucggaggagauagagaccauccucgacaagcgccugagcaacucccguaacgaguaccagaaguccgaaaaggugaucagacgguaccgcguccaggacgcccuguuauuccugcuggcgaagaagacgcucaccgagcuggcggacuucgacggggagcgcuucaagcuaaaggagauaaugcccgacgccgagaagggcauccucagcgagaucaugccuaugagcuucaccuucgagaagggcgggaagaaguacaccaucaccuccgagggcaugaagcugaagaacuacggggacuucuucgugcuugccagcgacaagcgcauuggcaaccuccuggagcuggugggguccgacaucgucagcaaggaggacggcucccuccaacugcccccgcuggagcgccucacgcuugggagccagcugcaccucccccaagugcuggccgacgcggugagccgguugguucucggcaaguuuggcgaccugaccgacaacuucuccagcccccacgcccgacggaagguguuagccgggguggucaugaccaccggcacggacgugaaggacgcgaaggugauauccgucagcaccggcgggaagugcaucaacggggaauauauguccgaccgcgggcucgcgcugaacgacugccacgccgagaucaucagccggcgcucccugcuccgguuccuguacacccagcuggagcucuaucugaacaacaaggacgaccagaagcgcagcaucuuccagaaguccgagcgcggcggauuccgcuugaaagagaacgugcaguuccaccuuuacaucagcaccuccccgugcggagacgcgcggaucuucagcccccacgagcccauccuggaggagcccgcugaccgccacccgaacaggaaggcccgcggccagcugagaacgaagaucgagagcggccaggggaccauucccgugagaagcaacgcgucaauccagaccugggacggcguccuccagggcgagcggcugcugacaaugagcuguucagacaaaaucgcccgauggaacgugguggguauccagggcucacuccuguccaucuucguagagcccaucuacuucagcucgaucauccuggggucccucuaccauggggaucaccugucgcgggcgauguaccagcgcaucucgaauaucgaggaccugcccccacucuacacgcugaacaagccccugcucucggggauuuccaacgccgaggcgcgucaacccggcaaggcgcccaacuucucaguaaacuggaccgugggugacuccgccaucgaggucaucaacgccaccaccgggaaagacgaauuaggccgggcaucccgccucugcaagcacgcacucuauugccgguggaugcgcgugcacgggaaggugccgucccaccuccuucggagcaagaucacgaagcccaaugucuaucacgaguccaagcuggccgccaaggaguaccaggccgccaaggcgcgccuguucaccgccuucaucaaggccggccucggugccuggguggaaaagccaaccgagcaagaccaguuuucuuuaaccuga

SEQ ID NO: 11760 - RNA, 2862 nt, Artificial Sequence
  Cas13b variant__Alistipes sp.__WP_047447901.1__Cas13b
auguccaacgagaucggggccuuccgggaacaccaguucgcguacgcgcccgguaacgagaagcaagaagaggccaccuucgccacguacuucaaccuagcacuauccaacgucgaaggcaugauguucggggaagucgaaagcaaccccgauaaaauugagaaaagccucgacacacuacccccggcaauccuccggcaaaucgcgagcuucaucuggcucagcaaagaagaccacccugacaaagcauacucuaccgaggaaguaaaggucauugugaccgaccuaguccgucgccucugcuucuacagaaacuacuucucgcacugcuuuuaucuagacacccaguacuucuacagcgacgagcuaguagacacaacagcaauaggggaaaaacugccauacaacuuccaccacuucauaacaaaucgacuauuccgcuauucgcuuccugaaaucacccucuuccgcuggaacgaaggcgaacguaaauacgaaauacuucgcgacggccucaucuuuuucugcugucuauuccucaaacgaggccaagcagaacgguuccucaacgaacuccgcuucuucaaacggacggacgaagaaggucgcauaaaacgcaccauauucacaaaauacugcacacgagaaucccacaagcauauugggauagaagaacaggacuuccuuauauuccaagacauaauaggagaccucaaccgcguccccaaaguuugcgacggcguaguagaccucagcaaagaaaacgaacgguacaucaaaaauagagaaacgucaaacgaauccgaugaaaacaaagcacgcuacagacuccuaaucagagaaaaggacaaauucccguauuaccucaugcgcuacauugucgacuucggcgugcuccccugcauaacauuuaagcaaaacgacuacucaacuaaggaaggccguggccaauuccacuaccaggacgcagcgguagcccaagaggaaagaugcuacaacuucgucgucagaaacgguaacguguacuauagcuacaugccccaggcacaaaacguaguuagaauaagcgagcugcaagggaccaucagcguugaagaacuacgcaauauggucuacgccagcauaaacggcaaagacguaaacaaguccguagagcaauaccuauaccaccuccaccuccuuuacgagaaaauccugacaaucucaggccagaccauaaaagaaggacgggucgacgucgaagacuaccgcccacuccuagacaaacuacuccuaagacccgccagcaacggcgaagaacuccgccgcgaacuacgcaaacuccucccaaagcgcguuugcgaccuucuuuccaacagguucgacugcagcgagggcgugucagcgguagaaaaacgccucaaagcaauacuacuccgucacgaacagcuccuucucucacagaaccccgcgcugcauauagacaaaaucaaaagcgucaucgacuaucucuaccuauucuucagcgacgacgaaaaauucagacaacaacccacagagaaagcccaccgaggccuaaaagacgaagaguuccagauguaccacuaccuagucggagacuacgacucacaucccuuagcccucuggaaagaacuggaagccuccggcagacucaagccggagaugcgaaaacuaaccuccgccacgucacuccacggacuauacaugcucugccuaaagggcaccguagaauggugucgcaaacaacugaugucaaucggcaaaggcacggcuaaagucgaagccauagcagacagaguaggccuaaaacuuuacgauaaacugaaagaauacacccccgaacagcucgaacgggaagucaagcuagucgugaugcacggauacgccgccgcugcgaccccaaaaccuaaagcucaagcagcaauaccaagcaaacugaccgagcuccgcuucuauagcuuccucggcaaacgggaaaugagcuucgccgccuuuaucaggcaggacaagaaagcacaaaaacucuggcuccgcaauuucuacaccguagagaacauaaaaacccuacagaaaagacaagcggcagcagacgcggccugcaaaaagcuauacaaucuagucggugaaguugagagaguucacaccaaugacaagguccucguccuaguagcacaacgauacagagaaagacugcugaacgucggcucgaaaugcgccgugacacuagacaacccagagcgccaacaaaagcuggcggauguguaugaaguccagaacgccuggcucagcauccgguucgacgaccucgacuucacacugacgcacgucaaccucuccaaccucagaaaagcauacaaccuaauaccacggaaacacauccuagccuucaaggaauaccuagacaaccgggucaagcaaaaacucugugaagaaugccgcaacguccggcgaaaggaggaccucugcaccuguugcuccccgcgauacuccaaccugacauccugguuaaaagagaaccacucggaauccucgaucgagcgcgaggcagcaaccaugaugcuccuggacgucgaacgaaagcuacucagcuuccugcuagacgagcgaagaaaagcgaucaucgaauacggcaaauucauaccauucagcgcccuaguuaaggagugcaggcuugcagacgcaggccuauguggaauccgaaacgacguacuccacgauaacgucauuuccuacgccgacgccaucggcaaacuaagcgccuacuuccccaaagaagccucagaagcagucgaguacauccgacgaacaaaagaaguccgcgaacaacgccgcgaggaacugauggccaauucaagucaauag

SEQ ID NO: 11761 - RNA, 3348 nt, Artificial Sequence
  Cas13b variant__Bacteroides pyogenes__ERI81700.1__Cas13b
auggagagcaucaagaacagucagaaguccaccggcaagacccugcagaaggacccacccuacuucgggcuuuaccugaauauggcacugcucaacgugcgcaaagucgagaaccacauccggaaguggcuaggagacguggcccugcuacccgagaaguccggguuccacagccugcugacgacugacaaucucagcagcgcgaaguggacccgcuucuacuauaaaucccguaaguuccugcccuuccuggagauguucgacagcgacaagaagucguacgagaaccgccgggagaccacggagugccucgacaccaucgaccgccagaagaucagcagccugcugaaggagguguacggcaaacuccaggacauccgaaacgccuucagccacuaccacaucgacgaccaguccgugaagcauaccgcucugaucaucagcuccgagaugcaucgcuuuaucgagaacgccuacagcuucgcccuacagaagacacgggcuagguuuacagggguauucguggagaccgacuuccuccaggccgaggaaaagggugacaacaaaaaguucuucgccaucggcgggaacgagggcaucaagcugaaggacaaugcccugaucuuccucaucugucuguuccuggaccgggaggaggccuucaaguuccucucgcgcgcgaccggguucaagucgaccaaggagaagggcuucuuagccguccgggagacguuuugcgcccugugcugccgccagccgcacgagaggcuccuguccgugaacccgcgcgaggcccugcucauggauaugcugaacgagcugaaccggugccccgacauucucuucgagaugcuggacgagaaggaccagaaguccuuccugccccuccugggcgaggaggagcaggcgcacauccuggagaacagccucaacgacgagcugugcgaggccaucgacgaccccuucgagaugaucgccagccugagcaagcgcgugcgguauaagaaccgcuucccguaccucaugcugcgguacaucgaggagaagaaccuacuccccuucauccgcuuccgcaucgaccugggcugccuggagcucgccuccuaccccaagaaaaugggcgaggagaacaacuacgagcggagcgucaccgaccacgccauggcguucgggaggcugaccgauuuccacaacgaggaugccgugcugcagcagauaaccaagggcaucacggacgagguucgguucucccuguacgcgccgcgcuacgcuaucuacaacaacaagaucggguucguccggaccggcggcuccgacaagauauccuuuccaacccucaagaagaagggaggggaggggcauugcguggccuacacccugcagaacaccaagagcuucggcuucaucuccaucuacgaucuccggaagauccuccugcuguccuuccucgacaaggacaaagccaagaacauuguguccgggcugcuggagcagugcgaaaagcacuggaaagaucucagcgagaaccuguucgacgccauccggaccgagcugcagaaggaguuccccgucccucucauccgcuacacccugccccgguccaagggcggcaagcuggugagcucgaagcucgccgacaagcaggagaaguaugagagcgaguucgaacgccggaaggagaaacugaccgagauccuguccgagaaggacuucgaccucagccagaucccgcgacggaugaucgacgaguggcugaacguguuacccacgagccgcgagaagaagcugaagggguacgucgagacccugaaacuugacugccgggaaagacuccggguguucgagaagcgcgaaaagggcgagcaccccgugcccccgcggaucggggagauggccaccgacuuggccaaggacaucauccgcaugguuaucgaccaaggcgugaagcagcgcaucacaagcgcguacuacagcgagauccaacggugccuggcccaguacgccggggacgacaaccgccgccaccucgacuccauuauccgcgagcuucggcugaaggacacgaagaacggccaccccuuccucggcaaggugcugcggcccgggcugggccacacggagaaacuuuaccagcgguacuucgaggagaagaaggaguggcucgaggccaccuucuacccagccgccagcccgaagcgcgucccccgguucguuaacccgcccaccgggaagcaaaaagagcugccccucaucaucagaaauuugaugaaggagcggcccgaguggcgcgacuggaagcagcggaagaacucccacccaaucgaucugccgagccagcuguucgagaacgagaucugccgccuucugaaggacaagauugguaaggagcccuccgggaagcugaaguggaaugagauguucaagcuguauugggacaaggaguuccccaauggcaugcagcgguucuaccgcugcaagcggcgcgucgagguguucgauaagguggucgaauacgaguacagcgaggagggcgguaacuacaagaaguacuacgaagcccugaucgacgagguggugcggcagaagauauccagcuccaaagagaaguccaagcuccaggucgaggaccugacgcugagcguccgccggguauucaagagggccaucaacgagaaggaguaccagcuccgccugcugugcgaggacgaccggcuccuguucauggccguccgcgaccuguacgacuggaaggaggcacagcucgaucuggacaagaucgacaacaugcuaggugagcccgugagcgugucccaagucauacaacucgagggcgggcagccugacgcaguuaucaaggcggagugcaagcugaaggacgugucgaagcugaugcgguacugcuacgacggccgcgucaagggacucaugcccuauuucgcaaaccaugaggccacccaggagcaggucgagauggaacuaagacacuacgaggaccaccgccggcgcguuuucaauuggguguucgcgcuggagaaguccgugcucaagaaugagaagcugcggcgcuuuuacgaggagucccagggcgggugcgaacauaggcgcugcaucgacgcccugcgaaaggccucccucgugagcgaggaggaguacgaguuccugguccacauccgcaacaagagcgcgcacaaccaguuccccgacuuagaaauaggcaagcugcccccgaacgugaccuccggguucugcgaguguaucuggagcaaguacaaggccaucauaugucggaucauacccuuuaucgaucccgagcggcgguucuucgggaaacuucuggagcagaaguga

SEQ ID NO: 11762 - RNA, 3348 nt, Artificial Sequence
  Cas13b variant__Bacteroides pyogenes__WP_034542281.1__Cas13b
auggaaagcauaaagaacucucagaaaucaaccggaaaaacccuccaaaaggacccgcccuacuucggacuauaccuaaacauggcacuccuuaacguccgaaaagucgaaaaccacaucaggaaauggcuuggagaugucgcccuacuccccgaaaaaucgggcuuccacuccuuguuaacuacagacaaccucagcagcgccaaguggacacguuucuacuacaaaucccgcaaauuccuacccuuccuggaaauguucgacagcgacaagaaaucguacgaaaaccgccgcgaaacggccgaaugccucgacacgaucgaccgacagaaaauaagcucacuacucaaagaaguguacgggaagcuccaagacauucgcaacgccuucucacacuaccacaucgacgaccaauccgugaagcacaccgcccucaucauaagcagugagaugcaccgauucaucgaaaacgcauacuccuucgcacuccagaaaacucgggcacgcuuuacgggggucuucgucgaaacggacuuccuacaagcagaagaaaaaggagacaacaagaaguucuucgccaucggaggaaacgaaggcauaaagcucaaagacaacgcccucaucuuccuaaucugucuauucuuggaccgcgaagaggcauucaaguuccugagccgcgcaacaggcuucaaauccaccaaagaaaaaggcuuccucgcugugcgugaaaccuucugcgcacucugcugccgccaaccacacgaacgacugcuguccgucaacccacgugaagcacuacucauggacaugcucaacgaauuaaaccgaugcccagacauuuuauucgaaaugcucgacgaaaaagaccaaaaaucauuucucccccuccucggagaagaagaacaagcccacauacucgagaacucacucaacgacgaacuaugugaagccaucgacgaccccuucgagaugaucgcaucacuuuccaaacguguuagguacaaaaaccgcuucccguaccucauguuacgcuacauagaggagaaaaaccuucugcccuucauacgcuuccguaucgaccuagggugccucgaacucgcaucauaucccaagaaaaugggagaagaaaacaacuacgaacgcucagucacugaccacgccauggcguucggccgccucacagacuuccacaacgaagaugcuguccuacaacagauuaccaaaggcauuacagacgaaguccgcuucucacucuacgcaccccgcuacgccaucuacaacaacaagaucggcuucguccggacaaguggcucugacaaaaucagcuuuccaacacucaaaaagaaaggcggcgaaggccacugcguagccuacacccuacaaaacacaaagagcuucgguuuuauaagcaucuaugaccuuagaaaaauucuccuccugagcuuccucgauaaagacaaggcaaagaacaucgucuccggccuacucgaacagugcgaaaagcacuggaaggaccucucggaaaaccuauucgacgcgaucagaaccgaacuccaaaaagaguuccccgugccgcuaauccgcuauacccuaccccgcuccaagggcgguaaacuugucagcuccaagcucgccgauaagcaagagaaauacgaaagcgaguucgaacgccgcaaagaaaaacuaaccgaaauacucucggaaaaagacuucgaccucucccagauuccccgacgaaugauagacgaauggcuuaauguacugcccacaucacgcgaaaagaaacucaaaggcuacgucgagacgcuaaaacucgacugccgcgagcgccuccgcgucuucgagaaacgcgaaaaaggagaacacccccuacccccaagaauuggagaaauggccacggaccucgcaaaagacaucauaaggaugguaaucgaccaaggagugaaacaaagaaucacguccgccuacuacagcgagauccagcggugccuagcccaauacgcuggcgacgauaaccggcgccaccuagauucaaucauccgggaacuaaggcugaaagacaccaagaacggucacccauuccugggcaagguccuacggccaggacugggccauacagaaaagcuauaucaacgcuacuucgaggaaaagaaagaguggcuugaggcgaccuucuaccccgccgccagcccaaaacgcgugccacguuuuguaaaucccccaaccggcaaacaaaaggagcucccccuaauaauacggaaccucaugaaagaacgcccagaguggcgcgacuggaaacaacggaaaaacucacaccccaucgacuuacccucacagcuauuugaaaacgagauaugccgacuccuaaaagacaagauaggcaaagaacccagcggcaaacugaaauggaacgaaauguucaaacuguacugggacaaagaguuccccaacggcaugcaacgauucuaccggugcaaacgaagaguagaagucuucgacaaaguaguagaauaugaauacucagaggaaggcgggaacuacaagaaguacuacgaagcacuaauagacgaagucguaagacagaaaauuuccagcuccaaagagaaaagcaagcuacaaguagaagaccuaacccucagcguacgacgagucuuuaaacgcgcgauaaacgaaaaagaauaccaacuacgacuccucugugaagaugaccgccuacuauucauggcaguccgagaccuauacgacuggaaggaagcacaacucgaccucgauaaaauagacaacaugcucggagagcccgucagcguaucacaaguaauccaacuggaagggggacaaccagacgcgguaauaaaagcagagugcaaacugaaggacgucuccaaauuaaugagauacugcuacgacggacgcguuaaaggccuaaugccguacuucgccaaccacgaggccacccaagaacaagucgaaauggaacucaggcacuacgaggaccaccgccgccgcguguucaauuggguauucgcgcucgaaaaauccguccucaagaacgaaaagcuccgcagauucuacgaagaaucccaagggggaugcgaacaccgacgcugcauagacgcccugcgcaaagcgucccugguaagcgaggaagaguaugaguuccuaguacacauaagaaacaaauccgcgcauaaucaauuccccgaccuugaaauaggaaagcugccgccuaacgucaccuccggcuuuugcgaaugcauauggaguaaguacaaagcgaucauaugccguauuauacccuucauugauccagaacgcagauucuucggcaaacuccuugagcaaaaguga

SEQ ID NO: 11763 - RNA, 3675 nt, Artificial Sequence
  Cas13b variant__Bergeyella zoohelcum__WP_002664492.1__Cas13b
auggagaacaagaccagccugggcaacaacaucuacuacaaccccuucaagccgcaggacaaguccuacuucgccggguacuucaacgccgcaauggagaacaccgacagcguguuccgcgagcucggcaagcggcugaaggggaaggaguacacguccgagaacuucuucgacgccauauucaaggaaaacaucagccuggucgaguacgagcgcuacgugaagcuccuguccgacuacuucccuauggcccggcugcucgacaagaaggaagugcccaucaaggagcgcaaggagaacuucaagaagaacuucaagggcaucauuaaggccguccgggaccugcgcaacuuuuacacccacaaggagcacggggagguggagaucaccgacgagaucuucggcgugcuggacgaaaugcucaagagcaccguccugacggugaagaagaagaaggugaagacagacaagaccaaggagauccugaagaagucaaucgagaagcagcucgacauccugugccagaagaagcuggaguaccuccgggacaccgcccgcaagaucgaggagaagcggcgcaaccagcgggagcgcggcgagaaggagcuggucgcucccuucaaguacagcgacaagcgggacgaccugaucgccgcgaucuacaacgacgccuucgauguguacauagacaagaagaaggacucccucaaggagagcuccaaggcgaaguacaacaccaagagcgacccgcagcaggaggagggggaccugaagauccccaucuccaagaacggcguggucuuccugcucagccucuuccugaccaagcaggagauccacgccuucaaguccaagaucgccggguucaaggccaccgugaucgacgaggccaccgugagcgaggcgacggucucccacggcaagaacagcaucugcuucauggcaacccacgaaauuuucucccaccucgccuacaagaagcugaagcgcaaggugcggaccgccgagaucaacuacggggaggccgagaacgcggagcagcugagcguguacgccaaggaaacccucaugaugcagaugcuggacgagcugagcaagguccccgacgugguguaccagaaccucuccgaggacguccagaagacguucaucgaggacuggaacgaguaccuuaaggagaacaacggcgacgugggcaccauggaggaggagcaggucauccaccccgugauccgcaagcgguacgaggacaaguuuaacuacuucgccauccgcuuccuggacgaguucgcccaguucccgacccuccgguuccaggugcaccuggggaacuaccugcacgacagccgccccaaggagaaccucaucucugaccggcggaucaaggagaagaucaccgucuucggcagacugagcgagcuggagcacaaaaaggcccucuucaucaagaacacggagaccaacgaggaccgggagcacuacugggagaucuuccccaaccccaacuacgacuucccgaaggagaacaucuccgugaacgacaaggauuuccccaucgcggggagcauccuggaccgcgagaagcaaccaguggccggcaagaucggcaucaaggucaagcugcucaaucagcaguauguguccgagguggacaaggccgucaaggcccaccagcugaagcagcggaaggccuccaagccguccauccagaacaucaucgaggagaucgugccaaucaacgagagcaaccccaaggaagcgaucguguuugggggccagcccacugccuaccuauccaugaaugacauccacagcauccucuacgaguucuuugacaagugggagaagaaaaaggagaagcuggagaagaagggggagaaggaguuacgcaaggagaucggcaaggagcucgagaagaagaucguggggaagauccaggcccagauccagcagaucaucgacaaggacaccaacgcgaagauccugaagcccuaccaggacgggaacucgacagcgaucgacaaggagaagcugaucaaggaccugaagcaggagcagaacauccuccagaagcugaaggacgagcagaccguccgggagaaggaguauaacgacuucaucgcguaccaggacaagaaccgcgagaucaacaaggugcgggaccgcaaccacaaacaguaucugaaggacaaccucaagcggaaguacccggaggcccccgcccgcaaggagguccuguacuaccgggagaagggcaagguggccguguggcuggcgaacgacauuaagcgcuucaugcccaccgacuucaagaacgaguggaagggggagcagcacagccuccugcagaagucccuggccuacuacgagcagugcaaggaggagcucaagaaccugcugcccgagaaagucuuccagcaccucccguucaagcugggcggguacuuccagcagaaguaccuguaccaauucuacacgugcuaccucgacaagcggcuggaguacaucagcggccuggugcagcaggccgagaacuucaaguccgagaacaagguguucaagaaggucgagaacgagugcuucaaguuccucaagaagcagaacuacacgcacaaggagcuggacgcccgcgugcagagcauccugggguaccccaucuuucucgagcgcggcuucauggacgagaagcccaccaucaucaagggcaagaccuucaaggggaacgaggcccuguucgcggacugguuccgcuacuacaaggaguaccagaacuuccagaccuucuacgacacggagaacuaccccuugguggagcucgagaagaagcaggccgaccggaagcgcaagaccaagaucuaccagcagaagaagaacgacgucuucacgcuccugauggccaagcacaucuucaaguccguguucaagcaggacagcauugaccaguuuagccucgaggaccuguaccagucccgggaggagcgccugggcaaccaagagcgcgcccggcagaccggggagcgcaacacgaacuacaucuggaacaagaccguggaccucaagcugugcgacggcaagaucaccgucgagaacgugaagcuaaagaacgugggggacuucaucaaguaugaguaugaccagcggguccaggccuuccucaaguacgaggagaacaucgaguggcaggcguuccugaucaaagaaagcaaggaggaggagaacuacccguacgugguggagcgcgagaucgagcaguacgagaagguccggcgcgaggagcugcucaaagagguucaccugaucgaggaguacauccuggagaaggugaaggauaaggagauccucaagaagggcgacaaccagaacuucaaguacuacauccugaacggccugcucaagcagcugaagaacgaggacguggagucauacaagguguucaaccugaacaccgagcccgaggacgugaacaucaaccagcucaagcaggaggccacggaccuggagcaaaaggccuucguccugacguacauccgcaacaaguucgcccacaaccagcuccccaagaaggaguucugggacuacugccaggagaaguacgggaagaucgagaaggagaagaccuacgcggaguacuucgccgagguguucaagaaggagaaggaggcccugaucaaguga

SEQ ID NO: 11764 - RNA, 3600 nt, Artificial Sequence; identical to SEQ ID NO: 11174
  Cas13b variant__Capnocytophaga canimorsus__WP_013997271.1__Cas13b

SEQ ID NO: 11765 - RNA, 3657 nt, Artificial Sequence; identical to SEQ ID NO: 11175
  Cas13b variant__Capnocytophaga cynodegmi__WP_041989581.1__Cas13b

SEQ ID NO: 11766 - RNA, 3438 nt, Artificial Sequence; identical to SEQ ID NO: 11176
  Cas13b variant__Chryseobacterium sp.__WP_047431796.1__Cas13b

SEQ ID NO: 11767 - RNA, 3453 nt, Artificial Sequence; identical to SEQ ID NO: 11177
  Cas13b variant__Flavobacterium branchiophilum__WP_014084666.1__Cas13b

SEQ ID NO: 11768 - RNA, 3642 nt, Artificial Sequence; identical to SEQ ID NO: 11178
  Cas13b variant__Flavobacterium columnare__WP_060381855.1__Cas13b

SEQ ID NO: 11769 - RNA, 3540 nt, Artificial Sequence; identical to SEQ ID NO: 11179
  Cas13b variant__Flavobacterium columnare__WP_014165541.1__Cas13b

SEQ ID NO: 11770 - RNA, 3642 nt, Artificial Sequence; identical to SEQ ID NO: 11180
  Cas13b variant__Flavobacterium columnare__WP_063744070.1__Cas13b

SEQ ID NO: 11771 - RNA, 3645 nt, Artificial Sequence; identical to SEQ ID NO: 11181
  Cas13b variant__Flavobacterium columnare__WP_065213424.1__Cas13b

SEQ ID NO: 11772 - RNA, 3468 nt, Artificial Sequence; identical to SEQ ID NO: 11182
  Cas13b variant__Flavobacterium sp.__WP_045968377.1__Cas13b

SEQ ID NO: 11773 - RNA, 3480 nt, Artificial Sequence
  Cas13b variant__Myroides odoratimimus__EHO06562.1__Cas13b
augaaggacauccuuacgaccgacacgaccgaaaagcaaaaccgcuucuacagccacaagaucgccgauaaguacuucuucggcggguacuucaaccucgccuccaacaacaucuacgagguguucgaggaggucaacaagcggaauaccuuuggcaagcuggcgaagcgcgacaacgggaaccugaagaacuauaucauccacguguucaaggacgaacucagcaucuccgacuucgagaagcggguggccaucuucgccagcuacuuccccauccuggagaccgucgacaaaaagagcaucaaggagcgcaaccggacgaucgaccugacccucagucaacgcauacggcaguuucgcgagaugcugaucuccuuagugaccgccguggaccagcuccggaauuucuacacccacuaccaucacagcgacaucguaaucgagaacaagguccuagauuuccucaacuccucuuuugugucuacggcacuccacgucaaggacaaguaccugaagaccgacaagaccaaggaguucuugaaggagaccaucgcggccgaacuugacauccugaucgaagccuacaagaagaagcagaucgagaagaagaacacgcgcuucaaggcuaacaagcgggaggacauccugaacgcuaucuacaacgaggccuucuggagcuucaucaacgacaaggacaaggacaaggacaaggagaccgugguggccaagggcgccgacgccuacuucgagaagaaccaccauaaauccaacgaccccgacuucgcgcucaacaucagcgagaaggggaucgucuaccugcuguccuucuuucucaccaacaaggagauggacagccugaaagccaaccugacaggcuucaagggcaagguggaccgcgaguccgggaacagcaucaaguacauggccacgcagcggaucuacuccuuccacaccuaccgcggccucaaacagaagauccgaaccagcgaggagggggugaaggagacgcugcuaaugcagaugaucgaugagcucagcaagguccccaacgugguguaccagcaccuguccacgacccagcaaaacagcuucaucgaagauuggaacgaguacuacaaggacuacgaagacgacgucgagacggacgaccuguccaggguuauccaccccgugauccggaagcgcuacgaagaccgguucaacuacuuugccauccgauuucucgacgaguucuucgacuuccccacccugcgguuccagguccaccuuggcgacuacgugcacgaccgccgcacgaagcaguuagggaagguggagagcgaccggaucaucaaggagaaggucacaguguucgcacgccugaaggacauaaacuccgcgaaggccagcuacuuccacuccuuagaggaacaggacaaagaggagcucgacaacaaguggacccuguucccgaacccuagcuaugacuuccccaaggagcacacccugcagcaccagggcgagcagaagaacgccggcaagaucgggaucuacgucaagcuccgggacacgcaguacaaggagaaggcugcccuggaggaggcgcgcaaaucccugaaccccaaggagcgaucagccaccaaggcauccaaguaugacaucaucacccagaucaucgaggccaacgacaacgucaagagcgagaagccgcucguguucacagggcagcccaucgccuaccuguccaugaacgacauccacagcaugcuguucucccuccugacggacaacgcggagcugaagaagacccccgaagaggucgaggccaagcucaucgaccagaucgggaagcaaaucaacgagauccugagcaaggacaccgacaccaagauccugaagaaguacaaggacaacgaccugaaggagacggacaccgacaagaucacccgcgaccucgccagagacaaggaggagauugagaagcuaauccuggagcagaagcagcgggccgacgacuacaacuacaccuccagcaccaaguucaacaucgacaaguccagaaagcgcaagcaccuccuauucaacgcugagaagggcaagaucggcguuuggcuggccaacgacauuaagcgguucauguucaaggagagcaagagcaaauggaagggguaccagcacacggagcuccagaaacuuuucgccuacuucgacaccuccaagucagaccuggagcucauccuguccaacauggugauggucaaggacuaccccaucgagcugaucgaccucgugaagaagucgcgcacccugguggacuuccugaacaaguaccucgaggcccggcuggaguacaucgagaacguaaucacacgcgugaagaacagcaucggcacgccgcaguucaagaccgugcggaaggagugcuucaccuuccugaagaaguccaacuacaccgucgugagccuggacaagcaagucgagcgcauccugagcaugccccuguucaucgagcggggguucauggaugacaagcccacgauguuagagggcaaguccuacaagcaacacaaagaaaaguucgccgacugguucgugcauuacaaggagaacagcaacuaccagaacuucuacgacaccgagguguacgagaucaccacggaggacaagcgcgagaaggcgaaagugacgaaaaagaucaagcagcagcagaagaacgacgucuucacgcucaugauggugaauuacaugcuggaggaggugcucaagcuguccagcaacgaccggcugucccucaacgagcuguaccagaccaaggaggagcgcaucguuaacaaacaggucgcaaaggacacccaggagcgcaacaaaaacuacaucuggaacaaagugguggaccugcagcucugcgacgggcuggugcacaucgacaacgugaagcugaaagacaucggcaacuuccguaaguacgagaacgacucacgcgucaaggaguuccucacguaccaguccgacaucgucuggucggcuuaccuguccaacgagguggacagcaacaagcuguacgucauagagcgacagcucgacaacuacgagagcauccgcaguaaggagcugcugaaggaggugcaggagaucgagugcagcguauacaaccaggucgccaacaaggagucccucaagcagagcggcaacgagaacuucaagcaguacgugcugcagggacugcugccuaucggcauggacguacgggagaugcugauccugucaaccgacgucaaguucaagaaggaggaaaucauccagcucgggcaggccggcgagguggagcaggaccuguacagccugaucuacauccgcaacaaguucgcgcacaaccagcucccgaucaaggaguucuucgacuucugcgagaacaacuaccgguccaucagcgacaacgaguacuacgccgaguacuacauggagauauuccgaucaaucaaggagaaguacgccaacuga

SEQ ID NO: 11774 - RNA, 3474 nt, Artificial Sequence; identical to SEQ ID NO: 11184
  Cas13b variant__Myroides odoratimimus__WP_006261414.1__Cas13b

SEQ ID NO: 11775 - RNA, 3474 nt, Artificial Sequence; identical to SEQ ID NO: 11185
  Cas13b variant__Myroides odoratimimus__EKB06014.1__Cas13b

SEQ ID NO: 11776 - RNA, 3480 nt, Artificial Sequence
  Cas13b variant__Myroides odoratimimus__WP_058700060.1__Cas13b
augaaggacauccugaccaccgacacgaccgagaagcagaaccgcuucuacagccacaagaucgccgacaaguacuucuucggcggauacuuuaaccucgccuccaacaacaucuacgagguguucgaggaggucaacaagcggaacacuuucggcaagcuggcgaagcgcgacaacgggaaccugaagaacuacaucauccacguguucaaggacgagcucagcaucuccgacuucgagaagcggguggccaucuucgccagcuacuuccccauacuggagaccgucgacaagaaguccaucaaggaacgcaaucggacgaucgaccugacccucagccaacgcauccggcaguuccgcgagaugcugaucucccuggugaccgccguggaccagcuccggaacuucuacacucauuaccaccacagcgacaucgucaucgagaacaaggugcuggacuuccugaacuccagcuucguguccacggcccuccacgucaaggacaaguaccugaaaaccgacaagaccaaggaguucuuaaaggagaccaucgcggccgagcuggacauccugaucgaggccuacaagaagaaacagaucgagaagaagaacacgcgcuucaaggccaacaagcgggaggacauccugaacgcgauauacaacgaggccuucuggagcuucaucaacgacaaggacaaggacaaggacaaggagaccgugguggccaagggcgccgacgccuacuucgagaagaaccaccacaaguccaacgacccggacuucgcgcucaacaucagcgagaaggggaucgucuaccugcuguccuucuuccugaccaacaaagagauggacagccugaaggccaaccugaccggcuucaaaggcaagguagaccgcgaguccgggaacagcaucaaguauauggccacgcagcggauauacuccuuccacaccuaucgcggccucaagcagaagauccggaccagcgaggagggggugaaggagacccugcugaugcagaugaucgacgagcucagcaagguccccaacgugguguaccagcaccuguccacgacccagcaaaauuccuucaucgaggacuggaacgaguacuacaaggacuacgaggacgaugucgagaccgacgaccugucccgcgugacccaccccgugauccggaagcgcuacgaagaccgguucaacuacuucgccauucgauuccucgaugaguucuucgacuucccgacgcugcgguuccagguccaccugggcgacuacgugcacgaccgccgcaccaagcagcucgggaagguggaaagcgaccggaucaucaaggagaaggucaccguguucgcccgccugaaggacaucaacuccgcgaaggccagcuacuuccacucccuggaggagcaggacaaggaggagcucgacaacaaguggacccuguucccgaaccccagcuacgacuuccccaaggagcacacgcugcagcaccagggcgagcagaagaacgccggcaagaucgggaucuacgucaagcuccgagacacgcaguacaaggagaaggccgcccuggaggaggcgcgcaagucccugaaccccaaagagcggagcgccaccaaggccucgaaguacgacaucaucacccagaucaucgaggccaacgacaacgucaagagcgagaagccgcucguguuuacgggccagcccaucgccuaccuguccaugaacgacauccacagcaugcuguucucccuccugaccgacaacgcggagcugaagaagacacccgaggagguggaggccaagcucaucgaccagaucgggaagcagaucaacgagauccugagcaaggacaccgacacuaagauccugaagaaguacaaggacaacgaccugaaggagaccgacaccgacaagaucacccgcgaccucgcccgggacaaggaggagaucgagaagcugauccuggagcagaagcagcgcgccgacgacuacaacuacaccaguagcacgaaauucaacaucgacaagucccggaagcgcaagcaccuccuguucaacgcggagaagggcaagaucgggguguggcuggccaacgacaucaagcgguucauguucaaggagagcaagagcaaguggaagggguaccagcacaucgagcuccagaagcuguucgccuacuucgacaccuccaagagcgaccuggagcucaucuuauccaacauggugauggucaaggacuaccccauugagcugauagaccucgugaagaagucccgcacccugguggacuuccugaacaaguaccucgaggcccggcuggaguacaucgagaacgucaucacccgcgugaagaacagcaucggcacgccgcaguucaagaccgugcggaaggagugcuucaccuuccugaagaaguccaacuacaccgucgugagccucgacaagcaggucgagcgcauccugagcaugccccuguucaucgagcggggguucauggacgacaagcccacgaugcucgaaggcaaguccuacaagcagcacaaggagaaguucgccgacugguuugugcacuacaaggagaacagcaacuaccagaacuucuacgacaccgagguguacgaaaucaccaccgaggacaagcgggagaaggcgaaggugacgaagaagaucaaacagcagcagaagaacgacgucuucacccugaugauggugaacuauaugcuggaggaggugcucaagcuguccagcaacgaccgguugucccucaacgaguuguaccagaccaaggaggaacgcaucgucaacaagcaggucgccaaggauacccaggagcgcaacaagaacuacaucuggaacaagguaguggaccuucagcucugcgacgggcuggugcacaucgacaacgugaagcugaaggacaucggcaacuuccggaaguacgagaacgacagccgcgucaaggaguuccucacguaccaguccgacaucguguggagcgccuacuuguccaacgagguggacagcaacaagcuguacgucaucgagcggcagcucgacaacuacgaaagcauccgguccaaagagcugcugaaagaggugcaggagaucgagugcagcguguacaaccaggucgccaacaaggagucccucaagcagagcggcaacgagaauuucaagcaguacgugcugcaggggcugcuccccauaggcauggacguccgggagaugcugauccuguccaccgacgucaaguucaagaaggaggagaucauccagcucgggcaggccggcgagguugagcaggaccuguacagccugaucuacauccgcaacaaguucgcgcacaaccagcucccgaucaaggaguucuucgacuucugcgagaacaacuaccgguccaucagcgacaacgaguacuaugccgaguacuacauggagaucuuccgcuccaucaaggaaaaguacgcuaacuga

SEQ ID NO: 11777 - RNA, 3465 nt, Artificial Sequence; identical to SEQ ID NO: 11187
  Cas13b variant__Paludibacter propionicigenes__WP_013446107.1__Cas13b

SEQ ID NO: 11778 - RNA, 3396 nt, Artificial Sequence
  Cas13b variant__Phaeodactylibacter xiamenensis__WP_044218239.1__Cas13b
augaccaacaccccaaagagacgaacacuacaccgacauccgucauauuucggcgcauuccuaaauauugcacgacacaacgccuucaugaucauggaacaccuguccaccaaguacgacauggaagacaaaaacacucuugacgaagcccaacuaccuaacgcuaaacuuuucgggugccucaaaaagagauauggaaaacccgacguaaccgaaggcguuagccgagaccuacgccgguacuuccccuuucucaacuacccccucuuucugcaccuagaaaaacaacaaaacgcugaacaagcggccacauacgacaucaaccccgaagacaucgaguucacccuaaaaggcuuuuuccgcuuacuaaaccaaaugcggaacaacuacagccacuacaucuccaacaccgacuacggaaaguucgacaaacucccaguacaggacaucuacgaagcggccaucuuccgcuuacucgaccgcgguaaacacacgaagcgcuucgacgucuuugaaagcaaacacacgcgccaccuagaaucaaacaacagugaauaccgaccccgcucgcucgccaacuccccagaccacgaaaauaccgucgcauucguaaccugccuuuuccuggagcgcaaauacgcguucccauuccuaucccggcuggacugcuuccgcuccaccaaugacgccgcugaaggcgacccccucauccgaaaggcgucccacgaaugcuacaccauguucugcugccgacuaccccagcccaaacucgaaagcuccgauauccuacucgauauggucaacgaacuaggaagaugcccgagcgcucuauacaaccuccuuuccgaagaggaccaagccagauuccacaucaagagagaagaaauaacaggcuucgaagaggacccagacgaagaacuggagcaggaaauuguccucaagcgucacagcgaccgauuccccuacuucgcgcugcgguacuuugaugacacagaagccuuccaaacgcuccgauucgacgucuaucucggcagauggcgaacuaaaccgguauacaagaaacgaaucuacggacaggaacgagaccgaguccucacacaguccauccgcaccuucacaagacuaucacgccuccuacccaucuacgaaaacgugaaacacgaugcaguccgccaaaacgaagaagacggcaaacucguaaaccccgacgucaccagccaauuucacaaguccuggauccagauagaaagcgacgacagggcauucuuaucagaccgcauagaacacuucucuccccacuacaacuuuggcgaccaaguaauuggccugaaauucauaaacccagaucguuacgccgcaauccagaacgucuuccccaaacuucccggcgaagaaaagaaagacaaagacgcaaagcucgucaaugagaccgcagacgcgauuauauccacacacgaaauccgaagccucuuucucuaucacuaccucucaaagaaaccgauuuccgcaggcgacgaacgacgcuucauacaaguggacacugaaaccuucauaaaacaauauauagacacgaucaaacuauucuuugaagacauaaaaucuggcgaacuucaacccaucgccgaucccccaaacuaccagaagaacgaaccccucccauacguucgcggcgacaaagagaaaacacaagaagaacgcgcccaauacagagaacgacaaaaagagauaaaggaacgacgaaaagaacuaaacacccuucuccagaaccgauaugggcuuucgauacaauacauccccucacgccuccgagaauaccuucugggcuacaagaaaguaccuuacgaaaagcucgcccuucagaaacuucgagcucaacgcaaggaggucaagaaacgaaucaaggauauagagaaaaugagaacaccccgggucggcgaacaggcaaccuggcucgcagaagacauaguauuucuaaccccgccuaaaaugcacacccccgaaagaaaaaccacgaagcacccacagaagcuaaacaacgaccaauuccgaaucaugcaauccucccuagcauacuucucagugaauaagaaagccaucaagaaauucuuccaaaaagaaaccggcauaggguuauccaaccgggaaaccucacaccccuuucuauaucggaucgacguuggacggugcagaggaauacucgauuucuacacgggauaucugaaauacaaaauggacuggcuagaugacgccauaaagaaaguugacaacagaaaacacgguaaaaaggaagcaaagaaauaugagaaauaccuaccauccuccauacaacacaaaacaccgcuagaacuggauuacacccgccucccugucuaccuaccccgcggauuauuuaagaaagcaaucguaaaagcacuagccgcacacgccgauuuccagguugagccagaagaagacaacguaaucuucugccucgaccagcuccucgacggggacacucaagacuucuacaauuggcaaagauacuaccguuccgcacuaaccgaaaaagagacagacaaccagcuaguacuagcccacccauacgcggaacagauacugggcaccaucaaaacgcuggagggaaaacagaaaaacaacaaacucgggaacaaggccaaacaaaagauaaaggacgaacuaauagaccucaaaagagcaaaacgccgacuauuggaccgcgaacaauaccucagggccguucaggcagaagaccgcgcccucuggcucaugauccaagagcgccaaaaacaaaaagcagaacacgaagaaaucgcauucgaccagcuggaccucaaaaacaucaccaaaauccuuacggaauccaucgacgcccgccuacgaaucccagacacaaaggucgacauaaccgacaaacuuccccuacgacgcuacggcgaccuccggagagucgccaaagacagacgccucguaaaccuagccaguuacuaucacguugcaggucuuagcgaaauucccuacgaccuagucaagaaagaacuagaagaguacgauaggagacgcgucgccuucuucgaacaugucuaccaguuugaaaaggagguauacgaucgauaugccgcggaacuccgcaacgaaaaccccaagggcgagagcacauacuucagccacugggaguacgucgcaguagcagucaaacacuccgcagacacgcacuuuaacgaacucuucaaggaaaaagucaugcaacuccgcaacaaguuccaccacaacgaauuuccauacuucgacuggcuccucccagaggucgaaaaagccuccgccgcacuauacgcagaccgagucuucgacguagccgaaggcuacuaccagaaaaugcgcaagcucaugcgccaauaa

SEQ ID NO: 11779 - RNA, 3408 nt, Artificial Sequence
  Cas13b variant__Porohyromonas gingivalis__WP_012458151.1__Cas13b
augaacaccgucccugcauccgaaaacaaaggacagagccgaaccguagaggacgacccccaauacuucggacucuacuugaaccuugccagagagaaccuaaucgaagucgaaagccacgucaggaucaaauucgggaaaaagaaauuaaacgaggaaagccuaaaacagagccuacuuugcgaccaccuccucucagucgaccgguggacaaaaguauacggccauuccagacgcuaucuuccauuccuccacuauuucgaucccgauagccagauugagaaagaucacgacagcaagaccggcgucgacccagacucagcccaacgccugauacgggaacuuuacucacuccuagacuuccugcgaaacgacuucagccacaaccggcuagauggcaccacauucgagcaccuagagguaucuccggacauauccagcuucaucacuggcacauauucauuggcaugcggacgagcacaaagccguuucgcagucuucuucaaacccgacgacuucguacucgccaaaaaccgcaaagaacaacucauuucaguugcagacgggaaagaaugucuaaccgucagcggauucgcuuucuuuaucugccuauucuuggacagagaacaagccucaggaaugcucagcagaauccgaggauucaaacgaaccgacgaaaacugggcccgagccguacacgaaaccuucugcgaccuaugcauccgacacccgcacgacagacuugaaucauccaacacaaaggaagcacuccucuuagacaugcuaaacgaacuaaaccggugccccaggauccuauacgacaugcuccccgaagaggaacgagcccaguuccucccggcucucgacgaaaacagcaugaacaaccuauccgaaaacucccucgacgaggaauccagacuccuaugggacggguccuccgacugggccgaggcacucacaaaaaggauccgccaccaagaccguuuccccuaccucaugcuaagauucaucgaagaaauggaccuccuuaaaggcauaagauucagagucgaccucggcgaaauagaacucgacucguacuccaagaaagucggaaggaacggagaguacgaccgaaccaucacggaucacgcccucgcauucggcaaacuaucggacuuccagaacgaggaagagguaucgcggaugaucuccggagaggccucauauccaguacgcuucagccucuucgcaccgcgauacgccaucuacgacaauaaaauaggauacugccauaccucugauccagucuaccccaagucgaaaacuggcgaaaaacgagcccucuccaacccgcaauccaugggguucauaucaguucaugaccuccguaaacuacuucuaauggaauuacugugcgaaggauccuucagccgcaugcagucagacuucuugcgcaaagcgaaccggauccuagacgaaacugccgagggcaagcuccaguucagcgcacuauucccggagaugagacaccgcuuuaucccaccccagaaucccaaauccaaagaccgacgggagaaggcugagaccacgcuagagaaauacaagcaagaaauaaagggacggaaggacaaacugaacagccagcuacugagcgcauucgacauggaccaacgacaacuaccaucccgccuacucgaugaauggaugaauauaagacccgcaagccacagcgugaaacuuagaacauacgucaaacagcuaaacgaagacugucgucuacggcuacgcaaauucagaaaggauggggacggcaaagcgcgcgccaucccccuaguaggagagauggccacuuuccucucacaggacauuguacgaaugauuauaagcgaagaaacaaagaaacucaucacgucagcauacuacaacgaaaugcaacgcucccuggcccaauaugcuggggaggagaaccgccgacaauuccgcgccauuguggccgaacuacgccuacucgaucccucaucuggccaccccuuccugucugccaccauggaaaccgcgcaccgcuauaccgaaggguucuacaaauguuaccucgaaaagaaacgcgaauggcucgccaaaauuuucuaccgcccagaacaagaugagaauacaaaaagacgcauaagcguguucuucgucccagauggagaagcgcgcaaacugcugcccuuacucauccgacgacgcaugaaagagcagaaugacuuacaggauuggauaagaaauaaacaagcucaucccauagaccucccaucucaucuuuucgacucuaaagucauggaacuccugaaaguaaaagacgggaaaaagaaauggaacgaagccuucaaagacugguggucuacaaaauauccagacggaaugcaaccauucuacggccuccgaagagaacucaacauccacggaaaauccgucucguauauaccuucagacggcaagaaauucgcggacugcuacacucaccuaauggagaaaacaguccgggacaagaaacgcgaacugagaaccgccggaaaacccguaccacccgaccuggccgccgauaucaaacgcagcuuccaccgagcggucaaugaaagggaauuuaugcugcgucucguccaggaggacgaucgccuuaugcucauggcaaucaacaaaaugaugacagacagagaggaagacauccugccagggcucaaaaacaucgacucaauccucgacgaggaaaaccaauucagccucgcgguccacgccaaaguccuggaaaaggagggagagggcggcgacaacucucuaagccucguacccgcaaccauagaaauaaaaagcaaacgaaaggacugguccaaauacaucagauaccgcuacgaccggcgcguccccggccuaaugucccauuucccagaacacaaagcgacauuagacgaggucaagacccuccuaggagaguacgaccgaugcagaaucaaaaucuucgacugggcauucgcgcucgaaggagcuauaaugagcgaccgcgaccugaaacccuaccuacacgaaagcucgucccgcgaaggaaaauccggagagcacagcacucucgucaagaugcucgucgaaaagaaaggcugccuaacuccggacgaaagccaauaucucauccucauccgaaacaaagcggcccauaaccaguuucccugcgccgcggaaaugccccuaaucuaccgcgaugugucggcuaaagugggaucuaucgaagguuccucagccaaggaccucccugaaggcuccucucucgucgacagucucuggaaaaaguacgaaaugaucaucagaaaaauucugcccauacucgaccccgaaaaccgauucuucggaaaacuucucaacaacaugagccagccaaucaacgaucuguaa

SEQ ID NO: 11780 - RNA, 3408 nt, Artificial Sequence
  Cas13b variant__Porohyromonas gingivalis__ERJ81987.1__Cas13b
augaauacagugcccgcauccgaaaacaaaggacaaagccggaccguggaagacgacccccaauacuuuggccuauaccuaaaccuagcgcgcgagaaccugaucgaagucgaaagccacguccguauaaaguucggcaaaaagaaacugaacgaagaaagccuuaaacaaucacuccucugugaucaccuacucucgguagaccgcuggacaaaaguguacggucacucacgaagauaccucccauuccugcacuacuucgaccccgacagucaaaucgaaaaagaccacgacucaaaaaccggagucgacccagacucggcacaaaggcucauccgagaacuauacucucuccucgacuuucuaaggaacgacuucucccacaauagacuggacggaacaaccuucgaacaucucgaaguuaguccagacaucagcuccuucaucacgggcaccuacucacuagccugcggccgagcacagucacgguucgccgacuucuucaaacccgacgacuucguacuagccaaaaaccgaaaagagcagcuaaucucaguugccgacggcaaagaaugccucacuguuuccggccucgccuuuuucaucugccucuuccuagaccgcgagcaggcuuccggcaugcuaucccggaucagaggauuuaaaagaacggacgagaacugggcccgagcaguccacgagaccuuuugugaccucuguauccgacacccccacgaccgacucgaaucuucaaacaccaaagaagcccuacuacuggacaugcuuaacgaacucaaccgcugcccucgaauccucuacgacaugcuacccgaagaggaacgugcgcaauuccuuccagcccuugacgagaacucaaugaauaaucucagcgaaaacagccucaacgaagagagccgccuacucugggacggcucauccgacugggcagaagcacucacaaaaaggaucagacaccaagauagguuccccuaccucaugcuccgauucaucgaagaaauggaccuauuaaaaggcauacgcuucagggucgacuuaggggagauagagcucgacucguacuccaagaaagucggccgcaacggggaguacgaccgaacgaucacggaucacgcgcuugccuuugggaaacuuagcgacuuccaaaacgaagaagaagucucacgaaugaucucaggggaagccagcuaccccguucgauucucucucuucgcgccacgcuacgcuaucuacgacaacaaaauuggauacugccacacauccgaccccgucuacccgaaauccaaaacgggcgagaaacgggcccugucaaacccgcaaagcaugggauucaucagcguccacgaccuacgcaaacuccuccucauggaacugcuaugcgaaggcuccuucagccguaugcaaucaggauuccuccgcaaggccaacagaauccucgacgaaaccgcugaaggaaagcuccaauucuccgcccuguuccccgaaaugcgccaccgcuucauacccccacaaaauccaaaaucaaaagaccgucgggaaaaggcugagaccacccucgaaaaauacaagcaagaaaucaaaggccgaaaggacaaacugaacucccagcucuugucagccuucgacaugaaccagcgacaauuacccucacgccuacuggacgaauggaugaacaucagaccagccucccauucaguaaaacugcgaaccuaugucaaacagcucaacgaagacugccgccuccgacuccgcaaguuccggaaggacggugacggcaaagcacgugcaauaccacuggucggcgaaauggccaccuuccuaagccaggacaucguacgcaugaucauaucagaagaaacuaagaaacuaaucacauccgcguacuauaacgaaaugcaacgcagccuagcccaauacgcaggagaggagaaccgacggcaauuccgcgcuaucguagccgaacuacaccuccucgacccaagcuccggccaccccuuucucucugcaaccauggaaaccgcccaccgcuacaccgaagauuuuuacaaaugcuaccucgagaaaaagcgugaauggcuggcaaagacauuuuaccgccccgagcaggacgaaaacaccaaacgcagaaucagcguauucuucgucccagauggcgaagcccgaaaauuacucccgcuucugauaagacgucguaugaaggagcaaaacgaccugcaagacuggauacgaaauaaacaagcgcacccaaucgaccuaccaucgcaccuuuucgacagcaaaaucauggagcuccuaaaagucaaagacgggaaaaagaaauggaacgaggccuucaaagacugguggucuacaaaauacccagacggcaugcagccuuucuauggccuccggcgggaauugaacauacacggaaaaucggucuccuacaucccaucagacgguaagaaauucgccgacugcuacacccaccucauggagaaaacaguucaagacaagaaacgcgaacuaagaacagccggcaaacccgucccacccgaccucgccgccgacaucaaacgaucauuccauagagccguaaacgaaagagaguucaugcucaggcuaguacaggaagacgaccgacugaugcucauggccauaaacaaaaugaugacagaccgcgaagaggacauccuacccgggcucaaaaacaucgauuccauccuagacgaggaaaaccaauucagccuagccguccacgcaaagguccuggaaaaggaaggggaaggcggagacaacagccucucacucguaccagcaacuaucgaaaucaaaucgaaacgaaaagacugguccaaauacauaagauaccgcuacgacagaagagucccaggcuuaaugagucacuuccccgagcacaaagcaacauuagaugaagucaagacacugcucggagaauaugaccgaugccgcauaaaaaucuucgacugggcguuugcacucgaaggcgcaaucaugagcgaucgagaccugaaaccauacuugcacgaaucaucuucccgcgaaggcaaaagcggcgaacacagcacccuaguaaaaaugcuuguggaaaagaaaggaugucuaacacccgacgaaucccaguaccuaauacucauuaggaacaaagccgcccacaaccaauuccccugcgcggcggaaaugccccucauauaccgggacgucagcgcaaaagucggaagcauagagggcaguuccgccaaagaccuaccggagggcagcucauuggucgacucacucuggaagaaauacgaaaugauaaucagaaaaauccucccgauacucgaccacgaaaaucgcuucuucggaaaacuccuuaauaacaugucccagcccaucaacgaucucuga

SEQ ID NO: 11781 - RNA, 3408 nt, Artificial Sequence
  Cas13b variant__Porohyromonas gingivalis__ERJ65637.1__Cas13b
augaauaccguaccagcaagcgagaacaagggccagucccggaccguagaagacgacccccaauacuucggccucuaccucaaccucgccagagagaaccucaucgaaguggaaucacacgucaggauuaaauuuggcaaaaagaagcucaacgaagaaucccucaagcaaucucuccugugugaccaccuccuaucugucgaccgauggaccaaaguuuacggccacucacgccgguaccucccauuccuccauuacuuugauccggacucccaaauagagaaagaccaugacucaaagacaggcgucgacccagacucagcucaaagacuuauccgcgagcucuacucccuacuagauuuccuccgaaacgacuucucgcacaaccgucuagacgggaccacauucgagcaccucgaagucucaccagacaucagcuccuucauaacaggcacguacucacuagccugcggacgcgcccagagccgcuucgccgacuucuuuaaacccgacgacuucguacuggccaaaaaccgcaaggaacaacucaucuccguagcagacggcaaagagugccucacaguaagcggucuagcauucuucaucugccucuuccuugaccgcgaacaggcuuccggcaugcuaucccgcauacgcgguuucaaacguacugacgaaaacugggcccgggcaguccacgaaacauuuugcgaucuauguauccgacacccccacgaccgccucgaaaguucuaacaccaaagaggcucuccuccucgacaugcucaacgagcuaaaccgaugcccccgcauacuauaugacaugcuacccgaggaagaacgugcgcaauuccuccccgcccuagaugaaaacagcaugaacaaccuuucagagaacagccucaaugaagaaucucggcuacucugggacggcucauccgacugggcagaagcgcuaacuaaaagaauccgucaucaagaccguuucccauaccucaugcuccgguucaucgaagaaauggaccugcuaaaaggcauccgcuuccgagucgaccuaggcgaaaucgaacuggauucauacagcaagaaaguuggacgcaacggagaauacgaccgcaccauaaccgaccacgcccucgcauuugggaaacuuagcgacuuucaaaacgaggaagaagucucgagaaugaucaguggugaggcauccuacccaguccguuucucccucuucgcccccagguacgcaauauacgacaacaaaaucggguacugccauacauccgaccccguuuacccuaaauccaaaacuggcgaaaaacgagcgcucagcaauccccgcucaaugggcuucaucucaguacacgacuuacggaaacugcuccucauggaacuucuuugcgagggcagcuucagcagaaugcagagcgacuuccuaagaaaagccaacaggauacuagacgaaacggccgaaggaaaacuacaauucucggcacuauuuccagagaugcgacaccgcuucauaccgccgcaaaacccaaaaagcaaggaccgccgagaaaaggcagaaaccacccuagaaaaauacaagcaggaaauaaagggcagaaaagacaaacucaacucccaacuccucagugccuucgauauggaccagcgucaacucccaagccggcuucucgacgaauggaugaacauccgaccugcgucccacagcgucaaacuccgcaccuaugugaaacaacugaacgaagauugccgccuccggcuccaaaaauuucguaaggacggagauggaaaagcccgagccaucccccuggucggcgaaauggcaacauuccuaucccaagacaucguccgcaugaucaucuccgaagagaccaagaaacucauaacauccgccuauuacaacgaaaugcaacggucccucgcccaauacgcaggcgaagaaaaccgacaccaguuccgagccauagucgcagaacucaggcugcuagaccccucaagcggccacccauuccuaucagccacaauggaaaccgcccaccgauacaccgaagacuucuacaaaugcuaccuagagaaaaagcgagaguggcuggcaaagaccuucuaccgaccggaacaagacgaaaauaccaaacgccguauuuccgucuuuuucgucccagauggagaagcccgcaaacuccugccgcuccucaucaggcgacgaaugaaggaacagaacgaccuucaagacuggauacguaacaaacaagcacacccaaucgaccugcccagccaccucuucgauuccaagauaauggagcugcuaaaagucaaagauggaaagaagaaauggaacgaagcauucaaagauuggugguccacaaaauacccagacggaaugcagcccuucuacggacuccgaagagaacuaaacauacauggcaaaucggucucauauaucccaucagacgggaagaaauuugccgacugcuacacacaccuaauggaaaagacaguccaagacaaaaagagagaauugcguacagcaggaaaaccugucccacccgaucuagcagccgacauaaaacguuccuuccaccgcgccgucaacgaacgcgaguucaugcuucggcucguacaagaagacgaccggcuaaugcuuauggcgaucaacaaaaugaugaccgaccgcgaagaagacauucuaccaggucuaaagaauaucgacucaauccuagaugaagaaaaccaauucagcuuagcaguccacgccaagguccucgaaaaagaaggugaaggcggcgacaacucccucagccuggugccagccacgaucgagaucaaaucaaaaagaaaagacuggucuaaauacauaagauaccgcuacgacagacgcgucccagggcucaugucccacuucccggaacacaaggccacccuagacgaaguuaagacccuucucggagaguaugaccgcugccgaaucaagauauucgacugggccuucgcccucgagggcgccauuauguccgacagagacuugaaacccuaccuacacgaaucaagcucacgcgagggcaaauccggcgaacacagcacccucguaaaaaugcuaguagaaaagaaaggcugccucacaccagacgagucacaauaccucauacuuauacgcaacaaagcagcgcacaaucaguuccccugcgccgccgagaugccucucaucuaccgugacgucagcgccaaaguaggcagcauagaagguucguccgccaaagaucuuccggaaggcuccagucuuguagacucacuguggaaaaaguaugagaugauaauccguaagauucucccaauccuagaucccgaaaacagauucuucggaaaacugcucaacaacaugucccaacccauaaacgaccuauga

SEQ ID NO: 11782 - RNA, 3408 nt, Artificial Sequence
  Cas13b variant__Porohyromonas gingivalis__WP_021665475.1__Cas13b
augaacacaguacccgcaucagaaaacaaggggcagucccggacugucgaagacgacccgcaguauuuugggcuauaccucaaccucgcacgagaaaaccucaucgaagucgaaucacacgucagaaucaaauucggaaagaagaaacuaaacgaagagucacuaaaacagucacuccuaugcgaccaucugcuauccguagaccgauggacaaaaguauacggacacucccgaagguacuuacccuucuugcacuauuucgaccccgauucccaaauagagaaagaucaugacucgaagacaggcgucgauccagacuccgcacagcgacucauccgggaacucuauucacuccuugacuucuuaagaaacgacuucucacauaaucgccucgacggcacuaccuucgagcaucuggaagucucacccgacaucucaucauucaucacaggcaccuacagccucgcuugcggccgcgcacaaagccgcuucgcggacuuuuucaaaccugacgacuucguucuagccaaaaaccgcaaagaacaacucaucagcguggccgacggcaaagagugucucaccguaucaggacuagccuucuucauaugccuauuucucgaucgcgaacaagccagcggcaugcuaucccgcauccgaggauuuaagcguacuaacgaaaacugggccagagcuguacacgaaacauucugcgaucucugcauccgccacccccacgaccgacuggagagcucaaacaccaaagaagcgcuccugcucgacaugcucaacgaacucaacagaugcccacgcauccuguacgacaugcuacccgaggaggaacgagcccaauuccugcccgcucuagacgaaaacuccaugaacaaccuaagcgaaaacucacuuaacgaagagucccgccugcuuugggacggaagcagcgacugggcagaagcccuuaccaaacgaaucagacaucaagaccgguuccccuaccuaaugcuucgcuucaucgaagaaauggaccuacucaagggcauccgcuuucgggucgaucugggagagaucgaacuagacaguuacagcaagaaagucgggagaaauggagaguacgaccgaaccauaaccgaccacgcacucgccuucgggaaacucuccgacuuccaaaacgaagaagaaguaucgagaaugaucagcggagaagccucauauccgguccgcuucucucuauucgcgccccgguacgcaaucuacgacaacaaaaucggcuacugccacaccagcgacccuguguacccaaaaucaaaaaccggagagaaaagagcccucagcaacccccaauccaugggcuucaucucaguccaugaccuccgaaaacuacuacucauggaacuucucugugagggcucuuucucacggaugcaaucaggcuuccuaagaaaagcgaaucgaauccucgacgaaacagccgaaggaaaacuccaauucucagcucucuuucccgaaaugagacaccgauucauuccaccccaaaaccccaaaucgaaagaccgucgugagaaagccgaaaccacacucgaaaaauacaaacaagaaauaaaagggcguaaagauaaauuaaacucacagcuccuauccgcguucgacaugaaccaacggcaacuaccauccagacuccucgacgaauggaugaacauccgccccgcaucccauucagucaagcuacggacauaugugaaacaguuaaacgaagacugccgccucagacugcgaaaauuucguaaagacggagacggcaaagcccgggccaucccgcuagucggagaaauggcaaccuuccucagccaagacauaguacgcaugaucauaucagaggaaaccaagaaacuaaucaccuccgccuacuacaacgaaaugcagcggucacucgcgcaguacgccggagaagaaaaccggagacaauuccgcgcgaucgucgcggaacuccaccuacuagauccauccucagggcacccguuccucagugccaccauggaaacagcccaccgguacaccgaggacuucuacaaaugcuaccucgagaagaaacgugaauggcucgccaaaacauuuuacaggccugaacaggaugaaaacacgaaacguagaauauccgucuucuuugugccggacggcgaagccagaaaacuccuaccccuucuaauccgccgacgaaugaaagaacagaaugaccuccaggacuggauacgcaacaagcaagcccaccccaucgaccuacccagccaucuauucgacucaaaaauaauggaacuucuaaaaguaaaggacggaaagaagaaauggaacgaagcguuuaaagacugguggucaaccaaauacccagacgggaugcaacccuucuauggccuccgacgcgaacucaacauacacggcaaaagcgucucguacaucccgucagacggcaagaaauucgccgacugcuacacacaccuaauggagaaaaccguacaagacaagaaacgcgaacuacggaccgcaggcaaacccgucccaccggaccuugcagcagacauaaaacgaucauuucaucgagcggugaacgaacgcgaauuuaugcugcgccuaguacaggaggacgaccgcuuaaugcucauggcaauuaacaaaaugaugaccgaccgagaagaagacauccuacccggacucaaaaauauagacuccauucucgauaaagaaaaccaauucagccuggcggugcaugcgaaaguccucgaaaaagagggcgaagguggcgauaacucccucucacucgucccugccacaauagaaaucaaaucgaaacgaaaggacuggaguaaguacauccgcuacagauacgauagacgcguccccggccucaugucccauuucccggagcauaaggcgacccuggacgaagucaagacccuccuaggagaguaugaccgcugucgcaucaaaauauucgacugggccuuugcccucgaaggggccauuauguccgacagggaucucaaaccauacuugcacgaaaguaguucgcgcgaagggaaguccggcgaacacuccacccucgucaaaaugcuggucgaaaagaaaggcugccucaccccagacgagagccaguaccucauccuaauaagaaacaaagccgcccacaaccaauuccccugcgcagcagagaugccccucauauaccgagacguauccgccaaagucgguucuaucgagggcuccucagccaaggaccucccggaaggcucaucccuagucgacucccucuggaagaaauacgaaaugaucauaaggaaaauacuccccauacuagaccacgaaaaccgauucuuuggaaaacuccuaaacaacaugucacaaccaauuaacgaccucuaa

SEQ ID NO: 11783 - RNA, 3408 nt, Artificial Sequence
  Cas13b variant__Porohyromonas gingivalis__WP_061156637.1__Cas13b
augaacacaguucccgccagcgaaaacaaaggacaaagcagaacgguagaagaugacccccaauacuucggccucuaccuaaaucucgcaagggaaaaccucaucgaaguagagucucacguaagaaucaaauucggcaaaaagaaacuaaacgaagaaucccuaaaacaaucgcuccucugcgaccaccuacugucuguggaccguuggaccaaaguauacggacauucacgacgauaccuaccauuucugcacuauuucgacccggauucacaaaucgagaaagaucacgacaguaagacaggcguggaccccgacuccgcgcaacgucucauccgagaacuauauagccuccucgacuuccuacgcaacgauuucucccacaacagacuggacgggacaacguucgaacaccuagaagucucaccagacaucucauccuucaucacaggcaccuacagcuuagccugcggacgagcacaaucccgcuucgccgacuucuucaaaccagacgacuucguccuugcgaaaaacaggaaagaacaacucauuagcgucgcagacggcaaagaaugccuaacggugucuggccuagcauucuucauaugccucuuccuggaucgcgagcaggcuucaggcaugcucagcagaauacgcggcuucaaacggacagacgaaaacugggcgagggccguacacgaaacauucugcgaucucugcauccgucacccacacgacagacuagaaagcagcaacacaaaagaagcacuccugcucgacaugcuuaacgaauuaaacagaugcccgcgcauccuauacgacaugcuucccgaagaggagcgagcacaauuccuaccagcacuagacgagaacucuaugaacaaccucuccgagaacucacucaacgaagaaucaaggcuccuuugggacggcucaagcgauugggcagaggcacucaccaaacggauaagacaccaagacagauuccccuaccugaugcucagauucaucgaggagauggaccuccucaaaggcauucgcuuccgcgucgaucugggcgagaucgaacuggacucuuacagcaagaaagucggccgaaacggagaauacgacagaaccaucacagaccacgcacuggcguuuggcaaacuuagcgauuuccaaaacgaagaagaaguuucacgcaugaucuccggagaagccagcuacccgguacgcuucucacuuuucgcuccaagauaugccaucuacgacaacaagaucggauacugccacaccagcgaccccgucuaccccaaauccaaaaccggcgagaagcgcgcccuuagcaacccccaauccaugggauucauuuccguacacgacuuacgcaagcuccugcuaauggaacuacucugcgaaggcagcuucucccggaugcaaucuggauuccuccggaaggccaaccgcauacucgaugaaaccgcagaaggaaagcuacaguucagcgcacuauucccagaaaugaggcaccgcuucaucccaccccaaaaccccaaguccaaagaucgaagagaaaaggccgagacaacccuugagaaguauaaacaggagaucaaaggccgaaaggacaagcucaacucgcaacugcuaagcgcuuucgacaugaaccagagacagcuacccagcagacugcuagacgaguggaugaacauccgaccagcuucccacuccgucaaacuacgaaccuacgucaagcaacucaacgaagacugccgacugaggcuccggaaauuccgcaaggacggcgacggaaaagcacgcgccauaccacucgugggagaaauggccacauuccugucccaagauauaguucgaaugauaaucagcgaggaaacuaagaaacuaauaacaucagcauacuacaacgaaaugcagcgcuccuuagcacaauacgccggagaagaaaacagacgacaauuccgugccauuguagccgaauuacaccuacucgaucccucguccggacaccccuuccugucggccaccauggagacagcccacagguacacagaagacuucuacaaauguuaccuagaaaagaaacgugaauggcuagcaaaaacguucuaccgacccgaacaagacgagaacacgaaaagacguauauccguguucuuuguaccugacggagaagcacgaaaacuauugccccuccucauucgccgucgaaugaaagaacagaacgaccuccaagacuggauucgcaacaaacaagcccaccccauagaucuaccaucccaucucuucgacagcaaaaucauggagcuccuaaaaguaaaagacgguaaaaagaaauggaacgaagccuucaaagacugguggucuacaaaauaccccgauggcaugcagccauucuauggauuacgccgcgaacuaaacauacacggaaaaucagugucauacaucccaucggacggaaagaaauucgcggacugcuacacacaccuuauggagaaaacaguucaagacaaaaagcgagaacuccggaccgcaggcaaacccguaccaccagaccucgccgcagauaucaagcgcuccuuccaucgcgcaguaaacgaacgagaauuuaugcuucgccuaguucaagaagacgaucgucuaaugcuaauggcaaucaacaaaaugaugaccgaccgcgaggaagacauacuacccggacucaaaaacauagacucaauccuagacaaagaaaaccaauucucacuggcagugcacgcaaaagucuuagaaaaagaaggagaagggggcgacaacucccucagccucguaccagccacaaucgagaucaaaucaaagcgaaaagauuggagcaaguacauccgauaucgauaugacagacgcguaccaggccuuaugucccacuuccccgagcacaaggcaacacucgacgaagugaagacccuucuaggagaauacgauagaugccgcauaaagauauuugacugggcguuugcuuuggaaggcgcaaucaugagcgaccgugaccuuaaaccauaccuacacgaaagcucaucacgggaaggcaaaucaggggagcacuccacccucguaaagaugcugguugaaaagaaaggcugccucacaccagacgaaagccaauaccuaauacugauaaggaacaaagccgcucacaaccaauucccuugugccgccgaaaugccucuuaucuaccgugacguguccgccaaagucggaagcauagaagggucauccgccaaagaccuaccagaaggcagcucgcucgucgacagccuuuggaagaaauaugagaugauaauacgcaaaauccuaccuauucuggauccagagaaccgcuucuuuggcaaacuccuaaacaacaugucccaacccauaaacgaccuauaa

SEQ ID NO: 11784 - RNA, 3408 nt, Artificial Sequence
  Cas13b variant__Porohyromonas gingivalis__WP_023846767.1__Cas13b
augaacacggucccagcuuccgaaaacaagggccaaucgcggaccguggaggacgacccacaauacuucggacuauaucuaaaccuagcccgagaaaaccugaucgaagucgagucucacguacgaaucaaguucggcaaaaagaaacucaacgaggaaagccuaaaacaaagccuccucugugaucaccuucuauccguagaccgguggacaaaaguuuacggccacuccagacgcuaucucccauuccuacacuacuucgacccugacagccaaaucgagaaagaccacgacaguaaaacaggcguagaccccgacagcgcccaacgccucauucgcgagcuuuacucacuccucgacuuccuccgaaacgacuucucccacaaccgucucgauggaaccaccuucgaacaccucgaaguaucuccagacaucuccucuuucaucacaggcacuuacagucucgcaugcggccgcgcccaaucaagauucgcagacuucuuuaaaccagacgacuucgugcuggccaagaaccguaaagagcaacucauuucagucgccgacgguaaagagugucuuacaguauccggccucgcauucuucaucugccucuuccuagaucgcgagcaggcaagcggaaugcuaucccgaauacgcggguuuaaacgaacugacgaaaacugggcccgugcaguacacgaaaccuucugugacuuaugcauccggcauccccacgaccggcuagaauccucuaacaccaaagaagcccuccuccuagacaugcucaacgaauugaaucggugcccacgaauccuuuacgacaugcuccccgaagaagaacgugcacaguuccucccagcuuuggacgagaacuccaugaacaaccuaucagaaaacucccucaacgaagaaucccggcuccugugggacggcagcucagacugggcagaagcgcucaccaaacgaauaagacaccaagacagauuuccguacuuaaugcuacgauucauagaggaaauggaccugcugaagggcauccguuuucgcguugaccuaggcgaaaucgaacuggacagcuacagcaagaaagucggcagaaauggagaauacgaccgcacaaucacagaucaugcccucgcauucggaaaacucagcgacuuccaaaacgaagaagaagucucgcggaugauuuccggcgaggcaucguacccagucagauucagccucuuugcuccacgauacgcaauuuacgacaacaaaauaggauacugccacaccagugauccagucuacccaaaaucuaagacuggagagaaaagagcacuuuccaacccgagaaguauggguuuuaucucaguccacgaccugcgcaaauuacuucuuauggaacuccugugcgaaggaucguucucaaggaugcagucagacuuccuacgcaaggcgaaccgaauacucgacgaaaccgcagagggaaaacuccaauucuccgcacuauuccccgaaaugcgccacagauucaucccuccucaaaaccccaaaucaaaagacagaagggaaaaggcggagacaacucucgaaaaguacaaacaagaaauaaagggacgaaaagacaaacucaacagccagcugcuaagcgccuucgacaugaaccaacgacaacucccgucucggcuacuugacgaauggaugaacauccgacccgcaucccacucagugaagcuacgaaccuacguaaagcagcuaaacgaagacugccgccuuaggcuaagaaaauuucgcaaagacggcgaugguaaagccagagccaucccccuagucggagaaauggcuacuuuccucucccaagacauaguucggaugaucaucuccgaagaaaccaaaaaguuaaucaccucagccuacuacaacgagaugcaacgaucacuggcucaauacgcaggcgaagaaaaucgccgccaauuccgagcaaucgucgcagaacugcaccuacucgacccuagcuccggccaccccuuucucucagcuacaauggaaacagcucaccgcuacacugaagacuucuacaaguguuaccucgaaaagaaacgggaauggcucgccaaaacguucuacagacccgaacaggacgaaaacaccaaaagacgaauuuccguguuuuucgucccggacggcgaagcccgcaaacuacucccucuacucauccgacggagaaugaaagaacagaaugaccuacaagacuggauacggaacaaacaagcacacccaaucgaccuucccucacaccucuucgacuccaaaaucauggaguuacuaaaagucaaggacggaaagaagaaauggaacgaagccuucaaagacugguggucgacgaaauaccccgacggcaugcaaccauucuacggacugagaagagaacucaacauccacggcaaauccguaagcuauauccccucggacggcaagaaauucgcggacugcuacacgcaccuaauggagaaaacaguccaggacaagaaaagagaacuacgaacggccggcaaaccagucccaccugaccucgccgcagacauuaaacgcuccuuccaccgcgccguuaaugaacgcgaguucaugcugagauugguccaagaagacgaccgucugaugcugauggccaucaacaaaaugaugaccgaccgcgaagaagacauccucccaggccucaaaaacaucgacuccauccuugacgaagaaaaucaauucagccucgcggugcacgccaaaguacucgaaaaagaaggcgaaggcggggacaacucguuaucccuaguccccgccacaauagaaauaaaaucaaaacguaaggacugguccaaauacauccgguaucgcuaugaccgucgagucccuggccucaugucccacuuccccgaacacaaagcuacucuagacgaagucaaaacacuacuaggagaauacgaucgaugccgcaucaagaucuucgacugggcauucgcacuggaaggcgcaaucaugagugaccgagaccugaaaccuuaccuccacgaaaguuccuccagggaaggcaagagcggggagcacuccaccuugguaaaaaugcuagucgaaaagaaggggugucucacacccgacgaaucacaauaccuaauacuuauucgaaacaaggccgcccacaaccaauuccccugcgccgccgagaugccccucaucuaccgagacguaucagcaaaaguuggaucaaucgagggcaguucagcuaaagaccuacccgaaggaucaucccucguagacucccuauggaagaaauacgagaugaucauccgaaaaauccuccccauacuagacccugaaaacagguucuucggaaaacuucuaaauaacaugagccaacccauaaaugaccucuaa

SEQ ID NO: 11785 - RNA, 3408 nt, Artificial Sequence
  Cas13b variant__Porohyromonas gingivalis__ERJ87335.1__Cas13b
augaacacgguacccgcauccgagaacaagggccaaucacgcacagucgaagacgacccacaguacuuugggcuauaccucaaccuagcccgagagaaccucaucgaaguugagagucacguacgcauaaaauucggcaaaaagaagcuaaacgaagagucccuaaaacaaucgcuucucugcgaccaccuacuuucggucgaccgauggacaaaggucuacggccacucucgccgcuaccugcccuuccuacacuacuucgaucccgacucgcaaaucgagaaagaccacgacagcaagacuggcguggaccccgacucugcccaacgucuuauacgcgaacucuacucacuccuagacuuccuacgaaaugacuucucucacaaccgauuggauggaacaaccuucgaacaccuagaaguaucaccagauauaagcucuuucauaaccgguaccuacucccuggcuuguggucgcgcccaaagccgcuuugcggacuucuucaaaccagacgauuucguccucgcgaaaaaccgcaaagaacagcuuaucucagucgcagacggcaaggaaugcuuaacaguaucuggccucgcuuucuucauaugccucuuccuagauagagagcaagccagcgguauguuaucccggauccgaggcuucaaacgcacggacgagaacugggcccgagccguccacgaaaccuucugugaucucuguauacgacacccacacgaccgcuuagagagcagcaacaccaaggaagcacuacuccuggacaugcuaaacgaacucaaccgcuguccccggauccuauacgacaugcugcccgaggaggaacgugcccaauuccucccagcccuggacgagaacuccaugaacaaccuaucagagaauagucucaacgaagaaucccgguuacucugggacggcuccuccgacugggcagaagcccuaacaaaacgaauacgccaccaagaccgauucccguaucucaugcuccgguuuauagaagagauggaucuacucaaaggcaucagguucagggucgacuuaggagaaauagaacuagacagcuacagcaagaaaguaggcagaaacggcgaauacgaccgaacaaucaccgaucacgcacuugccuucggaaagcucagcgacuuccagaacgaggaggaggucagccggaugaucucaggugaagcaucguacccgguucgguucucacuauucgcaccccgcuacgcuauauacgacaacaaaaucgguuacugccacacaucagaccccguuuaccccaaaaguaaaacaggagagaaaagagcccucucaaacccacgauccaugggguucauuucgguccacgacuuacgcaaacuacuccucauggaacuccuuugcgaaggcuccuucucccgaaugcagucagacuucuuaagaaaggcaaaccgcauccuugacgaaaccgcagaaggcaaacuccaauucagcgcucucuuccccgaaaugcgucaccgcuucaucccuccccagaacccaaagucaaaagaucggagagaaaaagccgaaaccacccuggaaaaguacaaacaagaaauaaaaggacgcaaggauaaacuuaacucccaacuacuauccgccuucgacauggaccaacgacaacugcccucgcgccuacuagacgaauggaugaacauccgacccgccucacauagcgucaagcuccguacguacguuaaacagcuaaacgaagacugccggcugcgccuacagaaauuccggaaagacggagauggcaaagcacgcgcaauuccccucgucggagagauggccaccuuccucucccaggauaucguuagaaugauaauaagcgaagagacaaagaaacuaauuaccuccgcauacuacaaugaaaugcaacgaagccucgcccaauaugcgggcgaagaaaaucgccaccaauuuagagcgaucgucgccgagcugcgacuacuagacccaagcuccggccaccccuuccucuccgcuaccauggagaccgcacacagauacacagaagacuuuuacaaaugcuaccuagaaaagaaacgagaauggcucgccaaaaccuucuaccgcccagaacaagacgaaaacacgaaaagacgaaucuccguauucuucguaccugacggagaagcccgcaaauugcuaccccugcuaauacgucggcgaaugaaagaacagaacgaccuacaggacuggauccggaauaaacaagcacaccccauagaccuuccaucccaccucuucgauucgaaagucauggaacuccucaaaguaaaagacgggaaaaagaaauggaacgaggccuucaaagacugguggucaaccaaauaucccgacgguaugcaaccauucuacggccuccgacgagaguuaaacauacacggcaaaucagucucuuacauaccauccgacggaaagaaauuugccgacugcuacacacaccugauggagaaaaccguaagagacaagaaacgagaacuuagaaccgccggaaaaccaguaccacccgaccucgcagccuacauaaaacguuccuuccaccgcgccgucaacgaacgugaguuuaugcuacgccucguacaagaagacgacagacucaugcucauggccauaaacaaaaucaugacugaccgagaagaagacauccuaccaggacuuaaaaauaucgacuccauacuagacaaagaaaaccaauucucauuggcaguccacgccaaaguacucgaaaaagaaggugagggcggcgacaacucacucucgcucguacccgccacuaucgaaauaaaauccaaacggaaagacuggagcaaguacauccgauaucgauacgaccgccgaguaccuggacucaugucacacuucccagagcacaaagccacccucgacgaagucaaaacccuacucggcgaauacgaccgcugccgaauaaaaauuuuugauugggcguucgcccuagaaggcgccauaauguccgacagagaucucaaaccauaccuacacgaauccuccucccgagaggggaaaucaggcgagcacagcacccucgucaaaaugcuaguagagaaaaagggaugccuaacacccgacgaaucccaauaccucauccuuauccgcaacaaagcagcccauaaucaauuccccugugccgcagaaaucccacuaauauaccgagacgucagcgcaaaaguuggaucgauagaggguuccagcgccaaagacuuaccagaaggcagcagucuagucgauucacucuggaagaaguacgaaaugaucauacgaaagauacuccccauacucgacccugaaaaccgguucuucggaaaacuacucaauaacaugucacagccaauaaaugaucuauga

SEQ ID NO: 11786 - RNA, 3408 nt, Artificial Sequence
  Cas13b variant__Porohyromonas gingivalis__WP_005873511.1__Cas13b
augaacaccguaccggccuccgagaacaaaggccaaucgcgcaccguagaagacgacccacaguacuucggacucuaccucaaccucgcccgcgagaaucuaauagaggucgaaucacacgugcgcauaaaguucgggaaaaagaagcugaaugaagagagccucaaacaauccuuacugugcgaccaccuacuaucaguagacagauggaccaaggucuauggacacucaagacgauaucuacccuuccugcacuauuucgaccccgacucccagaucgaaaaagaccacgacagcaaaacaggagucgaucccgacagugcccagcgacucauacgcgagcucuacucacugcuugacuuccucaggaacgacuucagccacaacagacuagacggaaccaccuucgagcacuuggaaguguccccagacauaucauccuucaucaccggcacguacucccucgcgugcggccgcgcacaaagccgauuugccgauuucuucaaaccagaugauuucguacucgcgaagaaccgaaaggaacaacuuauauccgucgcagacggcaaagaaugccuaacuguuagcggccuggcauucuucaucugccucuuucucgaucgugaacaggcuuccggcaugcucuccagaauccgcggcuucaaacgcaccgacgaaaauugggcccgagccguccacgaaacauucugcgaccucugcauccgacauccacaugauagacuggaaucuagcaauacgaaagaagcacuccuacuagacaugcucaacgagcucaacaggugcccccgcauccuauacgauaugcucccagaagaagaacgcgcccaauuccucccagcccuagacgagaacagcaugaacaaccuaagcgaaaacucacucaacgaagaaagccgacuccuuugggacggcuccagcgacugggccgaggcacucaccaaaagaauacgacaccaagaccgauucccuuaccuaaugcuaagguucaucgaagaaauggaccuccuuaaggggauacgcuuccgcguagaccucggggaaaucgaacucgacaguuacucaaagaaaguaggccguaacggcgaauacgacagaaccauaaccgaccacgcucucgcuuucggcaaacucagcgacuuucaaaaugaagaggaaguuucccggaugaucagcggcgaggcgagcuaccccgugcguuucucccucuucgcaccccguuacgcuaucuacgacaacaaaauuggcuacugccacacgagcgacccagucuaccccaaaucaaaaaccggagaaaaacgcgcacuaagcaauccccaaagcaugggcuucauaaguguccacaaccuccgaaagcugcuccucauggagcuucuaugcgagggcaguuucucacgcaugcaaagcgacuuccuccggaaagccaaccggauucucgacgagaccgccgagggaaagcugcaauucuccgcccucuuccccgagaugcgacaccgguucaucccaccccaaaaccccaaauccaaggaccgccgggaaaaggccgagaccacccucgaaaaauacaagcaggaaaucaaaggacgcaaagacaaacucaacucccagcuacuaagcgccuucgacaugaaccaaagacaacuccccucccgccuccucgacgaguggaugaacaucagacccgcaucccauagcgucaaacuacguaccuacgugaaacagcuaaacgaagauugccgguuacgacuacguaaauuccgaaaagacggagacggaaaagcccgggcgaucccacuuguaggagaaauggcaaccuuccugucacaagacaucguacgaaugaucauaagcgaagaaacgaagaaacuuaucaccucagccuacuacaaugagaugcagagaucccucgcgcaauacgcgggagaagaaaaccgcaggcaguuccgcgccaucgucgcagaacuacaucugcuggacccuuccucgggacaccccuuccuaucggcgacgauggaaacagcacaccgauacaccgaagacuucuauaaauguuaccucgagaagaaacgggaauggcuagcgaaaacauucuaucggcccgaacaagacgaaaacacaaaacgacguaucagcgucuucuucguacccgacggcgaagcccgcaaacuauuaccauuacucauacgccgccgaaugaaagaacaaaacgaucuacaagacuggauacgcaacaaacaggcacauccaauagaccugcccucccaccucuucgacucaaagaucauggaacuacucaaggucaaagacgguaagaagaaauggaacgaagcguucaaagacugguggucaaccaaauacccagacgguaugcaaccauucuacggccuacgccgagagcucaacauccacggcaagagcgucuccuacauaccaagcgacggcaagaaauucgcggacugcuacacacaccuaauggagaaaacgguccaagauaagaaaagggaacuccgcacggcaggaaaaccagucccaccagaccucgcugcagacaucaaacgcuccuuccaccgcgccgugaaugaacgcgaguucaugcuacgccucguacaggaagacgaucggcucaugcuaauggcgaucaacaaaaugaugaccgaccgggaagaagacauccucccgggacucaaaaacaucgacucaauucucgacgaagagaaccaauuuucccucgcgguacacgccaagguccuugaaaaagagggcgaaggcggcgauaauagccuaucacucguacccgcgacaaucgagaucaaaaguaagagaaaagacuggucaaaauacauuagguaucgcuacgaucggcgugucccuggacucaugucacauuucccggaacacaaagcaacccucgaugaggucaaaacacuccucggagaguacgaccgaugccgaaucaaaauuuucgacugggccuucgcccuagaaggagccauaaugucagaccgagaucuaaaacccuaccugcacgaaucgagcagccgugaaggaaaaagcggagaacacaguacccucgugaaaaugcuagucgagaaaaaggguugccugacccccgacgaaagccaauaccuaauccuuauacgaaacaaagcugcacacaaccaguuuccaugcgcggcagaaaugccgcucauauacagagacgucuccgcgaaaguaggcucgauagaaggauccagcgcgaaagaccucccagaagguaguucccucguagacucccucuggaagaaauacgaaaugaucauccgcaaaauacucccaauauuagacccggaaaaccguuucuucggaaaacugcuuaauaauaugucucaaccgauaaacgaccuguga

SEQ ID NO: 11787 - RNA, 3408 nt, Artificial Sequence
  Cas13b variant__Porohyromonas gulae__WP_039445055.1__Cas13b
augaacaccguacccgccaccgagaacaagggucagagccgcacggucgaggacgacccgcaauacuucgggcuguaccucaaccuggcccgggagaacuuaauugagguggaaucccacguucgcaucaaguucggcaagaagaagcucaacgaggagagccugaagcagucccugcucugcgaccaucuccuuagcaucgaccgguggaccaaagucuacgggcacucccgccgguaucugccauuccuucacuguuucgaccccgacaguggcaucgagaaggaccacgacuccaagaccgggguggaccccgacagcgcgcagcgccuuauccgugaacucuacagccugcuggacuuccuccgcaacgacuucucccacaaccggcuggacggcaccacauucgagcaccuuaagguguccccggacaucagcuccuucaucacuggcgccuacaccuucgccugcgagcgcgcccagagccgguucgccgacuucuucaagcccgacgauuuccuccuggcaaagaaucgcaaggagcagcugaucuccgucgccgacgggaaggagugcuuaaccgucagcggcuuugccuucuucaucugccucuuucuggaccgggagcaggccuccgguaugcucagccgcauccggggcuucaagcgcacggacgagaauugggcgcgggccgugcacgagaccuucugugaucucugcauccgccauccccacgaccggcuggaguccagcaacaccaaggaggcccuccugcuggacaugcucaacgaguuaaaccgcugcccccggauccuguacgacaugcucccggaggaggaacgcgcccaguuccugccagcccuggaugagaacagcaugaacaaccucuccgagaacagccugaacgaggagucccgccugcucugggacgggagcuccgacugggcggaggcccugacgaagcggauccgccaccaggaccgcuuccccuaucugaugcuccgcuuuaucgaggagauggaccugcugaaagggauccgguuccgcgucgaccucggcgagaucgagcucgacagcuacuccaagaagguggggagaaacggcgaguacgaccgcacgaucaccgaccacgcccuggccuucgggaagcucagcgacuuccagaacgaggaggaggugucccggaugaucagcggagaggccuccuaccccguccgcuucagccuguucgcuccgcgguacgccaucuacgacaacaagaucggcuacugccacaccuccgaccccguguaccccaagagcaagaccggagagaagcgcgcccuguccaacccgcaaagcaugggcuucaucuccgugcacgaccugcggaaacuccugcugauggagcuccugugcgaggggagcuucucccgcaugcagucagacuuccugcggaaggccaaccggauccucgacgagacggccgagggcaagcugcaguucagcgcgcuguucccggagaugcgccaucgcuucaucccuccccagaaccccaaguccaaggaccggcgcgagaaggccgagaccacccucgagaaguacaagcaggagaucaaggggcgcaaggacaaguuaaacagccagcugcucuccgccuucgacaugaaccagcggcagcugcccagccgucugcucgacgaguggaugaacauccggcccgcuucccacagcgucaaacugcgcaccuacgugaagcagcugaacgaggacugccggcuccgccugcggaaguuccggaaggacggcgacggcaaggcccgggcgaucccccuggugggggagauggccacguuccucucgcaggacaucguccgcaugaucaucucggaggagacuaagaagcuaaucaccuccgccuacuacaacgagaugcagcggagccuggcgcaguacgcgggcgaagagaaucgcaggcaguuccgcgccaucguggccgagcuccacuugcuggaccccuccagcgggcacccuuuucuauccgccacuauggagacggcccaccgguacaccgaggauuucuacaaguguuaccuggagaagaaacgugagugguuagccaaaaccuucuaccggcccgagcaggacgaaaacaccaagcggcggaucagcguguucuucgucccugacggcgaggcccgaaagcuccugccccugcugauccggcgccgcaugaaggagcagaacgaccugcaggacuggauccggaacaaacaggcccauccgaucgaccugcccucccaccucuucgacagcaagaucauggagcugcugaaggugaaggacgggaagaagaaguggaacgaggccuucaaggacuggugguccacgaaauaccccgacggcaugcagccguucuacggccuccgccgugagcugaacauccauggcaagucagugucguacauccccuccgacgggaagaaguucgccgacugcuacacccacuuaauggagaagaccgugcgcgacaagaagcgggagcuccgcaccgcggggaagcccgugccuccggaccuggccgccuacaucaagcggagcuuucaucgcgccgucaacgagcgggaguucaugcugcgccucguacaggaggacgaccggcugaugcugauggccaucaacaagaugaugacggaccgcgaggaggacauucucccuggccugaagaacaucgauuccauccuggacgaagagaaccaguucagccucgcggugcacgcuaagguccuggagaaagagggggagggcggcgauaacucccugagccucgugccagccaccaucgagaucaagucaaaacgaaaggacuggagcaaguacauucgcuaccgguacgacaggcgggugccagguuuaaugucccacuuuccugaacacaaggccacccuggacgaggucaagacccuccugggcgaauacgaccgcugccggaucaaaaucuucgacugggcguuugcccuggaaggagccaucaugagugaccgcgaccucaagcccuaccugcacgaauccagcagucgcgagggcaagagcggcgagcacuccacgcuggugaaaaugcucguggagaagaaggggugccugacccccgacgagagucaguaccugauccucauccggaacaaggccgcccauaaccaguuccccugcgcggccgagaugccgcugaucuacagagacgucuccgccaaggugggcagcaucgagggguccagcgccaaggaccuucccgaggguagcucccucguggacagccuguggaagaaauacgagaugaucauccggaagauccugcccauccucgaccacgagaaccgcuucuucgggaagcugcugaauaacaugucccagcccaucaacgaccucuga

SEQ ID NO: 11788 - RNA, 3528 nt, Artificial Sequence
  Cas13b variant__Porphyromonas gingivalis__WP_052912312.1__Cas13b
augacagaacaaaacgagaaacccuacaacggaaccuauuacaccuuggaagacaagcacuucugggcugccuucuucaaccuagcccgccacaaugccuacauaacccuagcccauauagacagacagcuagcauacagcaaagccgacaucaccaacgaugaagacauacucuucuucaagggacaguggaaaaaccucgacaacgaccucgaacguaaagcccgcuuacgaagccugauacucaaacacuucucguuccuggaaggagcggccuacgggaagaaacuauucgagucccaguccagcggaaacaaaagcuccaaaaagaaagaacucacaaagaaagagaaagaggagcuccaagcaaaugcccucucgcuagacaacuuaaaaagcauacuuuucgacuuccuccaaaaacugaaagacuuccgaaacuacuacagccacuaccgccacccugaauccucagagcuaccccucuuugacggcaacaugcuucaacgccuauacaacgucuucgaugucucaguccagcgcguaaaacgcgaccaugagcacaacgacaaaguugauccccauagacacuuuaaccaccuuguccgaaaaggcaagaaagauaaauaugguaacaacgacaaccccuucuucaaacaccacuucgucgaccgcgaagagaaagucaccgaggcagggcugcuauucuucguaagccucuuccucgaaaaacgcgaugcgaucuggaugcagaagaaaauccggggcuucaaagguggcacagaagccuaccaacagaugaccaaugaaguauucuguaggagccguauaucccuacccaaacucaaacucgaaucgcugcgcacagacgacuggaugcuucucgacaugcucaacgaguuaguacgcugccccaaacuccucuacgaccgccuucgggaagaagaccgcgcacgcuuccgcguaccugucgacauccuuuccgaugaagacgacacagacggcacagaggaggaccccuucaaaaacacgcucguacgccaccaggacagguucccguacuucgcgcuccgcuacuucgaccucaagaaaguauucaccagccuacgcuuccacaucgaccugggaacauaccacuucgcaauauacaagaaaaauaucggagaacagccagaagacagacaccucacacgcaaccuauacggcuuuggacguauccaagacuuugcagaggaacaccgaccagaagaauggaaaagacuggucagagaccuggacuacuucgaaaccggagacaagccauacauuacccaaacaacaccgcacuaccauauagagaagggcaaaauaggccugcgauucguaccggaagggcaacuucuuuggcccucccccgaggucggcgcuacccggacaggacgcucgaaguacgcccaagacaaacgcuuuacagccgaagcauuccuuaguguccacgaacuaaugccgaugauguucuacuacuuccugcugagagaaaaauauagugaggaggcaagcgcagagaaggugcagggcagaaucaagcgaguaauagaagacguuuacgccgucuacgacgcguucgccagagacgagaucaacaccagagacgaacuagacgcgugucucgcagacaagggaauccggcgaggacaccucccccggcaaaugauugccauacucagccaagaacauaaagacauggaagagaaaguccgaaagaaacugcaagagaugaucgccgacacugaccaccgccuagacaugcucgaccggcagacagacagaaaaauccgcauuggccgcaaaaacgccggacuccccaaaucaggagucauugccgacuggcuaguacgcgacaugaugcgcuuccaaccgguugccaaagacacauccggaaaacccuuaaacaacucuaaagcaaacucaacagaguaccgcaugcuucagcgagcacucgcuuuauuuggaggagaaaaagaacgcuuaacaccuuacuuucggcaaaugaacuuaaccggcggaaacaacccccaccccuuccuccacgaaacccgaugggagagccacaccaacauacucagcuucuacagaagcuaccucaaagcaaggaaagcguuccuacaaagcaucggcagauccgaccgugaagaaaaccaucgauuccuucuacucaaagaaccaaaaaccgacagacagacccucguggccggcuggaaauccgaguuccaccuaccgcgaggcaucuucaccgaagcugugagagauugccuuaucgaaauggguuacgacgaaguaggauccuauaaagaaguaggauucauggccaaagcgguaccgcuauauuucgaacgagccugcaaagacagaguccaaccauucuacgacuaccccuucaacgugggaaacucccucaaaccgaaaaagggaagauuuuuaagcaaagaaaagcgggcagaagaaugggaaucagguaaagaacgguuccgggaccucgaggcguggucgcauucagccgcacgccgaaucgaagacgccuucgucggaaucgaauacgccuccugggaaaacaaaaagaaaauugagcagcuacuccaagaccucucguuaugggagacauucgaaaguaaacucaaagucaaagccgacaagauuaacauagcgaaacuaaagaaagaaauccucgaagccaaagaacacccauaccacgacuucaaaagcuggcagaaguucgaacgcgagcuucgacucgucaaaaaccaagacauaaucaccuggaugaugugccgugaucuaauggaagagaacaaaguagaaggccuagacacgggaacccuauaccucaaagacauccggacagacguacaggagcaaggcucccucaacguacuuaaccacgucaaaccaaugaggcucccggucgucgucuaccgggccgacagcagaggacacguacacaaagaagaagcgccccucgccaccgucuacauugaagaacgagacacaaaacuccucaaacaaggcaacuucaaaucauucguaaaggaccgccgacugaacggccucuucuccuucguggacacaggcgccuuagccauggaacaguacccaaucuccaaauuacgcgucgaauacgagcuagccaaguaccagaccgcacgcgugugcgccuucgaacaaacacucgaacucgaagaaucccuccucacccgguacccacaccucccagacgaauccuucagggaaaugcuggagagcuggagugacccucucuuagacaaauggccagaccuacaaagggaaguaagacuccuaaucgcgguccgaaaugccuuuucccacaaccaauacccaauguacgacgaaacaaucuuuuccagcauacgaaaauacgacccaagcucacuggaugccaucgaagaacggaugggacucaacauagcccaccgccuaucagaagaaguuaagcuggcaaaagagauggucgaaaggaucauccaggccuaa

SEQ ID NO: 11789 - RNA, 3360 nt, Artificial Sequence
  Cas13b variant__Porphyromonas gingivalis__WP_053444417.1__Cas13b
augaccgagcagaacgagaagcccuacaauggcaccuauuacacccuggaggacaaacauuuuugggccgcguuccucaaccuggcgcgccacaacgcauacaucacccuggcccacauugacagacagcucgccuacagcaaggccgacaucaccaaugacgaagacauccuguucuucaaggggcaguggaaaaaccuggacaacgaucucgagcgcaaggcaaggcugcgcucccugauccucaagcauuucucuuuccuggagggugccgcguacgggaaaaagcuguucgagucccagagcuccggcaacaagagcuccaagaagaaggaguugucaaagaaggagaaggaggagcugcaggcaaacgcgcuguccuuagacaaccucaagagcaucuuguucgacuuccuccagaagcugaaggacuuccggaacuacuacucccacuaccgccacccggagagcuccgagcucccccucuucgacgggaauaugcuacagcggcucuacaacguguucgacgugucaguacagcgcgugaagcgggaccacgagcacaaugacaaggucgacccccaccgccacuucaaccaccucguucgaaaaggcaagaaggacaaguacggaaacaaugacaaccccuucuucaaacaucacuucguggaccgcgaggguaccgucacugaagcggggcuccucuucuucguuucccucuuccuagagaaacgggacgcuaucuggaugcagaagaagauccgcggauucaagggcggaaccgaggccuaccagcagaugaccaacgaggucuucugccguagcaggaucucccugccgaagcucaagcuggagagccugcggaccgacgacuggaugcuccuggacaugcugaacgaacucguccgcugccccaagucccuguacgaccggcuacgcgaggaggaccgggcccgauucagggugcccguggacauccucagcgacgaagacgacacggacggcaccgaggaggaccccuucaagaacacccuuguccggcaccaggaccgcuuuccguacuucgcccugcgguacuucgaucucaaaaagguguucaccagccugcgcuuccacauagaccucgggacguaccacuucgcaaucuacaagaaaaacaucggugaacagcccgaagaccggcaccucacccgcaaccuguacggcuuugggcggauccaggacuucgccgaggagcaccgacccgaggaauggaaacggcuggugcgcgaccucgacuacuucgagaccggcgacaagcccuacaucacccaaaccaccccacauuaucacaucgagaagggcaagaucggacugcgguucguacccgagggccagcaccuguggcccucccccgaagugggcgccacccgcaccggccggagcaaguacgcccaggauaagcgccugacggcggaggccuuccucuccgugcaugagcugaugccgaugauguucuauuacuuccuguugcgugagaaguacagcgaggaggucuccgccgagaagguacaggggcgcaucaagcgggugaucgaggacgucuacgccguguacgacgccuucgcgcgcgacgagaucaacacgcgggacgagcuggacgccugccuggcggacaagggcauccgccgcggccaccucccccgucagaugaucgccauccuuagccaggagcacaaagacauggaagagaaggugcgaaagaagcugcaggagaugauugccgacaccgaccaccggcucgacaugcuggaucggcagaccgaccggaaaauccgcaucgggcggaagaacgcgggccugcccaaguccggggucguggccgacuggcucguccgcgacaugaugcgguuucagcccguggccaaagacacgaguggcaagccgcugaacaacuccaaggccaauagcaccgaguaccgcaugcugcagagagcgcucgcucuguucgggggcgagaaggagcgccugacccccuauuuccgucagaugaaccuaaccggcgggaacaacccccaccccuuccugcacgagacacgcugggagucccacaccaauauccugagcuuuuaucgguccuaccucgaggcccgcaaggcguuccugcagagcaucgggcgguccgaccggguggagaaccaccgguuccugcuccugaaggaaccaaagaccgaccgccagacccugguagcgggguggaaaggcgaguuccaccuccccagggggaucuucacggaagcgguucgcgacugccugaucgagaugggcuacgacgagguuggcagcuacaaggaggucggguuuauggccaaggccguuccacuguacuucgaacgcgccuccaaggaccgggugcagcccuucuacgacuauccguuuaacgucgguaacagccuaaagcccaagaaggggcgcuuucuguccaaggagaagcgcgccgaggagugggagagcggcaaggagcgcuuccggcuggcuaagcucaagaaggagauccuggaggccaaagagcaccccuaccacgacuucaagucuuggcaaaaguucgagcgcgaacuucggcucgugaagaaccaagauaucaucaccuggaugaugugccgcgaccugauggaggagaacaaaguggagggccuggacaccgggacccucuacuuaaaagacauccggacggacguccaagagcagggcucccugaacgugcuuaacagaguaaagccgaugcggcugcccgucguggucuaccgcgccgacagccgcgggcacguccacaaggagcaggcgcccuuagccaccguguauaucgaggagcgggacaccaagcuccugaaacagggcaauuucaaguccuucgugaaggaccggcgccugaacgggcuguucagcuucgucgacaccggcgccuuggccauggagcaguaccccaucuccaagcuccggguagaguacgaguuggccaaguaccagaccgcacgcguuugcgcguuugagcagacguuagaacuggaggagagccuccugacccgguacccgcaccuccccgacaagaauuuccgcaagaugcuggaguccuggagcgacccccugcuggacaaguggcccgaccuccacggcaacguccgccuccugaucgccgugcggaacgcauucucccacaaccaguauccgauguacgacgagacccuguucagcuccauccgcaaguacgaccccagcucccccgacgccauugaggagcggauggggcugaauaucgcccaccgccugagcgaggaggugaagcaggcgaaggagaugguggagcggaucauccaggcuuga

SEQ ID NO: 11790 - RNA, 3360 nt, Artificial Sequence
  Cas13b variant__Porphyromonas gingivalis__WP_012458414.1__Cas13b
augacggaacaaaacgagcgcccauacaacggcaccuauuacacccuugaagacaaacacuucugggccgccuucuuuaaccuagccaggcacaacgcauacaucacccuugcccacaucgacaggcagcucgcauacuccaaggccgacauuacaaacgacgaggacauccuauuuuucaagggccaauggaaaaaucucgacaacgaccucgaacgaaaagccaggcuccgcagccugauucuaaaacacuucaguuuccucgaaggagcagccuacgggaagaaacucuucgaaucacaauccagcggaaacaaaucauccaaaaagaaagagcugaccaagaaagaaaaagaggaacuacaggccaaugcgcuuagucuagacaaccucaaaucaauccucuucgacuuccuccaaaagcucaaagacuuccgaaacuacuacagccacuaccgccacccugaaucauccgaacuaccucuauucgacggcaacaugcuccaaaggcuauacaacguauuugacguauccguucaacgcguaaagagagaccacgaacacaacgacaaagucgacccacaccgacacuucaaccaccucguccgcaaagggaagaaagaccgcuauggcaacaacgacaacccuuucuucaagcaccauuuuguagaccgcgaagaaaaaguaaccgaagccggacuucucuucuucgucucacucuucuuggaaaaacgagaugcgaucuggaugcaaaagaaaauacgaggcuucaaaggcgggacagaaacuuaucaacaaaugacuaacgaggucuucugccggagucgcaucucccuaccaaaacuaaagcuggagucgcuacgcaccgacgacuggaugcuccuagacaugcucaacgagcuaguacgcugcccaaagagccucuacgaccgccuccgagaagaagaccgcgcaagauuccgcgucccggucgacauucuauccgacgaagacgacaccgauggaacagaggaagacccuuucaaaaacaccuuagugaggcaccaggaccgcuuccccuauuucgcccuacgauacuucgaccucaaaaagguuuucacuuccuuacgcuuccauaucgaccucgggaccuaccacuucgcaaucuacaagaaaaacauaggcgaacagccggaagaccgacaccugaccaggaacuuguacggguucggucggauccaggacuucgcagaggaacaccgcccagaagaauggaaaagacuuguacgggaccuagacuacuuugaaaccggagacaaaccguacaucacucaaaccaccccucacuaccacaucgagaaagggaaaauaggccuccgcuucguucccgaaggacaacaccuuuggccaucacccgaaguuggcgccacacgcaccggccgcucaaaguacgcccaggacaaacgccucacagccgaagccuuccuaagcguacacgaacucaugccgaugauguucuacuacuuccuccuccgugagaaguacuccgaugaagcauccgcagagcgaguccaaggacguaucaaacgcguuaucgaagauguauaugcaguguacgacgccuucgccaggggagagaucaacacucgagacgaacuugacgccugcuuagcagacaagggaaucagaagaggacacuugccgcgacaaaugaucggaauccuaagccaggaacauaaagacauggaggaaaaggucagaaagaaacuccaggaaaugauaguggacaccgaccaccgacucgacaugcucgaccgacagaccgaccgcaagauccgcaucgggcgcaagaacgccggccucccaaaauccggaguaauagcggacuggcuuguacgcgacaugaugagauuccaacccguagccaaagacacuagcgggaaaccccucaauaacagcaaagcuaauagcacagaguacaggaugcugcaacgcgcacuggcacuguucggaggcgaaaaagaacgccucacacccuauuucagacaaaugaaccuaaccggaggaaacaacccccacccuuucuuacacgaaacacgcugggaaucgcacacgaacauccuaucuuuuuacagauccuaccugaaggcacgcaaggccuuccuacagagcauagguagauccgaccgcguagaaaaccaucgcuuucuccuacugaaggagcccaaaacggacaggcaaacccuagucgccggcuggaagggagaguuucaucugccacggggaauauucaccgaggccguccgcgacugucuaauagaaaugggccucgacgaagucgggucauacaaagaagucgguuuuauggcuaaggcuguaccacuauauuucgaacgagcaugcaaagaccguguacagccauuuuacgacuacccguuuaacgucggcaacagucucaaacccaaaaagggaagguuccuuuccaaagagaaacgcgcggaagagugggagagcggcaaggaacgauuucgccuggcaaaacucaagaaagaaauauuagaggcaaaagagcacccauaccuugacuuuaaaucauggcagaaauucgaacgugaacugcgucucguaaagaaccaagacaucaucacauggaugaucugcagggaccugauggaagaaaacaaagucgagggccuggacaccggcacucuauaccuaaaagacauacgaacugacgugcaagaacaaggaaaccuuaacguacugaaccgcguuaaacccaugcgacuacccguaguggucuaucgagcagacucaagaggacacguacacaaagaacaagcuccccuagcaaccguguacaucgaagaaagggacaccaaacuccuaaaacaaggcaacuucaagagcuucguaaaagacaggcgacugaacggccuguucagcuucgucgauacaggcgcacuagcuauggaacaauacccaaucucaaaacuucgaguugaauacgaacuagcaaaauaccaaaccgcccgcgucugcgccuucgaacaaacacuugaacucgaggaaucccuucucacacgauacccacaccuaccagacaaaaacuucagaaaaaugcucgaguccugguccgacccgcugcucgacaaguggcccgaccuccacggcaacguccgccugcucaucgccguccgcaacgcauuuagccacaaccaguacccgauguaugacgaagcaguauucuccuccauccgaaaauacgacccuuccagccccgacgcaauugaagaacgcaugggccuuaacauagcccaccgccuaagcgaagaaguuaaacaggcaaaagagauggccgaacgcaucauccaggccuaa

SEQ ID NO: 11791 - RNA, 3360 nt, Artificial Sequence
  Cas13b variant__Porphyromonas gingivalis__WP_039417390.1__Cas13b
augaccgaacaaaacgagcggcccuacaacggcaccuacuauacgcuagaggacaaacauuucugggcggccuucuucaaccucgcccgccacaacgccuacaucacccuagcacacauagaucgacaacuagccuacucaaaggccgacaucacaaaugacgaggacauacucuucuucaagggacaguggaaaaaccucgacaacgaccucgaacgcaaagcacgccuccgaucccuuaucuuaaaacacuucuccuucuuagagggggcagccuacggcaagaaacucuucgaaucgcagucuucaggaaacaaaagcucaaagaagaaagaacucaccaagaaagaaaaggaggaacuccaagccaacgcacuaagccucgacaaucuaaagucgauacuauucgauuuccuccaaaagcucaaagacuuccgaaacuacuacagccauuaccgccaccccgaaaguagugaacugcccuuauucgacggcaauaugcuacaacgacuauacaaugucuuugacguguccgugcagagagucaagcgagaccacgagcacaacgauaagguagacccacaccggcacuucaaccaccucguccggaagggaaagaaagauagauacggcaacaacgacaacccauucuucaaacaccacuucguagacagggaaggcaccgucaccgaagcgggcuuauuauucuucgucucccuauuccuggaaaaacgcgacgccaucuggaugcagaagaaaauucgaggauucaaaggaggaaccgaagcauaccaacagaugacaaaugaagucuucugccggucacgcaucucucuacccaaacuaaaacuagaaucccuccgaaccgacgacuggaugcugcuagacaugcucaacgaacucgucagaugccccaaaucccuauacgaccgacuacgcgaagaagaccgcgcuagauucaggguccccaucgacauacucucggacgaagacgacaccgacggaacagaagaagacccauucaaaaacacacucgugcgacaucaagaccgguuccccuauuucgcacugcgguauuucgaccucaagaaagucuuuacaucccugagauuccacauugaccuagguaccuaccacuuugcgaucuacaagaaaaacauaggggaacaacccgaagaccgucacuuaacccgaaaccuuuacggcuucgggaggauccaagacuucgcagaagaacauagaccugaagaauggaaacggcuaguaagagaccuagacuauuucgaaaccggcgacaaacccuauaucacccagacaacaccccacuaccauauagaaaaagguaaaauaggacuacgcuucguucccgaaggacaacaccuauggccaucucccgaagucggcgccaccagaacaggccgcagcaaauacgcccaagauaagagacuuacugccgaagccuuccugagcgugcacgaacuaaugccaaugauguucuacuacuuccuccucagagaaaaauacucggaggaagugagcgcagagaaaguacagggccgcauaaagagggucaucgaagacguauacgccguauacgacgcguucgcccguggagaaaucgacacccucgacagacucgacgcaugccucgccgacaaaggcauccgccgaggccacuugccccgccagaugauagccauccugucacaagaacacaaagacauggaagaaaaaguccgcaagaaacuacaagaaaugaucgccgauacugaccauagauuggacaugcucgaccgccagaccgaccgcaaaauccgcaucgggcgcaaaaacgccggccuccccaaaagcggggucauugcagacuggcuagugcgagacaugaugcgcuuccaacccguagccaaagacaccagcggcaaaccauuaaacaacucaaaagcgaacucaacagaguacaggaugcugcaacgcgcccuugcacucuucggcggcgaaaaggaacgacucacgcccuacuuucgacaaaugaaccucacaggaggcaacaacccacacccguuccuccacgagacacgcugggaaucacacaccaacauccucucauucuaccgaucauaccugaaagcccgaaaagcauuucuccaaagcaucggccgcagcgaucgagaagaaaaccacagauuccugcuucugaaagaaccgaaaacagaucgccaaacacucguugcaggcuggaaguccgaguuccaucucccccgcgggauauucaccgaagcaguacgagacugucucauagaaaugggcuacgacgaagucgguucauacaaagaaguaggauuuauggcgaaagcagugccccuauacuucgaacgcgccugcaaggaccgcguccaaccauucuacgauuaucccuucaacguuggaaacucacucaaacccaagaaaggccgcuuccucuccaaagaaaaacgagccgaagaaugggaaucgggcaaagaacgguuucgacucgcuaaacuaaagaaagaaauucucgaagcuaaagagcaccccuaucuagacuucaaauccuggcagaaauucgaacgagagcugcggcucgucaaaaaccaagacauaaucacauggaugaugugccgagacuuaauggaagaaaacaaaguagaaggacuagacacaggcacccuauaccuaaaagacauaagaacagacgugcacgaacaaggaucccucaacgugcucaaccgcgucaaaccgaugcggcugcccguagugguguaucgcgcggacagucgaggacacgugcacaaagagcaagcgccccuugccacagucuacaucgaggaacgggacaccaaacuucugaaacaaggcaacuucaagagcuucgucaaagaccgccgacucaacgggcuuuucaguuucguagacaccggcgcucucgccauggaacaauaccccauaagcaaacuacguguggaauacgaacuggccaaauaccaaacggcccgaguuugcgccuucgagcaaacacuagaacuugaggaaucccuacugacccgguacccccauuuaccggauaagaacuucagaaaaaugcuugaaagcuggucagauccccuccuggacaaauggcccgaccuccaucgaaaaguucgccugcuaaucgcaguccgcaacgccuucucccacaaccaauaccccauguacgacgaagcaguguucagcuccauccgaaaauacgacccauccucgcccgacgccaucgaggaacggaugggccugaacaucgcccacagacuuagcgaagaaguaaagcaagccaaagaaauggccgagcguaucauacaaguauaa

SEQ ID NO: 11792 - RNA, 3528 nt, Artificial Sequence
  Cas13b variant__Porphyromonas gingivalis__EOA10535.1__Cas13b
augacagaacaaaacgaaaaaccguacaacgguacauacuacacauuagaagacaaacacuucugggcugcauucuucaaccuagcaagacacaacgcauauaucacgcuaacccacauagaccgacagcuagcuuauuccaaggcggacaucacaaacgacgaagacauccuguucuucaaggggcaauggaaaaaccucgacaacgaccuugaacgcaaggcacgccuccgcagccucauacucaagcacuucagcuuccucgaaggagcggccuacggcaagaaacuauuugaaucgcaaagcuccggaaacaaaagcucuaaaaagaaagaacugaccaaaaaggaaaaagaagaacuccaggcaaacgcgcuuucccucgacaaccuaaaauccauccucuucgacuuucuacagaaacucaaagacuucaggaacuacuacucacacuaccgccaccccgaaagcagcgaguuaccauuguucgauggcaacaugcuucaacgacuauacaacgucuucgacguaaguguccagcgagucaagcgcgaccacgagcacaacgacaaaguggauccccaccgccacuucaaucaccuuguacgcaagggaaagaaagaucgcugcggaaacaacgauaacccauucuuuaaacaccacuucgucgaccgcgaagaaaaaguaacagaagccggccuccuguucuucgucucacucuuccuagaaaaacgugacgccaucuggaugcaaaagaaaauccgaggcuucaaagggggcacagagacauaccaacaaaugaccaaugaggucuucugccgcuccagaaucucccucccgaaacucaaauuagagucucugagaacugacgauuggaugcuccucgauaugcucaacgaacuggugagauguccaaaaagccuuuacgaccgacuucgcgaggaggaucgcgccagguucagagucccaguggacauccuaagugacgaggacgacaccgacggcacagaggaggaccccuucaaaaacacacucguacgccaucaagaccguuuccccuacuuugcccuacgcuacuucgaccucaagaaagucuucacgucacuacgcuuccacaucgaccucgggacauaccacuucgcgaucuacaagaaaaacauaggagaacaacccgaagacaggcaccucacuagaaaccucuacggguucggaagaauccaagacuucgcggaagaacaccgccccgaggaauggaaaagacugguccgcgaccucgacuauuucgaaacaggagacaaacccuacauaacacaaacaacaccccacuaccauauagagaaaggaaaaaucggcuuacgguucguacccgaaggacaacugcuauggccgucccccgaagucggagcaaccaggaccgggagauccaaauacgcgcaagacaaacgguuuaccgccgaagcauuccucagcgugcacgaacucaugcccaugauguucuauuacuuucuacuacgcgagaaauacuccgaagaagcaucggcggagcgcguacaaggacgcaucaaacgcgucauagaagacgucuacgcaguuuacgacgccuucgcacgaggagaaaucgacacacucgaccgccuggacgccugucuggccgacaaaggcauccggcgaggccaccuaccacgacaaaugaucgcaauccuaagccaagaacacaaagacauggaagaaaaaguccgcaagaaacuccaagaaaugauagccgacacagaucacagacucgacaugcuagaccgucagaccgaccgaaaaauccgaauugggcggaaaaacgcgggccugcccaaauccgggguaaucgcagauuggcucguacgcgacaugaugcgcuuccaacccgucgcaaaagacaccagcggcaaaccucuaaauaacuccaaagcaaacagcacagaguauagaaugcuccagcgugcccucgcccucuucggaggcgaaaaagagcgccucaccccguacuuccgacaaaugaacuuaaccggagggaacaacccacaccccuuucuccacgaaacccguugggagagccacacaaacauacucuccuucuaccgcagcuaccuuaaggcccgcaaggccuuccuccaaucaaucggccgcagugaccgcguagagaaccaccgcuuccuacugcucaaagaaccuaagaccgaccgacaaacacuggucgccggcuggaaaggagaguuccacuuaccaagaggcauuuuuaccgaagccguccgggacugccucauugagaugggccuagacgaagugggcaguuauaaggaggucggguucauggcgaaggccguuccacucuacuucgaacgggccugcaaagacagaguccaaccauucuacgacuaucccuucaacgucgguaacucgcuaaaacccaagaagggacgcuuccuaucaaaagaaaagagagcagaagaaugggaaucaggaaaggaaagauuccgcgaccuagaagcauggagccauucagcagccaggcgcaucgaagacgccuucgccgggauagaaaacgccagccgagaaaacaagaagaaaauagaacagcugcuacaagaccucucccuuugggagacuuucgaauccaaacuuaaaguaaaagccgacaaaaucaacaucgccaaacuaaagaaagaaauccucgaagcgaaagaacacccauaccucgauuuuaaauccuggcaaaaauucgaacgggaacugcgccucgucaagaaccaagacaucauuaccuggaugaugugucgugaccuuauggaagaaaacaaagucgaaggacuagacacagguacacucuaccugaaggacauaagaaccgacguccacgagcaaggcucccuuaauguacucaaccgcguaaaacccaugcggcuacccguugugguguaccgcgccgacagcagagggcacgugcacaaagagcaggcuccccuggccacgguguacaucgaggaacgagacaccaaacuacugaaacagggaaauuuuaagucauucgugaaggaccgccggcugaacggccuauucagcuuugucgacacaggugcacucgcgauggaacaauaccccaucucuaaacugcgcguggaguacgaacucgccaaauaccaaaccgcccgcguaugcgccuucgagcaaacauuagaacucgaagagucauuacuaacccgguacccccaccuaccugacaagaacuuccgcaaaaugcucgagagcugguccgacccccuacucgacaaguggcccgaccuccacgggaacgugcgccuacucaucgcuguccgcaaugccuucucacauaaccaauacccaauguacgacgagacccuauuuagcucaaucagaaaguacgaccccagcagccccgacgccauugaagaacgaaugggucuuaacaucgcacaccgacucuccgaagagguaaaacaagcaaaagaaaugguagaacgcaucauacaggccuga

SEQ ID NO: 11793 - RNA, 3360 nt, Artificial Sequence
  Cas13b variant__Porphyromonas gingivalis__WP_061156470.1__Cas13b
augaccgaacagaacgagagaccguacaauggaaccuacuauacacuagaagacaagcacuucugggccgcauucuucaaccucgcccgccacaacgcguacauaacccuaacccacaucgaccgccaacuagcuuauucuaaagcagacaucacgaaugacgaagacauacucuucuucaaaggucaauggaagaaccucgacaacgaccuggaaaggaaagcacgacuacggucccucauccucaaacacuucucauuccuggaaggggcagcauacggcaagaaacucuucgaaaacaaauccagcggcaacaaaucauccaaaaagaaagaacuuacuaaaaaggaaaaagaagaauuacaggcuaacgcccuaagccuagacaaccucaaaagcauacuguucgacuuccuacaaaagcucaaagacuuucgcaacuacuacucgcacuaccgccaccccgagaguagugaauuaccucucuucgacggaaacaugcuacaacgacucuacaacguguuugacgugucgguacaacgcgugaaacgagaccacgaacauaacgacaagguagauccccacagacacuucaaccaccucguccgaaaaggcaaaaaggaccgcuguggaaacaacgacaaucccuucuucaaacaccacuucguagacagggaagggaagguaacagaagccggccuuuuauucuucgucucacucuuccucgaaaaacgugacgcgauauggaugcagaaaaagauccgaggcuucaagggcgggaccgaagccuaccaacaaaugaccaacgaaguuuucugcagaucgcgcaucucgcuccccaaacuaaaacucgagucguuacggaccgacgauuggaugcuccucgacaugcucaacgagcuaguccgcugcccgaaaucccuguacgacaggcuccgagaagaagaucgagccagguuccgggucccagucgauauccucucagaugaagacgacaccgacgguaccgaagaagaucccuucaaaaacacgcucgugcgccaccaagaccguuuccccuacuucgcacugcgcuacuucgaucucaaaaaggucuuuacaucacucagguuucacaucgacuugggaacauaccacuucgcgaucuacaagaaaaauaucggcgagcaacccgaagaccgacaccucacaaggaaccuauacgguuucggacgcauacaggacuucgcagaggaacaccgccccgaagaguggaaaagacuuguccgcgaccuagacuacuucgaaacaggggacaaaccauacauaacccagaccacaccacacuaucauaucgaaaaaggcaaaaucggccuacgcuucguaccagaaggccaacaccuauggcccuccccugagguaggcgcgacaagaaccggacgcuccaaauacgcccaggauaaacgccucaccgccgaagccuuccucagcguccacgaacugaugcccaugauguucuauuacuuucuccugcgggagaaguacagcgaagaaguauccgccgaaaaaguccaaggacgcaucaagcgcguaauagaagacgucuacgccgucuacgacgcauucgcccgaggcgaaaucgacacccucgaccgccuagaugcuugccucgccgacaaaggcauucgccgcggacaccuuccccggcaaaugauugcgauacucucccaggaacacaaggacauggaagaaaaggugcguaagaaacuacaagaaaugauagcugacacggaccaccgacuagacaugcuagaccgacaaaccgaccgcaaaauaagaauuggccggaaaaacgccggucugccgaaaucaggggucauagcagacuggcugguucgagacaugaugcgcuuccaaccgguagcgaaagacacaucaggcaaaccccucaacaauaguaaggcaaacuccaccgaauauaggaugcuacaacgugcucuugcccuauucggcggagaaaaagaaagacuaacccccuacuuuagacaaaugaaccugacuggcggaaauaauccgcacccauuccuccacgagacacgcugggaaucccauaccaacauacucagcuucuaccguucauaccugaaggcccgcaaggccuuccuccaaucgauaggacgaucggaucgcgaagagaaccaccgcuuccuucuacucaaggagcccaaaaccgaccgccaaacccucguagcuggcuggaaauccgaguuccaccuccccagagggauauucacagaagccguaagagauugcuuaaucgaaauggguuaugacgaaguaggcuccuauaaggaagucggcuuuauggccaaagcuguaccacucuacuucgagagggcauguaaagaccgcguacaacccuucuaugacuaccccuucaacguggggaacagccugaaacccaagaaagguagauuucuuagcaaagaaaaacgagccgaagaaugggaaagcggaaaggaacgguucagacucgcgaaauuaaagaaagaaauacuagaagcaaaagaacacccauaccucgacuuuaaauccuggcaaaaguucgaacgagaacuacgccuagucaaaaaccaagacaucauaacauggaugaugugccgcgacuuaauggaggaaaauaaagucgaaggauuggacacgggcacucuguaucuaaaagacauccgcacagaaguccaggaacaaggaucacucaacguccuaaaccgugucaaaccaaugagguugcccguagucgucuacagagccgacucacgcggacacguacacaaagaacaagccccacucgccaccguguacaucgaggaacgcgacacaaaacuccucaagcaaggaaacuuuaagagcuucguaaaagacagacgccuaaacggacuauucagcuucgucgacaccggcggccucgcuauggaacaauaccccauaucaaaacuacgcguugaauacgaacucgcaaaauaccaaaccgcccguguaugcgccuucgaacaaacccuagagcucgaagagucccuccucacccgcugcccccaccuccccgacaagaacuuccgaaaaauguuagaauccuggagcgaccccuuacucgacaaguggccagaccugcaaagagagguuuggcuucucaucgcaguccgcaacgcauucucucacaaucaauaccccauguacgacgaagccguuuucuccucgauucgaaaguacgaccccuccaguccugacgcgaucgaagaacgcaugggccuuaacaucgcacauagacuauccgaagagguaaaacaggccaaagagauggccgagcguauaauccaagccuaa

SEQ ID NO: 11794 - RNA, 3360 nt, Artificial Sequence
  Cas13b variant__Porphyromonas gingivalis__WP_013816155.1__Cas13b
augacggagcagaacgagaagccguacaacggcaccuacuacacccuagaagacaaacacuucugggccgcuuucuucaacuuagcaaggcacaacgcguacauuacacuagcccacaucgauagacagcuagccuacuccaaagcugacaucacaaaugacgaggacauccucuuuuucaagggacaauggaagaaccuugauaacgaccucgaacgcaaagcacgccuccgcucccuaauccuuaaacacuucagcuuccucgaaggcgccgccuacggcaagaaacucuucgaaucucaauccucaggcaacaaauccucuaaaaacaaagaacuuaccaagaaagagaaagaggaacuacaagccaacgcccucucauuagacaaccugaaauccauccuauuugacuuccuccaaaaacucaaggacuuccgcaauuacuacucccacuacaggcacccagaauccucugagcugccacucuucgacgggaacaugcuccaacgacucuacaacgucuuugacgucucgguccaacggguuaagcgggaccacgaacauaacgacaaagucgacccccacaggcacuuuaaccaccucguacgcaaagggaaaaaggaccgcuauggcaacaacgacaaccccuucuucaagcaccacuuugucgaccgcgaaggcaccguuacagaggcgggcuuauuauucuucgucagucuuuuccuggaaaaacgugacgccaucuggaugcaaaagaaaauucgaggcuucaaaggcgggacagaaaccuaucagcaaaugaccaacgagguguucugccgaucacgcaucagccucccuaaacuaaaacuugaaucccuccguaccgacgacuggaugcugcuugacaugcuaaacgaacucguacguugcccaaaaucccucuacgacagacuacgugaagaggaccgagcacgauuccgaguccccgucgacauucuaagcgacgaagaagacaccgauggagcagaagaagacccauucaaaaauacucuuguccgacaucaagaccgcuuccccuacuucgcacuccgguacuucgaccuaaagaaagucuucaccucgcuacgguuucaaauagaccucggaacuuaccacuucgcaaucuacaagaaaaacaucggcgaacagccagaggaccgccaccucacacgaaaccucuauggcuucggccguauucaagacuucgcugaagaacaccggcccgaggaauggaaacgccucguccgcgaccuagacuacuuugaaacgggugacaaaccauauauaacucaaacaacgccccacuaccauauugagaaagggaagauaggccuccgcuucguccccgagggacaacaccucuggcccuccccagaggucggagccacacggacaggacgcuccaaauaugcccaagacaaacgauucacagcagaagcguuucuuuccgcccacgaacuaaugcccaugauguucuacuauuuccuccugcgcgagaaauacagcgaagaagccuccgcggaacggguccaaggccgaauaaagagagucaucgaagacgucuacgcggucuacgacgccuuugcacgcgacgaaaucaacacacgagacgaacuagaugccugccuagccgacaagggaauccgccggggacaucugccccggcagaugaucgggauucucagucaagaacacaaggacauggaagagaaaauaagaaagaaauuacaagaaaugauggccgacaccgaccaccgucuugacaugcuggaccgacaaacugaccgcaaaauccgaaucggccgaaagaacgcaggacucccuaaaagcggaguaaucgcagauuggcuaguucgagacaugaugagauuccaacccgucgccaaagacaccuccggcaaaccccucaacaauagcaaagcaaauuccaccgaguacagaaugcuucaacgagcccucgcccuguucgguggagaaaaagaacggcuaacccccuacuucaggcaaaugaaccucacugguggcaacaacccacacccauuccuacacgaaacacgaugggaaagccacaccaacauacucaguuucuaccgaagcuaccucaaagcgagaaaagcguucuuacaguccauaggacgcagcgaccgaguagaaaaccacagauuccuccuacugaaagagccaaaaaccgaccgucaaacgcuagucgcaggcuggaaaggugaguuccaccucccccgagggaucuuuaccgaagcaguccgagauugccucauagaaauggggcuagacgaagucggauccuacaaagaggucgguuucauggcgaaagccguaccgcuguacuucgaacgcgcgugcaaagacuggguacaaccauucuacaacuacccuuucaaugugggcaacucgcucaaacccaagaaaggccgauuucucuccaaagaaaaacgagccgaggagugggaaucgggcaaagaacgcuucagacuagcgaaacucaagaaagaaauccucgaagcaaaagaacacccauaccuggacuucaaaagcuggcaaaaauucgaacgcgaacuccgacucgugaaaaaccaagacaucaucacuuggaugaucugcggcgaccucauggaagaaaacaaaguagagggccucgacaccggcacgcucuaccugaaagacauccguacugacguccaggagcaaggcagccucaacguccucaacagggugaaaccaaugcgccuaccuguaguaguauaucgagccgacucccgcggacacguccacaaagaacaagcuccgcuggcaaccgucuacaucgaggaacgggacacuaagcugcuuaaacagggcaacuucaaauccuucguaaaggaccgccgauuaaacggucuauuuuccuucgucgauacuggagcccuugcgauggagcaauacccgauaucgaaacuccgcgucgaguacgaacucgccaaauaccaaaccgcccgcgugugugccuucgaacaaacccuagaacuagaagaaagucugcucacccgaugcccacaccucccggauaaaaacuuccgaaaaaugcucgaauccuggucggacccccuacuagauaaauggccggaccuacaccggaagguacgacuacucauugcagugcgaaacgcguucucgcacaaucaauaucccauguacgacgaagcgguuuucuccagcauccgaaaauacgacccgagcuucccugaugcgaucgaagaacgaaugggccuuaauauagcacaccgccucuccgaagaaguaaaacaagcaaaagagaccgucgagcgaaucauccaagccuga

SEQ ID NO: 11795 - RNA, 3528 nt, Artificial Sequence
  Cas13b variant__Porphyromonas gingivalis__WP_005874195.1__Cas13b
augacagagcagaacgagaaaccauacaacggcaccuacuacacuuuagaagacaaacacuucugggccgcuuucuucaaccuggcccgccacaacgccuauauaacacucgcccacauagaucgacaacucgccuacagcaaagcagacaucaccaacgacgaagacauacucuucuucaaaggccaauggaagaaccucgacaaugaccuugagcgcaaagcccgcuuaagaucauuaauacucaaacacuucagcuucuuagagggcgccgcguacggaaagaaacucuuugaaagccaaagcucugggaacaaaucuucgaaaaagaaggaacucacuaagaaagaaaaagaagaacuccaagccaaugcacuuagccucgacaaccucaaaucuauacuuuuugauuuccuccaaaaacucaaagacuuccguaauuacuacucacacuaccgccaucccgaaucaucagaacuaccacucuucgacggcaacaugcuacaaagacuauacaacguauucgacgucagugugcaacgcgucaaacgagaccacgaacacaacgacaaagucgauccgcaccgucacuucaaccaccucguccgcaaaggcaagaaagacaaguacggcaauaacgacaacccauucuucaagcaccacuucgucgacagagaagaaaaaguaacggaggcaggccuccuauucuucguuucgcuguuccuagagaaacgggaugccaucuggaugcagaagaaaauacgaggcuuuaaagguggcaccgaagccuaccagcaaaugacuaaugaggucuucugcagaucacgcaucucacuacccaaacucaagcuggaaagccuacgaaccgacgacuggaugcuacucgauaugcuuaacgaacucgugagaugcccuaagucccuguacgacagacuccgggaagaagaucgcgcacgauuccggguacccguggauauccucagcgacgaagacgacaccgacggcacugaagaggaccccuucaaaaacacacugguccgacaccaagaccgcuucccuuacuucgcccuccgcuauuucgaccucaagaaagucuucaccagccuacgcuuccacauagaccucggaaccuaucauuucgcgaucuacaagaaaaauaucggagagcaaccagaagaccgccaccucacccgcaaccucuacggguucgggcgcauccaggauuucgccgaggaacaucgcccagaagaauggaaacgacucguaagagaccuagacuacuuugagaccggcgauaaaccauacaucacacaaacgacgccccacuaccacauagaaaagggaaaaauaggacuccgguucguccccgagggacaauugcucuggcccagcccggaagucggagcaacccggacaggcaggucaaaguacgcgcaagacaagcguuucaccgccgaggcguuccuauccgugcaugaacucaugcccaugauguucuacuacuuccugcucagagagaaauacuccgaagaggcauccgcggagaaaguccaaggccgaauaaagcgcguaauugaagacguauacgccgucuacgacgcguucgcacgagacgaaaucaacacacgcgacgaacuagacgccugucuagccgacaaaggaauacgacgcggccaucuuccacgacaaaugaucgccauucuaucccaggaacacaaagacauggaagaaaaaguuagaaagaaacuccaagaaaugaucgcagacacugaccaccgcuuggacaugcuagaccgccaaaccgaccgcaaaauccggaucggcaggaagaaugccgggcuaccaaagagcggcgucaucgcugacuggcucgucagggacaugaugagauuccaaccugucgccaaggauaccagcggcaaaccucuaaacaacagcaaagccaacucaaccgaauaucgcaugcuccaacgcgcacuagcacuauucgguggggaaaaagagagacucacgccauacuucagacaaaugaaccucaccggcggaaauaacccacaccccuuucuacacgaaacccgcugggaaucccacacaaacauacucuccuucuaccgcuccuaccucaaagccagaaaggcuuuccuccaauccauaggacgcucugacagggaagagaaccaccgcuuccuccucuugaaagaacccaaaacugaccgccaaacgcuagucgcuggauggaaaagcgaguuucaccuacccagaggaaucuucacagaagcuguccgugacugccucaucgaaaugggauacgacgaagucggaucauauaaagaaguaggcuucauggcaaaagcugucccacuauacuucgagcgcgccugcaaagaucgcguacaacccuucuacgacuaccccuucaacguaggcaacucccucaagcccaaaaagggacgcuuccuuucaaaagagaaaagagcagaagaaugggagucaggcaaagaaagauuccgagaccuggaggcuuggucacacuccgccgcccgccgaaucgaagacgccuuuguaggaaucgaauacgccuccugggaaaacaaaaagaaaauagaacaauuacuacaagaccuuucccuaugggagacuuucgaaagcaaacucaaagucaaagccgacaaaauaaauaucgcgaaauuaaagaaagaaauucucgaagcaaaagaacaccccuaucaugacuucaaauccuggcagaaauucgaacgcgagcuccgccucgucaaaaaccaagauauaauaacguggaugaugugccgugacuuaauggaggaaaacaaaguagaaggccuagacaccgggacgcuauaccucaaagauauacgcacugacguacaagaacaaggcucacuaaacguacugaaccacgucaaacccaugcgccucccagugguggucuaccgcgcggacucccgaggccacgugcacaaggaagaagcaccccuagcaaccgucuacaucgaagagagggacaccaaauuacuaaagcagggcaacuucaagagcuucgucaaagacagacggcucaauggucucuuuagcuucgucgacacuggcgcccuagcaauggaacaauacccaauaagcaaacuccgcgucgaauacgagcucgccaaauaucaaaccgcacgcguaugugccuucgaacaaaccuuagagcuugaagaaucacuccuaacacguuacccccaucugccagacgaauccuuccgagagaugcucgaaucguggagcgacccccugcucgacaaauggccagaccuccaaagagaggucagacuccucauugcagugcggaaugccuucucacacaaccaauaccccauguaugaugaaacuauauucuccucgauccgaaaauacgacccaucuucccuggacgcaauagaggaaaggaugggucugaacaucgcacaccgccuuuccgaggaaguaaaauuggccaaagaaauggucgagcgcaucauccaggccuga

SEQ ID NO: 11796 - RNA, 3360 nt, Artificial Sequence
  Cas13b variant__Porphyromonas gulae__WP_039437199.1__Cas13b
augacagaacaauccgaacgcccauacaacggaacuuauuacacacucgaagauaaacacuucugggccgcuuuccucaaccuggccagacacaacgcguacauaacccucacccacaucgaccgacaacuggcauacagcaaagccgacaucaccaacgacgaagacauccucuucuucaaaggccaauggaaaaaucuagacaacgaccuagaacgcaaaagucgccuccgcucucucauucuaaaacacuuuuccuuccucgaaggagcagccuacgggaagaaauuuuucgaguccaaauccuccggcaauaaaagcucgaaaaacaaagaacuaaccaagaaagagaaagaggaacugcaagccaacgcauuaucauuggacaaucuaaaauccauccuauucgauuuccuccagaaauugaaagacuucagaaacuacuacucccacuaccgacacagcggauccuccgaacuaccccucuucgacggaaacaugcuccagcgccuauauaacguauucgacguaucagugcaacgagucaagagagaccacgaacacaacgacgaagucgacccgcacuaccacuuuaaccaccuaguacguaagggcaagaaagaucgauacggacauaacgauaacccuagcuucaagcaccauuucguagauggcgaaggcaugguuacggaagcugggcuccucuuuuucgucagccucuuccucgaaaaacgcgacgccaucuggaugcagaagaaaauccgcggcuucaagggaggcaccgaaccauacgagcaaaugacaaacgaagucuucugcagaucacgaaucuccuuaccgaagcucaagcucgaaagccuucgcaccgacgacuggaugcuacuagacaugcucaacgaacuuguacgcugcccaaaacccuuguacgaucggcuaagagagaaggaccgcgccugcuuccgagucccaguggacauacuccccgacgaggacgacaccgacggcggcggcgaagaccccuucaagaacacgcucgugcggcaccaagacagguuuccuuauuucgcacuccgauauuucgaccucaaaaaggucuucacgucccugcgcuuccacauagaccucggaaccuaucauuucgcaaucuacaagaaaaugauuggcgaacaacccgaagaccgacacuuaacccgaaacuuauacgguuuuggacgaauccaagacuucgcagaggagcacagaccggaagaauggaaacggcuuguccgagaccuagacuacuucgaaaccggcgauaaaccauacaucucacaaaccacgccacauuaccacaucgaaaaaggaaaaaucggacuccgcuucgucccagaaggacaacaucucuggccauccccagaaguagggacaaccagaacagggcgcagcaaauacgcacaagacaaacgccucacagcagaagcauuccucucagugcacgagcucaugccgaugauguucuacuacuuccuccugcgugaaaaauacagcgaagaaguauccgcagaaaaaguccaaggacguauuaaacguguaaucgaggacgucuacgccaucuacgacgccuucgcacgcgacgaaauaaacacccucaaagaacucgacgccugccucgccgacaaggggauucgccgcggacaccuaccaaaacagaugauaggaauacuaucucaagagagaaaagacauggaggaaaaaguccggaaaaagcuccaggaaaugaucgccgacaccgaccaucgacuagacaugcuagaccgacaaacugaccgcaaaauacgaaucggacgcaagaacgcaggccuccccaaauccggagucaucgcagacuggcuuguccgagacaugaugcgcuuccaacccguugcaaaggacaccuccggaaaaccccucaacaauucgaaagccaacuccacugaguaccggaugcuucaacgggcccuggcccucuucggcggcgaaaaggagcgucuaacgcccuacuuuagacaaaugaaccucacaggcggcaacaacccccacccauuccuccacgagacgcgaugggaaucccacacgaauauccuaucauucuaccgcuccuaccuacgagcccgcaaagcauuccucgaaagaaucggacgcagcgaccgaguggagaacugcccauuccuacuucuaaaggagcccaaaacagaccgacagacccucgucgccggcuggaaaggcgaguuccaccuaccacgagggaucuucaccgaagccguccgggacugccuaaucgaaaugggguacgacgagguaggcagcuaccgcgaaguaggcuucauggcaaaggccgugccccuguacuuugaacgagcaugcgaagacagaguccaaccguucuacgacucucccuucaaugucggaaacagccucaagcccaagaaaggccgguuucuuaguaaagagaaacgcgccgaggaaugggaaagcggaaaagaacgauuccgccuggcaaagcucaagaaagagaucuuagaagcccaggaacacccauaucacgacuucaaaagcuggcagaaauucgaacgggaacugcgcuuagucaagaaccaagacaucaucacauggaugaugugccgcgaccucauggaagaaaauaaagucgagggccuagauaccggcacccuauaccuuaaggacauccgaccaaacguccaagaacagggcagccuaaauguccucaaccgcguaaaaccuaugcggcuaccagucguggucuaccgcgccgacucacggggacacgugcauaaagaggaggcccccuuagcaacaguauacaucgaagaacgagacaccaagcucuuaaagcaaggaaacuucaaauccuuuguaaaagacagacggcugaacggucuauucucauucgucgacaccggagccuuagccauggagcaauaccccauuucaaaacuccgaguagaauaugagcuagccaaguaccagacagcgcgaguaugcgcuuuugaacaaacgcucgaauuagaagagucacuccucaccagauacccacaucuacccgacgaguccuuccgggaaaugcucgaauccugguccgauccccuacuaaccaaauggccagaacugcacggcaaagucagacuccuaauagcagucagaaacgcauuuucccacaaccaauauccaauguacgacgaggccgucuucuccuccauauggaaauaugacccgagcagccccgaugcaaucgaggaacggaugggucugaacaucgcucacagacucuccgaagaaguaaaacaggcaaaggaaaccaucgagcgcaucauucaagcauag

SEQ ID NO: 11797 - RNA, 3360 nt, Artificial Sequence
  Cas13b variant__Porphyromonas gulae__WP_039419792.1__Cas13b
augacggaacagagcgagcgcccguauaacggcaccuacuacacacucgaagacaaacacuucugggccgccuuucuaaaccuggcacgacacaaugcauacauaacccuaacccacauagaccgccaauuagccuacagcaaagccgacauuaccaacgaccaagacguccuaucguucaaagcccucuggaaaaaccuagacaacgaccuggaacguaaaagccgccuccgcucccugauccuaaagcauuucagcuuccuagaaggagcagcauacggcaaaaagcucuuugagagcaaaagcuccggcaacaaaagcucgaaaaacaaagaacucaccaagaaggaaaaggaggaacuccaggcgaacgcccuaucacuagacaacuuaaagucaauccuguucgacuuccuacagaaauuaaaggauuuccgcaacuacuacagucacuaccgucauuccggcuccucagagcucccccucuucgacggaaauaugcuccagcgccucuauaacguguucgaugugagcguucaacgcguaaaacgagaccacgagcacaacgacaaaguggacccacaccgccacuucaaccaccuaguaagaaaggggaagaaagaccgcuacggccacaacgacaaccccagcuucaaacaucauuucguagauggugagggaaugguaaccgaagcuggacuccuguucuucguaucacuauucuuagagaaaagagacgcgaucuggaugcagaaaaagauccgaggcuucaaagggggaacagaaaccuaccaacaaaugaccaacgaagucuuuugccgcucacgaaucucccuuccaaagcuaaaacuagaaagccuccggaccgacgacuggaugcuucucgacaugcucaacgagcuaguacgaugccccaagccccucuacgaccgacuaagagaaaaggacagagcacguuuccgagucccgguagacauacuacccgacgaagacgacaccgauggcgggggugaagaccccuucaaaaacacccugguaagacaucaagaccgauucccguacuucgcacuccgauacuucgaccuuaagaagguauucacaucccuccgcuuucacauagaccuagguaccuaccacuucgcgauauacaagaaaguuaucggagagcaaccagaggaccgccaucucacuagaaaccucuauggguucggccggauccaagauuucgcagaggagcaccgcccggaggaauggaagcgccucguccgggaccucgacuacuucgagaccggcgacaaaccguacaucucucaaaccacgccucacuaccauauagagaaaggcaagauaggccuccgcuuugugcccgaaggacaacaccucuggcccucaccggaggucgggacaacacggacuggcagaagcaaauacgcccaagacaagcgguugacggcagaagcauuccucuccguacacgaacucaugcccaugauguucuacuacuucuugcuacgggagaaguacagcgaagaaguauccgccgaaaaagugcaaggacgaauaaaacgugugaucgaggacguauacgcaauauacgacgccuucgcccgcgacgaaaucaacaccagggacgaacuagacgcaugucuugccgacaaaggaauacggagaggccaccuaccgaaacaaaugaucgggauacugucucaagagcacaaaaacauggaagaaaaagucagaaagaaacuacaagaaaugaucgccgacaccgaccacaggcucgacaugcuugaccgacagaccgaccggaaaauucguaucggacgaaagaacgcuggccuacccaaauccggaguaaucgcagacuggcuuguacgagacaugaugagauuccaacccgucgccaaagacaccaguggaaaaccgcuaaacaacagcaaagcgaacuccaccgaguacagaaugcugcaacgugcacuagcacucuucgggggagaaaaagaacgccuaaccccuuacuuucgccagaugaaccucaccggagggaacaacccccacccauuucucgaugagacacgaugggaaucacacacaaacauccucucauucuaccgaucguaccuucgggcccgaaaggcuuuccucgaaaggaucggccgaagcgaccgaguagaaaaccgacccuuccuccuacuaaaggagccgaaaacagacagacaaacccuagucgcaggcuggaaaagugaauuucaccuaccccgaggaaucuucacagaagcaguccgggacugccucaucgaaaugggcuacgacgaagucggcuccuacaaagagguaggguucauggccaaagccgugccacuauacuucgaaagggccugcaaggaccgcguacagcccuucuacgacagcccguucaacguagggaacagccucaaaccaaagaaaggccgcuucuuaagcaaagagaaaagagcggaagaaugggagagcgguaaagaacgauuuaggcucgccaaacucaagaaagaaauccuggaggcacaagaacacccguaccacgauuucaaaagcuggcaaaaauucgaacgagaacuacgccuaguuaaaaaccaagacauaauuacauggaugaugugcagagaccuaauggaagaaaacaaaguagaaggccuggacaccggaacgcuguaccucaaggacauaagaccaaacguacaagagcagggaucccugaacguccucaaucgaguaaaaccaaugcgucugccagucgucgucuaucgggcagacucacgaggccacguccacaaagaagaagcaccccucgccacagucuacauagaagagagagauacaaagcuccugaaacaaggaaacuucaagagcuucguuaaagaccgcaggcuaaacggacuuuucagcuuuguggacaccggaggacuagccauggaacaauacccaauaagcaaacuccgaguagaauacgaacuggcaaaauaccaaacagcacgcguuugugucuucgaacugacacuacgacuugaagagagucuacuaucgcgauacccccaccuacccgacgagagcuuccgcgaaaugcuggagucauggagugacccacuccucgcuaaguggccggaacuccacggaaaaguccgccuccucauagccguccgcaaugcauucagccacaaccaauauccgauguacgacgaagcgguauucuccagcauccgcaaauacgaccccaguagcccagacgcaaucgaggagagaaugggacuaaacauagcucaccgccuaagcgaggaggugaaacaagcaaaagaaacaguggaacgcaucauccaggcauga

SEQ ID NO: 11798 - RNA, 3528 nt, Artificial Sequence
  Cas13b variant__Porphyromonas gulae__WP_039431778.1__Cas13b
augacagaacagagugagagacccuacaacggaaccuacuacacccuggaagacaaacacuucugggccgcauuccucaaccuggcgagacacaacgccuacaucacccuaacgcacaucgaccgacaacuagcauacaguaaagcagacauaaccaacgaccaagauguccucuccuucaaagcacuuuggaaaaauuucgauaacgaucucgagagaaaaagccgccucagaagccuaauucucaaacacuuuucauuccuggaaggugcagcauaugguaagaaauuauucgaaaguaaaucauccggaaauaaauccuccaaaaacaaagagcucacaaagaaagaaaaagaagaacuccaggccaacgcacugucucucgacaaccugaaauccauucuuuucgacuuccugcagaagcugaaagacuuccgaaacuacuacagccacuaccgacacucagaguccucugaacugccccuauucgacggcaacauguuacaacgacuauacaacguauuugacgucagcguccaacggguaaaaagagaccaugagcauaacgacaaaguagacccacaucgccacuuuaaccaucuaguaaggaaagggaagaaagaccgcuacggccacaacgacaaccccuccuucaagcaucacuucgucgacggcgaaggcaugguaacggaagcaggccuucuguucuucguaagccuauuccuagaaaaacgcgaugcaaucuggaugcaaaagaaaauuagaggcuucaaagggggaacggaaacauaccaacaaaugacaaacgaaguauuuugcagaucccgaauaagccuacccaagcugaaacucgaaucgcuacgaacugacgacuggauguuacucgacaugcucaacgaacugguccgcugcccaaaaccccuauaugaucgacuacgcgaagacgaccgcgcgugcuuccgcguccccgucgacauccuuccagacgaagacgacaccgacggaggaggugaagacccguucaaaaauacgcucguaagacaccaagaccgcuuccccuauuucgcccuaagauacuucgaccuaaagaaaguauucacaagccuacguuuccauauagaccucgggaccuaucacuucgcgauauacaaaaagaugaucggcgaacaacccgaagaucgccaccucacgcgcaaucucuacggguucggacggauccaagacuucgccgaagaacaccgcccggaagaguggaagcgccuaguccgagaucucgacuacuucgagaccggcgacaagcccuacauaucccaaacauccccacacuaccauaucgagaagggaaagaucggacuacgauucaugccugaaggacaacaccuuuggccaucccccgaagucggcacaaccagaacaggcagaagcaaguacgcccaagacaagcggcuaaccgcggaggcauuccuauccguacacgaacuaaugcccaugauguucuacuacuuccuccuacgagaaaaauacucagaagaaguaagcgcggaaaagguacagggaaggauaaaacgcgucauugaggacgucuacgcaaucuacgacgcauucgcacgcgaugaaaucaacacgcugaaagaacuggacgccugccuggccgacaaaggcauucgcagaggacaccuaccgaagcagaugaucgccauacuaucccaggagcacaaagacauggaagagaaaaucagaaagaagcuacaagaaaugauugcagacacagaccacagacuggauaugcuggacagacaaacggaucgaaagauacggaucgguaggaagaacgcggggcuccccaaaaguggcguaauagcggacuggcugguccgugacaugaugcgcuuccaaccagucgcaaaagacaccagcggcaagccacuuaauaacuccaaggcaaacuccacggaauaccgaaugcuccaacgugcacuugcucucuucgggggcgagaagaaaagacuuacacccuacuuccgccaaaugaaccuaacaggaggaaacaacccccaccccuuccuacacgaaacgcggugggaaagccacaccaacauccucuccuucuacagaucauaccuaagagccaggaaagcauuccucgaacgaaucggaaggucagaccguauggaaaacagacccuuccuacugcucaaagaacccaaaacggaccgacaaacccuaguggcaggauggaaaagcgaauuucaccuccccagaggcauauucacagaagcuguccgcgacugccucauagaaaugggauacgacgaagucggaucguaccgagaagucggguucauggccaaagccgugccucuuuacuucgaaagagccugcgaagacaggguacaacccuucuaugacucaccuuuuaacgucggcaacagccuaaagcccaaaaagggaagguuccucucaaaagaggagcgcgcagaagaaugggaaagaggcaaagagcgcuuccgcgaccucgaagcguggagucacuccgcagccagaaggaucgaagacgccuucgccggaaucgaauacgccagccccggaaacaagaagaaaauagaacaacugcugcgggaucuaagccucugggaagcguucgagagcaaacuaaaaguucgagcggacaaaaucaaccuggcaaaacuaaagaaagaaauccuagaagcccaggagcaccccuaccacgacuucaaaagcuggcaaaaauucgagcgcgaacuccgacucgugaaaaaccaagacaucauaaccuggaugaugugccgagaccugauggaggaaaacaaagucgagggccuagacacaggcacccucuaccuaaaagacauaagaccaaacguacaggaacaaggcagucuaaacgugcuuaaccgcgucaaaccuaugaggcuccccgucguagucuaccgagccgacucccguggccacguacacaaagaggaagccccacucgccaccguguacaucgaagaacgcgacaccaaacuacuaaaacaaggcaacuucaaaucauucgucaaggaucgacgcuugaauggccuauuuucguucguagauaccggaggauuagcgauggaacaguaccccaucuccaagcuccgggucgaauacgagcuugccaaauaccaaaccgcccgugucugugucuuugaacucacccuacggcuggaagaaucacuccuaacgcguuacccccacuuaccagacgaauccuucaggaaaaugcucgaaagcugguccgacccccuccuagccaaauggccagagcuccacggcaaagugcggcuucuaauagcggucaggaacgcauucucgcacaaccaguaccccauguaugacgaagccguauucucgucuauccguaaauacgaccccagcagcccggacgccaucgaagaacgcaugggccuaaacaucgcacaccgucuaucugaggaagugaaacaagccaaagaaacgguugaaagaaucauucaagucuaa

SEQ ID NO: 11799 - RNA, 3528 nt, Artificial Sequence
  Cas13b variant__Porphyromonas gulae__WP_046201018.1__Cas13b
augacagaacaaagcgagaggcccuacaacggcaccuacuacacccucgaggacaaacacuuuugggccgcauuccuaaaccuagcccgccacaaugccuacaucacacugacacauauagaccggcagcuggcauacagcaaggcagauaucacgaaugaccaagacguccuaagcuucaaagcgcuguggaaaaauuucgacaacgaccuggaacgcaaaucccgacuaagaucacucauccuuaaacauuuuuccuuccuggaaggagccgcauacggcaagaaacucuuugagucgaaaucgagcggaaauaaauccucaaaaaauaaggagcucacgaaaaaagaaaaagaagaacugcaggcaaacgcacucagucuggacaaucugaagagcauccuauucgacuuccugcaaaagcuaaaagacuucagaaacuauuauucacacuaccgacauuccgaaagcucagagcuaccacuauuugacggcaacaugcuucaacgacucuacaacguauucgacgucagcguccaacgugucaagagagaccaugaacacaacgacaaagucgacccucaccgucacuucaaccaccucgucagaaaaggaaaaaaagauagauacggccacaacgacaacccgaguuucaaacaccacuucguagauagugaagggauggucacagaagcuggacugcuauucuucgucagccucuuccuagaaaaaagagaugcaauuuggaugcaaaaaaaaauccgcggauucaaggguggaacugaaacguaccaacaaaugaccaacgagguuuucugccgcucacguauaucucucccgaaacuaaagcucgaaucgcuaagaaccgaugacuggaugcuccuagacaugcucaacgaacucgugcgcugccccaaaccacuauacgacaggcuccgcgaaaaggaccgugcgcgcuuccgcguccccguggacauucugccugacgaagacgacacggacggaggaggcgaagaccccuucaagaacacccucgugcgacaccaagaccguuuuccauacuucgcacucagauauuucgaccuaaaaaaaguguucacaucgcugcguuuccacauagaccuaggaacauaucacuucgccauauacaaaaaaaugauaggcgagcagcccgaggaucgucaccucacgagaaaccucuacggcuucggccgcauacaagacuucgcagaagaacacaggcccgaggaauggaagcgacucgugagggaccuggacuacuucgaaacaggggacaaacccuacaucagccaaaccacuccccacuaccacaucgagaagggaaaaaucgggcuacgcuucaugcccgaaggacaacaucuauggcccucccccgaaguuggaaccacaagaacaggccguagcaaauacgcucaggauaaacgccucacggccgaggccuuccucucugugcacgaacucaugccgaugauguucuacuacuuucuacuccgcgagaaauauuccgaagaaguauccgcagagaaaguccaaggucguaucaaacgcguaauugaggacgucuacgccaucuacgacgccuucgcucgagacgaaauaaacacccucaaagaacucgacgcaugccucgcugacaaaggcaucagaagaggccacuuacccaaacagaugauagccauacucagccaagagcacaaagacauggaggaaaaaauaaggaaaaagcuccaagaaaugauagcagacacagaccaccgccuagacaugcucgaccgccaaaccgacagaaaaauucgaaucggccgaaaaaaugcaggccucccgaaaagcggcgucauugcggauuggcucguaagagacaugaugagauuccaacccguggccaaagacacgucaggcaaaccacuaaacaacagcaaagcgaacucaaccgaauaucgaaugcugcaaagggcacuagcacuauucggaggcgaaaaaaagcgacuaacgcccuacuuccgacagaugaaccugacaggcggcaacaacccacacccguuccuacacgaaacacgcugggaaucacacacaaacauauuaucauucuaccgcucguaccugcgcgcgcgcaaagccuuccuggaacgcauaggacgcagcgaucgcauggaaaaccgcccguuccuacuauuaaaagaacccaagacagaucgacaaacccucgucgccgguuggaaaagcgaauuccaccugccacgcggcaucuucacagaggcaguacgagacugucuaauagaaaugggauacgacgaaguaggcagcuacagagaagucggauucauggccaaggccguaccgcuauacuucgaaagggccugcgaagacagaguacaacccuuuuacgacucgccuuucaacguaggaaacucgcuaaagccgaagaaaggccgcuuccucagcaaggaagaacgcgccgaagagugggaacgcgguaaagaacgauuucgcgaccucgaagcauggucccacagcgccgcaagacgcaucgaggacgcuuuugcaggcauagaguacgcaagcccaggcaacaaaaaaaagaucgaacagcuacuccgcgaucucucccuaugggaggccuucgaaagcaaacucaagguacgagcugacaaaauuaaccuggcaaaauuaaaaaaagaaauccucgaagcccaggagcacccauaccaugacuucaaguccuggcaaaaguucgaacgcgagcuccgccuugugaagaaccaagacaucauaacguggaugaugugcagagaccucauggaggaaaauaaggucgaaggccuggauacgggcacacuguaccuuaaagauaucagacccaacguccaggagcaggguagccucaacguucucaacagagucaaaccaaugagacuacccgucgucguguacagagcagacagccgggggcacguacacaaggaagaggcaccucuagcuaccguauacauagaagagcgcgacaccaagcuccucaagcagggcaacuucaagaguuuugucaaagaucgacgcuugaacggacuauucagcuucguggacacuggcgggcucgcaauggaacaauacccaauuucaaaacucagagucgaauacgaacuagcaaaauaccagaccgcacgagucugcguguucgagcuaacgcuccggcucgaagaaucgcuacucacccgguacccccaccuacccgacgaaucauucagaaaaaugcucgaaaguuggagcgacccucuccuggcaaaauggccugaacuccacggaaaaguccgacuccucauagcaguacgaaacgcauucucccacaaccaguaucccauguacgacgaagcgguauucagcagcauaaggaaguaugacccgaguucuccggacgccauagaagagcgaaugggacugaacauagcccacagacugagcgaagaagugaaacaagcaaaagaaaccguggaaagaaucauacaaguuuaa

SEQ ID NO: 11800 - RNA, 3525 nt, Artificial Sequence
  Cas13b variant__Porphyromonas gulae__WP_039442171.1__Cas13b
augaccgaacaaagcgaaaggcccuauaacggaacguacuacacccucgaggacaaacauuuuugggcugcauuccuaaaccuugcccggcacaacgcauacaucacgcuuacgcacauagaccgccaacucgccuacagcaaagcagacauaacaaacgaccaagacguccuauccuucaaggcccuauggaaaaaccuagacaacgaccucgaaagaaaaucccgccuccgcucgcuaauccuaaaacacuucaguuuccucgagggagcagcguacggaaagaaacucuucgagagcaagagcagcgggaacaaguccagcaaaaacaaggaacuaacuaagaaagagaaggaagaguuacaagccaaugcccucucccucgacaaccugaaaucuauccucuuugacuuuuugcaaaaauuaaaggauuuccggaacuacuacucccacuaccggcacagcgguuccucagaacucccacucuucgacggcaacaugcuucaaagacucuacaacguauucgacgucucgguacagcgaguaaaaagagaccacgagcacaacgacaagguggacccccacuaccacuucaaccaccucguucgcaaagggaagaaagaccgauacgggcacaacgacaacccaaguuucaaacaccacuucgucgacagcgaaggaaugguaacggaggcagggcuccuauucuucguaagucuauuccucgagaaaagagacgccauauggaugcaaaagaaaauaagaggauucaaaggaggaaccggaccauacgaacagaugaccaacgaaguauucugucguagcagaauaucacucccaaaacucaaacucgaaucacuacgcacggacgacuggaugcuucucgacaugcugaacgaacugguacgaugccccaaaccucuguacgaccgccuaagagaaaaagaccgggcaugcuuccgagucccaguagacauacuccccgaugaagaugacaccgaugggggcggcgaagaccccuuuaaaaacacccucgucagacaucaagaccgauucccauacuucgcccugcguuacuucgaccuuaagaaaguauuuacaucccugcgauuccacaucgaucucggcacauaccacuucgcgaucuacaagaaaaugaucggcgaacaacccgaggaccgccaccuaacgcgcaaccucuacggcuucggaagaauccaagacuucgcagaagaacacagaccagaggaauggaaacgccuaguacgagaccuugacuaccucgaaacaggcgacaaaccauauaucucacaaacuaccccgcauuaccacauagaaaaaggcaagauaggacuacgcuuuguuccagaaggccaacaccucuggccaucaccagaaguaggcaccacgagaaccggccgaagcaaaugcgcacaagacaaacgacucaccgcggaagccuucuuaucuguccacgaacugaugccuaugauguucuacuacuuccuacuccgagagaaauacucagaagaggucagcgccgagaaaguacaagggcgaauaaaacgugucauugaggacguauacgcaauauacgacgcguuugcccgcgacgaaauaaacacccucaaagaacuugauaccugccucgccgacaaaggaauccggagagggcaccucccuaagcaaaugauaacaauacucucacaagaacguaaagacaugaaagagaaaauccgaaagaaacuccaagaaaugauagccgacaccgaucaccgccuagacaugcuagacagacaaaccgacagaaaaauccgcaucggacgcaaaaacgcgggcuuaccaaaaucuggcgucauagcggacuggcuagugcgggacaugaugcgcuuccaaccgguagccaaagacgccagcggaaaaccccucaacaacagcaaagcuaacucaaccgaauaccgcaugcugcaacgggcacucgcccucuucggaggggaaaaagaacgccuuacccccuacuuccgccaaaugaaccucaccggcggaaacaacccccacccguuccuacacgaaacccggugggaaagucacacgaacauccuuagcuucuacaggucuuaucuacgggcucgaaaagcauuccuggaaaggauugggcguagcgaccgcgucgaaaacugcccguuccuacucuuaaaagaacccaaaacagacaggcaaacguuagucgccggauggaaagacgaguuccaucugccccgaggcauauucacggaagccgucagggacugccuaauagaaaugggcuaugacgaagucggcuccuaccgcgaaguaggauucauggcaaaggcagucccgcuguacuucgaacgcgcaugcgaagaccggguacagcccuucuaugauucacccuuuaacgugggaaacagccuuaagcccaagaaaggacgguuccucagcaaggaggacagggcagaggagugggaacgcgggauggagcgguuccgagaccuagaagcauggagccacucagccgccagacguauuaaggacgcguucgcgggaauagaguacgcaucccccggaaacaagaagaaaauagaacaauuacuaagggacuuaagccuaugggaggcuuuugagucaaaacugaaaguaagagcagacaagaucaaccuggcaaagcucaaaaaggaaauacuagaagcccaagagcaccccuaccacgacuucaaaucauggcagaaauucgagcgagagcuacgucuggucaaaaaccaagacauaaucaccuggaugaugugccgagaucuaauggaagaaaacaaaguagaaggucucgacacgggcacccuauaucuaaaagauaucaggccgaacguacaggaacaaggcagccuaaacguccugaaucgcguaaaaccaaugcgucugcccgucguaguauaucgggcagacagccggggacauguccacaaggaggccccacucgcaaccguguacaucgaagagagaaacacgaagcuacucaaacagggcaacuucaagagcuuugucaaagacagaaggcugaacggccuauucucguucgucgacaccggcggacucgcaauggaacaauacccgauuucaaaacuacggguagaauacgaacuugccaaauaccaaacagcccgagugugcguguucgagcuuacccuacggcuagaagagagccuccuaagcagguacccacaccucccagacgagagcuuccgagaaaugcucgaaucauggucggacccccuacucgccaaauggccagagcuucacggcaaaguucggcuacuuauagcagucaggaacgcguucagccacaaccaauaccccauguacgacgaagcaguuuucaguucaauacgaaaauacgaucccaguagcccagacgccaucgaagaaagaaugggccuaaacauagcacauagacuuucagaagaaguaaagcaagcaaaagaaacagucgaaagaaucauacaagcauaa

SEQ ID NO: 11801 - RNA, 3360 nt, Artificial Sequence
  Cas13b variant__Porphyromonas gulae__WP_039426176.1__Cas13b
augacugagcaaagcgagcgccccuacaauggaaccuauuacacacuagaagacaaacacuucugggccgcauuccucaaccuagcacggcacaacgccuauauaacccuuacgcacauagaccggcaacuggcauacuccaaagcagacauaaccaacgaccaagacguacucagcuuuaaagcccucuggaagaacuucgacaaugaucucgagcgcaagagucgcuugcgaaguuuaauccugaaacacuucagcuuccucgaaggggccgcauacggcaaaaagcuauucgaaagcaagagcuccggaaacaagagcagcaaaaauaaagagcuaacgaaaaaggaaaaagaggaacuccaagcaaacgcacuuucacuggacaaucucaaaagcauccucuucgacuuccuacaaaaacugaaagacuuccggaauuauuacagccacuaccgacacuccggaucaagcgaauuaccucuuuucgacggcaacaugcuacaaagacucuacaacgucuuugacguuuccgugcaacgcgucaaaagagaccacgagcacaacgacaaaguagauccacacuaccacuucaaccaccuagugagaaagggcaaaaaggaccgcuacggacacaacgacaaccccagcuucaaacaccacuuugucgacucggagggaauggugacagaggcuggccuacucuucuucgucagccuauuccucgagaaacgggacgccaucuggaugcaaaagaaaauacgcggcuucaaaggcggaacaggacccuacgaacaaaugacgaacgagguauucugccggagccgaauaucgcuaccaaaauugaaacucgaaucccugcgcaccgacgauuggaugcuacuugacaugcucaacgagcucgugcgaugccccaaaccccuuuaugaccgauuacgagagaaagauagagcaugcuuccgcguaccagucgacauccucccagacgaggacgacacagauggaggaggagaggacccuuucaaaaacacccucguccgccaccaagaccgcuuccccuacuucgcuuuacguuacuucgaccucaagaaaguuuuuacaucacugcgauuucacauagaucucggaacguaccacuuugccaucuacaagaaaaugaucggcgaacaaccagaggaccgacaccuaacacggaaccuguacggcuucggcaggauucaggacuucgcggaagaacaccgacccgaggaauggaaacgccugguccgagaccucgauuacuucgagacuggcgacaagccguacaucagccaaaccacgccacacuaccauauugaaaaaggcaaaauaggacuccgauucaugcccgagggccaacaccucuggccaagcccugaggucgguacgacacgcacagggaggaguaaauacgcacaagacaaacgacugaccgcggaggccuuucuauccguccacgaacuaaugcccaugauguucuacuauuuccucuuacgagaaaaauacuccgaggaagucagcgccgaaaagguccagggcagaaucaaaaggguaaucaaagaugucuacgccaucuacgacgccuucgcccgagacgaaaucaacacacuuaaagaacuagacgcguguucagcugacaaaggaauccgacgcggacaccuccccaagcagaugauugggauccuaucccaagaacacaagaacauggaagagaagguccggaagaaacugcaggaaaugaucgcagauacggaccaucgccuugauaugcuggacaggcagacagacaggaaaauccgcaucggaagaaagaacgccggccuccccaaaucaggugucaucgcugauuggcuaguucgagacaugaugcgauuccaacccgucgcaaaggauacaagcggaaaaccccuaaacaacucaaaggccaacagcacagaauaccgcauguuacaacgcgcccuggcccucuucggcggggaaaaagaacgcuuaacaccguauuucagacagaugaaccuaaccggaggcaacaacccgcacccauuucuagacgaaacacgaugggaaagccauacgaacauacuguccuucuaccgauccuaccuacgagcccgcaaagcauuccucgaacgcaucgggcgguccgaccgcguggagaaucgaccuuuccugcuucugaaagaacccaaaaacgacagacaaacgcuagucgccggcuggaagucagaauuucaccuaccgcgagguaucuucaccgaagcagucagagacugccuaaucgagaugggcuacgacgaaguggguucguacaaggaaguaggcuucauggcgaaggcaguuccccucuauuucgaacgagcaugcaaagaccgcguacaaccuuucuacgacucccccuucaacgugggcaauagccuaaaaccgaagaaagggcgauucuuauccaaagagaaaagggcagaagagugggaaagcggaaaagaaagauuccgacucgccaaacuaaagaaagaaauccucgaagcgaaagaacacccauaccacgacuuuaaaagcuggcaaaaauucgaaagggaacugcgccucgucaaaaaucaagacaucauaacguggaugaugugccgcgaccuaauggaagagaacaaaguagaaggacuggacacaggcacgcucuaccucaaagacauacgcacagacguacacgagcaaggcagccugaacguccucaaccgcgugaagcccaugcgcuuaccgguagucgucuaccgcgccgacagcagaggccacguacacaaagaacaagcgccccucgccaccguuuauaucgaagaacgcgacaccaagcuacuuaaacagggcaacuucaagagcuucguaaaggaccgccggcucaacgggcuauucagcuucguagauacaggagggcuugcuauggaacaguacccaauaagcaagcugcgcguugaguacgagcuggcaaaauaccagacggcccgcguuugcgccuucgagcaaaccuuggaacucgaagaaucccuguuaacaagauacccacaucugccagaugaaaacuuuagagaaaugcuagagucauggucugacccacuacuagggaaauggcccgaccuacacgggaaaguacgccuacuaauagccgucagaaacgcguucagccacaaccaauaccccauguacgacgaagccgucuucagcucaauccgaaaauacgacccgagcuccccggacgccauagaggaaagaaugggcuuaaacauagcacaccgucuaagcgaagaggucaaacaagccaaagaaacggucgagcgaauaauccaagccuaa

SEQ ID NO: 11802 - RNA, 3528 nt, Artificial Sequence
  Cas13b variant__Porphyromonas gulae__WP_039418912.1__Cas13b
augacggagcaaagcgaacgcccauauaauggaacauacuauacccucgaagacaaacacuucugggccgcauucuuaaaccucgcgcgccacaaugccuacaucacacuuacccauauagaccgucaacucgcauauucaaaggccgacaucaccaacgaccaagacguccugagcuucaaagcccuauggaaaaaccuugacaacgaucuagaacgcaaaagccggcuacgcucacugauacucaagcacuucuccuuccuugagggggccgccuacggaaagaaacuauucgaaucuaaguccucagguaacaaaagcagcaaaaacaaggaacugaccaaaaaggaaaaagaggaacuccaagccaacgcgcuaucacuagacaaucuaaaaagcauccuuuucgacuuccuacaaaagcucaaagacuuucgcaacuacuacucccacuaccgccacagcggauccucugaacugccguuauucgauggcaacaugcuccaacgccucuacaacguauucgacgucuccguccaacgcguaaagcgugaccacgaacacaacgauaaaguggacccacaccgacacuucaaccaccucguccgcaaaggcaagaaagacagguacggacacaaugacaacccuuccuucaaacaucauuuuguagacagcgaaggcauggucaccgaagcaggccugcuauucuucgucucccuuuuccuggaaaaacgcgacgcaaucuggaugcagaaaaagauccgcggguucaaaggcgggacagaaacauaccaacagaugacaaacgaggucuucugccgcucccgaaucucacuacccaaacuuaaauuggaaucacuccgaauggacgacuggaugcucuuagauaugcucaaugagcuggugagaugcccaaaaccccucuacgaucgccuaagggaggacgacagagcaugcuuccgcgugccagucgacaucuuaccagacgaagacgacacggacggaggcggcgaggacccguucaaaaacacguugguuagacaucaggauagguucccguacuucgcccuccgcuacuuugaccugaagaaagucuucaccucucuacgauuccacauagaccucggaaccuaccacuucgcaauuuacaagaaaaugaucggggaacaaccagaagaccggcaccucacccgaaaucucuacggcuuuggccgaauccaagacuucgcggaggagcacagacccgaagaauggaaacgccugguacgugaccuagacuacuucgaaacaggugacaaacccuacauaagccaaacaagcccccacuaccauauagaaaaagggaaaaucggccucagauucaugccagagggccaacaccucuggccaucgccagaggucgggacaacuagaacggguagaaguaaauacgcccaggacaaaagacucaccgccgaagccuuucucucaguacaugaacucaugcccaugauguucuacuacuuccuucuucgcgagaaauacucggaagaggugucggcagaaaaaguacaaggcagaaucaaacgcguaaucgaagacguguacgccauauacgacgcguucgcccgcgacgaaaucaacacgcuaaaagaacuggacgccugccuagcugacaaagggaucaggcggggacaccucccgaagcaaaugaucgcgauucuaucccaggaacacaaaaacauggaagaaaaagugaggaagaaacuccaagaaaugaucgcagauacggaccaccggcucgauaugcuagaccgucaaaccgacaggaaaauccgaauagggcgcaaaaacgccgggcugccaaagagcggaguaauugccgacuggcuagugcgagacaugaugcgauuccaacccguagcgaaggaugcaucaggcaaaccacucaacaauuccaaagccaacucaaccgaauaccgaaugcuccagcgagcacuugcccuguucgguggugagaaagagcgacuaacacccuacuucagacagaugaaccugacaggcggaaacaacccccaccccuuccugcacgacacacgaugggagagccacacuaacauccuaucuuuuuaccgaucguaucuccgggcucgaaaagcauuccucgaacgcaucggccgcagcgaccggauggaaaaccguccguuccuacugcucaaagaacccaagacggaccgacagacgcuaguugcuggcuggaaaagcgaguuccaccucccccgcggaaucuucacagaagcaguccgcgacugccuaaucgagaugggcuacgacgaggucgggagcuaccgggaaguaggauuuauggcaaaggccgugccccuauacuucgaacgcgccugcgaagaccgaguacaaccauucuacgauuccccguuuaaugugggcaacucacuaaagccaaagaaagguagauuccucucaaaagaagaacgcgcugaagagugggaacgcgguaaagaacguuuccgagaccucgaagccuggagucacagcgccgcccgacgcaucgaagacgcuuuugcaggaaucgaauacgcaucgccaggaaacaaaaagaaaauagagcaacuacuccgagaccuaucccuuugggaagcauucgaauccaaacucaaagucagagcagacaagauaaaucucgcuaaacucaaaaaggaaauccuagaagcacaagaacacccguaccacgacuucaagucguggcagaaauuugagcgagaacuucgacucguuaaaaaucaggacauaauaaccuggaugaugugccgcgaccuaauggaagaaaacaaagucgaagggcucgacacaggaacgcuauaccuaaaggacauacgcacgaauguacaagaacaaggcagccugaacguacugaaccacgucaagcccaugcggcucccagugguagucuaucgcgcggacagccgcggacacguccacaaagaagaagcaccccuagccacagucuacauugaggaacgagacaccaaacuacuaaagcaagggaacuucaaauccuucguaaaagaccgccgauugaauggacuuuucucuuucguagacacaggaggccuggcaauggaacaauaccccaucucgaagcuacgaguagaguacgaacuagccaaguaucagaccgcacgagucugugccuucgaacaaacgcucgagcucgaggagagccuacuaacacgguacccacaccuacccgacaaaaacuuccgcaagaugcuggaaagcuggucagaccccuugcuggcaaaguggccagaacuccacggcaaagucagacuacucaucgccgugagaaacgcguucagccacaaucaguaucccauguacgacgaagccguguuuagcucaaucagaaaauacgacccauccagccccgacgccaucgaagaaagaaugggcuuaaacaucgcucaucgucuaagugaggaagucaaacaggcaaaagaaaccgucgaacgaauuauccaggccuga

SEQ ID NO: 11803 - RNA, 3528 nt, Artificial Sequence
  Cas13b variant__Porphyromonas gulae__WP_039434803.1__Cas13b
augacagaacaaagcgaacgcccauauaacggcaccuacuacacccuagaggacaaacacuucugggccgcguuccugaaccucgcccgacacaacgcguacaucacacucacccacauagaccggcaacuagcguauuccaaagcagacaucaccaacgaccaagacguacucagcuuuaaggcacuauggaagaacuucgacaacgaccuagaacgcaaaagccggcuuagaucccuaauccucaaacacuucagcuuccucgagggagccgcauacggcaagaaacucuucgaaagcaaauccagcgggaacaaaucaagcaaaaacaaagaacucaccaagaaagagaaagaagaacuccaggcgaacgcauugagccucgacaaccucaaaagcauccucuucgacuuucuccaaaaacucaaagacuuccgcaacuacuacucacacuaccgccauucuggcaguucagaacugccccuguucgacgggaacaugcuccaacgacuguacaacguuuucgauguuagcguacaacgcgucaaaaucgaccacgaacauaaugaugaaguagauccacauuaccacuucaaccaccucguucgaaaagguaagaaagaccgcuacggacacaacgacaaucccuccuucaaacaccacuucgucgacggcgaaggaauggucacagaggcgggucuccucuucuucguaagccuauuucucgagaaacgcgacgcaauauggaugcaaaagaaaauccgaggcuucaaaggcggcacagaaaccuaccaacaaaugacuaacgagguuuucugccgaagccgaauaucacuuccaaaauugaaauuagaaucacuccguauggacgacuggaugcuauuggacaugcuaaacgaacugguaagaugcccaaaaccacucuacgaccgacugagagaagacgaccgcgccugcuuccggguccccgucgacauccuccccgacgaagacgauacagacggagguggggaagaccccuucaaaaacacgcucguccggcaccaagaccgauuccccuauuucgcgcuuagauacuucgaccuaaagaaaguuuucacaucacuucgcuuccacauagaccuaggaaccuaccauuucgcgauauacaagaaaaugaucggcgaacagccagaagaccggcaccucacgaggaaccuguacggcuucggcagaauccaggacuucgcugaagaacaccgaccagaagaauggaaacgccuagucagagaucuagacuacuucgagacgggagacaaacccuacauuucgcagacaucaccacacuaccacauugaaaaagggaaaauaggccugcgcuuuaugccagaaggccaacacuuguggcccuccccggaagucgggacuacacgcacaggccgaucaaaauacgcacaagacaaacggcugacugccgaagcauuccucucggugcaugaacugaugcccaugauguuuuacuacuuucuccuccgagaaaaauacucagaggaagucuccgccgaaaggguacagggacguaucaaacggguaauagaagacguguacgccguuuacgacgcguucgcacgcgacgagaucaauacccgcgacgaacuagacgccugucuagccgauaaaggaauccgcagaggccacuuaccccgucagaugaucgccaucuuaucccaggaacacaaggacauggaagagaaaauaagaaagaaacuucaagaaaugauggcagauacagaccaccgacucgacaugcucgaccggcaaaccgacagaaaaaucagaaucgggcggaaaaacgccggccucccgaaaucgggcgucaucgcagacuggcuuguacgagacaugaugagauuccaaccgguagcaaaagacgccagcggcaaaccacugaacaacaguaaagccaacucaacagaauaucgcauguugcaacgagcccucgcacuauuuggcggagagaaagagcgauuaaccccauacuuccgccagaugaaucucaccggaggcaacaacccgcacccauucuuacacgaaacgcgaugggagucccacaccaacauucucagcuuuuaccgauccuaccuccgcgcgagaaaggccuuccuagaacgcauaggacggagcgaucgaguagaaaaccggcccuuccuccugcuuaaagagcccaaaaccgacagacaaacucuagucgccggguggaaaggcgaauuucaccuaccccgcgguaucuucacagaggccguaagagacugccuaaucgagauggggcaugacgaagucgcgagcuacaaagaaguugguuucauggcaaaagccguaccccucuauuucgaacgagccugugaagaccguguacagccauucuacgacuccccguucaacgucggaaauucccugaaaccaaagaaaggaagauuccugagcaaagaggaacgcgcagaagaaugggaacgcggcaaagagcgcuuuagagaccucgaagcguggucauacuccgccgcaaggcgaaucgaggacgcauucgccggaaucgaauacgccaguccgggcaacaaaaagaagauagaacaacuacuacgcgaccuaagccucugggaagcauuugagagcaaacuaaaagucagagccgaccgcaucaaccuagcuaagcugaagaaagaaauuuuagaagcacaagagcaccccuaucacgacuuuaaaaguuggcagaaauucgagcgggaacuccggcuagugaaaaaccaagacauaauuacauggaugaugugcagggaccuaauggaagaaaacaaaguagaggggcuagacaccggcacacuauaccucaaagacauacgaccaaacguacaggaacaggggucccucaauguacucaaccgggucaaaccgaugcgccuacccgucguaguguaccgugccgacucccgcggccacguccacaaggaggaagcuccccuagccacugucuacaucgaggaacgcgacaccaagcuccugaaacaagggaacuuuaaaucauucguaaaagaccgacggcuuaacggccuauucuccuucgucgacaccggcgggcucgccauggaacaauaccccaucagcaaacuacgcguagaauacgagcucgccaaauaccagaccgcccgaguaugcguauucgaguuaacacucagacucgaggaaucucuacucacccgcuacccacaccuccccgacgagagcuucagggaaaugcucgaaaguuggagcgacccacugcucgccaaauggccggaacuacacggcaagguccgacuacugaucgccguccgaaacgcguucucccacaaccaauacccgauguacgacgaagcugucuucagcagcauuagaaaguacgaccccagcucucccgaugcuauagaagaacgcaugggacuaaacauagcgcacagacucucagaagaagugaagcaagcgaaggaaacggucgaacgcauaauccaagcguaa

SEQ ID NO: 11804 - RNA, 3528 nt, Artificial Sequence
  Cas13b variant__Porphyromonas sp.__WP_039428968.1__Cas13b
augacagaacaauccgaacgcccuuacaacggcaccuacuacacccucgaagacaaacacuucugggccgcauucuuaaaccucgccagacacaacgccuauaucacccugacccacaucgaccgacaacuagcguacagcaaggccgauauuacgaacgaccaagauguccugagcuucaaagcacucuggaaaaauuucgacaacgaccucgaaagaaagucucgccuacgaagccuuaucuugaaacacuucucauuccucgaaggcgccgcauauggcaagaaacucuucgaaucgaaguccagcgguaacaaaaguuccaagaacaaagaauuaaccaagaaagaaaaggaagaacugcaagcaaacgcacuuucgcucgacaaccucaaauccauccucuucgacuuucuccaaaaacugaaagacuuccgaaacuacuacucucacuaucgacacuccgaaagcuccgaacugccccucuucgacggcaacauguuacagagacucuauaacgucuucgaugucucaguccaaagaguuaagcgagaccaugaacacaacgacaaaguagacccccacaggcacuucaaccaccuaguucgaaaaggcaagaaagaccgcuacggacacaacgacaacccguccuucaagcaccauuuuguagacuccgaaggcauggucacagaggccggacuccuauucuuuguuagccuuuucuuagagaaacgcgacgccaucuggaugcaaaagaagauccgaggcuucaagggaggcaccgaaaccuaccaacagaugacgaacgaagucuucugccgaagccgaauaagccuuccuaaacugaaacuggaaucccugcggacugaugacuggaugcuccuagacaugcugaacgaacucguccguugcccaaaaccucuauacgaccgccuaagagaagaugacagagcaugcuuucgagugcccguagacauacucccggacgaagacgacaccgacggcggcggggaagauccauucaaaaacacguugguccgccaccaagaccgcuucccauauuucgcauuaagauauuuugaccucaaaaagguauucaccucgcuacgcuuccacauagaccuagggaccuaccacuucgcuauuuacaagaaaaugauaggggaacaaccagaagacaggcacuuaacacgcaaccuuuacggguucgggcgcauacaagacuucgcugaggaacauagaccggaagaguggaaacgacucguccgcgaccucgacuauuucgaaacaggggacaaacccuacauaagccaaaccacaccccacuaucacauagagaaaggcaaaauaggacuccgauucguccccgaggggcaacaccuguggcccucccccgaaguuggcaccacacguaccggccgaagcaaauacgcucaggacaaacgacuaacagccgaagccuuccucucaguccacgaacuuaugccuaugauguucuacuacuuccuccuacgcgaaaaguacuccgaagaagucucagccgaaaaaguccagggcaggauaaagcgcgucaucgaagacgucuacgccauauacgacgccuuugcccgcgaugaaaucaauacacucaaggaacuggacgcgugccuagcagauaaagggaucagacguggccaccuaccaaaacagaugaucggaauacuaucgcaagaaagaaaagauauggaagaaaagguucggaagaaacugcaagaaaugauagccgacacggaccaccgccuugacaugcucgaccgccaaaccgaccgaaaaauccgaaucggacguaaaaacgcuggacuacccaagucaggaguaaucgcggacuggcuggugcgagacaugaugcgcuuucagcccguagcaaaagacacgagcggcaaaccacugaacaacucaaaggcgaacucaacagaguaccgaaugcuccagagagcgcuggcacucuucggcggcgaaaaagaacgccuaacaccauacuuccgucagaugaaccuaaccggaggcaacaacccucaccccuuccuccacgaaacccguugggaaucacacaccaacauacucucauucuacagaucguaccuaagggcacgaaaagcauuccucgaacguauaggcaggucagaccgagucgaaaacugcccguuccuacuccuaaaagagccgaaaacggacagacaaacauuagucgccggcuggaaaggggaguuccaccucccccgcggaaucuucacggaagccguccgcgauuguuuaauagaaaugggcuacgacgaaguaggaucauacagagaaguaggcuucauggcaaaagccgugccccuauacuuugaacgcgcgugcgaagaccggguccaaccauucuacgacagcccauuuaacgucggaaacucauuaaagcccaagaaaggccgcuuccugagcaaagaagacagggccgaagagugggaacgcggcaaggaacgcuuccgcgacuuagaggccuggagccacucggcagcccgccgaauaaaggacgcauucgcaggaaucgaguacgcaucacccgggaacaaaaagaaaaucgaacaguuauuacgagaccuaagccuuugggaggcuuucgaauccaagcucaaaguacgagcugacaagaucaaccuggcaaaacuuaaaaaggaaauccucgaggcacaggagcaccccuaccacgacuucaaaagcuggcaaaaauucgaacgcgagcugagacucgucaaaaaccaggacaucaucacauggaugaugugccgcgaccuaauggaagaaaacaaagucgaaggacuagacaccggcacgcucuaccuaaaagacauacggccaaacgugcaagaacaaggaucccuaaacguccucaaccgagugaagccaaugcgacucccagucguaguauacagggcagacucgcgcggccacguccacaaagaagaagccccacuggcaaccgucuacaucgaagaaagagacacaaaacuacucaaacaaggaaacuucaagaguuucgucaaggaccgccgacucaacggccucuucagcuucgucgacacagggggccuagcgauggagcaauaccccaucagcaaacuacgaguggaauacgaacuggccaaauaccagaccgcacgaguaugcgucuucgaacucacacucagacuggaggaaagccuucuuucccgauacccccacuugccagacgaaucguuccgggaaauguuagaaagcugguccgacccccucuuagcgaaauggccggaacugcacggcaaaguccgccuccuaaucgccguacgcaacgcauucagccacaaucaauacccaauguacgaugaggccgucuuuagcuccauccgcaaauacgacccaucuucaccagacgcgauagaagaacggaugggacucaacaucgcccaccgacugagugaggagguuaaacaggccaaggaaacgguagaacgaaucauccaagccuaa

SEQ ID NO: 11805 - RNA, 3375 nt, Artificial Sequence; identical to SEQ ID NO: 11215
  Cas13b variant__Prevotella aurantiaca__WP_025000926.1__Cas13b

SEQ ID NO: 11806 - RNA, 3384 nt, Artificial Sequence
  Cas13b variant__Prevotella buccae__EFU31981.1__Cas13b
augcagaagcaggacaagcuguucguggaccgcaagaagaacgccaucuucgccuuucccaaguacaucaccaucauggagaacaaggagaaaccagagcccaucuacuacgagcucaccgacaagcacuucugggcggccuuccugaaccuggcccggcacaacgucuacacgaccaucaaccacauuaaccgccggcucgagauugccgagcugaaggacgacggcuacaugauggggaucaagggcagcuggaacgagcaggccaagaagcuggacaagaaagugcgccuccgggaccugaucaugaagcacuuccccuuccuagaggcggccgccuacgagaugaccaacagcaagagccccaacaacaaggagcagcgcgagaaggagcaauccgaggcccucagccugaacaaccugaagaacgugcuguucaucuuccuggagaagcugcagguccuccggaacuacuacucccacuacaaguacagcgaggaguccccgaagcccaucuucgagacgagccugcugaagaacauguacaaaguguucgacgcgaacgugcgccucgucaagcgggacuacaugcaccacgaaaacaucgacaugcagcgcgacuucacgcaccugaaccggaaaaagcaggucgggcgcaccaagaacaucaucgacucccccaacuuccacuaccacuucgccgacaaggagggcaacaugaccaucgccgggcugcuguucuucgugucucuguuccuggacaagaaggacgccaucuggaugcagaagaagcucaagggguucaaggacggccggaaccugcgcgagcagaugaccaacgagguguucugccggucccgcaucucccugcccaagcucaagcuggagaacgugcagacgaaggacuggaugcagcuggauaugcucaacgagcuggugcggugccccaagucccuguacgagcgccuccgggagaaggaccgcgagagcuucaagguucccuucgacaucuucuccgacgacuacaacgccgaggaggagcccuucaagaacacccuggugcggcaccaggaccgcuuccccuacuucgugcuucgcuacuucgaccucaacgagaucuucgagcagcugcgguuccagaucgaccuugggaccuaccacuucagcaucuacaacaagcgcaucggcgacgaggacgagguccggcaccucacccaccaccuguacggguucgcgcgcauccaggacuucgccccgcagaaccagcccgaggaguggcggaagcuggugaaggaccucgaccacuucgagacgucccaggagcccuacaucagcaagaccgcaccccacuaccaccuggagaacgagaagaucggcaucaaguucugcuccgcccacaacaaccuguucccgagccuccagacggacaagaccugcaacgggcgcagcaaguucaaccugggcacgcaguucaccgccgaggccuuccuguccgugcacgagcuccugcccaugauguucuacuaccuccugcucaccaaggacuacagccggaaggaguccgccgacaaggucgagggcaucauccgcaaggagaucagcaacaucuacgccaucuacgacgccuucgccaacaacgagaucaacuccaucgcggaccugacccggcgccugcagaacacgaacauccuccaggggcaccuccccaagcagaugaucagcauccugaagggccggcagaaggacauggggaaggaggccgagcguaagaucggugagaugaucgacgacacacagcggcgccucgaccugcugugcaagcagaccaaccagaagauccggaucggcaagcgcaacgcggggcuccucaaguccggcaagaucgccgauuggcuggugaacgacaugaugcgguuccagcccgugcagaaggaccagaacaacaucccgaucaacaacagcaaagccaacucaaccgaguaccgcaugcuccagcgggcgcuggcccuguucgggagcgagaacuuccgccucaaggccuacuucaaccagaugaaccuggucggcaacgacaacccgcaccccuuccuggccgagacgcagugggagcaccagaccaacauccucuccuucuaccgcaacuaccuugaggcgcggaagaaguaccugaaggggcucaagccccagaauuggaagcaguaccagcacuuccugauccugaaggugcagaagaccaaccgcaacacccucguaacuggcuggaaaaacagcuuuaaccugccgcggggcauuuucacccagcccauccgcgagugguucgaaaagcacaacaacuccaagcggaucuacgaccagauccucagcuucgaccgggucggguucguggccaaggccaucccccucuacuucgccgaggaguacaaggacaacguccagcccuucuacgacuacccguucaacaucggcaaccggcugaagccgaagaagcgucaguuccuggacaagaaggagcggguggagcucuggcagaagaacaaggagcuguucaagaacuaccccuccgagaagaagaagaccgaccuggcguaccucgacuuccugagcuggaagaaguucgagcgcgagcugcggcucaucaagaaccaggacauugugaccuggcugauguucaaggagcuguucaacauggcgacgguagaggggcucaagaucggcgagauccaccuccgcgacaucgacaccaacaccgccaacgaggaguccaacaacauccugaaccggaucaugccgaugaagcuccccgugaagaccuacgagaccgacaacaaggggaacauccugaaggagcgcccccuggccaccuucuauaucgaggagaccgagaccaaagugcucaagcagggcaacuucaaggcccuggucaaggacaggcgccugaacggccucuucagcuucgccgagaccacggaccugaaccuggaggagcaccccaucuccaagcucagcguggaccuggaguuaauuaaguaccaaaccacccggaucagcaucuucgagaugacccucgggcuggagaagaagcugaucgacaaguacuccacgcucccgaccgacagcuuccgcaauaugcuggagcgguggcugcagugcaaggcgaaccgccccgagcucaagaacuacgugaacucccugauugccguccggaaugccuucagucacaaccaguaccccauguacgacgccacccuguucgccgaggugaagaaguucacgcuauuccccuccguagacacgaagaagaucgagcugaacaucgcgccgcagcugcucgagaucgucggcaaggccaucaaggagaucgagaaguccgaaaacaagaacuga

SEQ ID NO: 11807 - RNA, 3384 nt, Artificial Sequence
  Cas13b variant__Prevotella buccae__WP_004343581.1__Cas13b
augcagaagcaggacaagcuguuuguggaccgcaagaagaacgccaucuucgccuuccccaaguacaucaccaucauggagaaccaggagaagccggagcccaucuacuacgagcucaccgacaagcacuucugggcggccuuccugaaucuggcacggcacaacgucuacacgaccaucaaucacaucaaccgccggcuggagaucgcagagcugaaggacgacggcuacaugauggacaucaaggggagcuggaacgagcaggccaagaagcuggacaagaaggugcgccuccgggaccugauuaugaagcacuuccccuuccuggaggcggccgccuacgagaucaccaacuccaagagccccaacaacaaggagcagcgcgagaaggagcaguccgaggcccucagccugaacaaccugaagaacgugcuguucaucuuccuggagaagcugcagguccuccggaauuacuacucccacuacaaguacagcgaggaguccccgaagcccaucuucgagaccagccugcuaaagaacauguacaagguguucgacgcgaacgugcgccucgucaagcgggacuacaugcaccacgagaacaucgauaugcagcgugacuucacgcaccugaaccggaagaagcaggucggccgcaccaagaauaucaucgacuccccgaacuuucacuaccacuucgccgacaaggagggaaauaugaccaucgccggccugcuguucuucgugagccuguuccuggacaagaaggacgcuaucuggaugcagaagaagcucaagggguucaaggacggccgaaaccugcgcgagcagaugacaaacgagguguucugccggucccgcaucagccugcccaagcucaagcuggagaacguccagacgaaggacuggaugcagcuggacaugcucaaugagcuagugcggugcccgaagucccuguacgagcgccuccgggagaaggaccgcgagagcuuuaagguccccuucgacaucuucuccgacgacuacgacgccgaggaggagcccuucaagaacacccuggugcggcaccaggaccgcuucccguacuucgugcuacgcuacuucgaccucaacgagaucuucgagcagcugcgguuccagaucgaccugggcaccuaccacuucaguaucuacaacaagcgcaucggggacgaggacgaaguccggcaccucacccaccaccuguacggcuucgcgcgcauccaggacuucgcccagcagaaccagccggagguguggcggaaauuggugaaggaccucgacuacuucgaggccucccaggagcccuacauccccaagacggcgccccacuaccaucuggagaacgagaagaucgggaucaaguucugcagcacccacaacaaccuguucccgucccucaagaccgagaagacuugcaacggccgcuccaaguucaaccuggggacgcaguuuaccgccgaggccuuccugagcguccacgagcuccugcccaugauguucuacuaccugcugcucaccaaggacuacucccggaaggagagcgccgacaagguggagggcaucauccgcaaggagaucuccaacaucuacgccaucuacgacgccuucgcaaacggcgagaucaacuccaucgcagaccugaccugccggcugcagaagacgaacauccuccaagggcaccuccccaagcagaugaucuccauccucgagggccgccagaaggacauggagaaggaggccgaacggaagaucggggagaugauagacgacacccagcgccggcucgaccuccugugcaagcagaccaaccagaagauccgcaucggcaagcggaacgccggccuccucaagagcgggaagaucgccgacuggcuggugaacgacaugaugcgcuuccagcccguccagaaggaccagaacaacaucccgaucaacaacuccaaagccaacagcaccgaguaccggaugcuccagcgcgcgcuggcccuguucggcuccgagaacuuccggcucaaggcauacuucaaccagaugaacuuagucgggaacgacaacccccacccguuccuggccgagacgcagugggagcaccagaccaacauccugagcuucuaucgcaacuaccuagaggcgcgcaagaaguaccugaagggccucaagccccagaacuggaagcaguaccagcacuuccuaauccugaaggugcagaagaccaaccggaacacccucgucacgggguggaagaacuccuucaaccugccgcgcggcaucuucacccagcccauccgggagugguucgagaagcacaacaacagcaagcgcaucuacgaccagauccuguccuucgaccgggugggcuucgucgccaaggccaucccccucuacuucgccgaggaguacaaggacaacgugcagcccuucuacgacuacccguucaacaucgggaauaagcugaagccccagaagggccaguuccuggacaaaaaggagcgcguggagcucuggcagaagaacaaggagcuguucaagaacuaccccagcgagaagaagaagaccgaccuggccuaccucgacuuccuguccuggaagaaguucgagcgggagcugcgccucaucaagaaccaggacaucguaaccuggcugauguucaaggagcuguucaacauggcgacgguggaggggcucaagaucggcgagauccaccuccgggacaucgacaccaacaccgccaacgaggagagcaacaacauccugaaccgcaucaugccgaugaagcugcccgugaagaccuacgagacggacaacaaggggaacauccugaaggagcggccccuggccaccuucuacaucgaggagacagagaccaaggucuugaagcagggcaacuuuaagguucuggccaaggaccgccggcugaacggccuccuguccuucgccgagaccacggacaucgaccuggagaaaaaccccaucaccaagcucagcguggaccacgagcugaucaaguaccagaccacccgcaucuccaucuucgagaugacgcuggggcuagagaagaagcugaucaacaaauacccgacccuucccaccgauagcuuccggaacaugcuagagcgcuggcugcagugcaaggcgaaccggcccgaacuaaagaacuacgucaacagccucaucgccgugcgcaacgccuucucccacaaccaguaucccauguaugacgccacccuauucgccgaggugaagaaguucacgcuguucccgagcgucgacaccaagaagaucgagcucaacaucgcgccccagcuguuggagaucgugggcaaggccaucaaggagaucgagaaguccgagaacaagaacuga

SEQ ID NO: 11808 - RNA, 3402 nt, Artificial Sequence
  Cas13b variant__Prevotella falsenii__WP_036884929.1__Cas13b
augaagaacgacaacaacagcaccaaguccaccgacuauacgcuaggcgacaagcacuucugggccgccuuccucaaccuggcccgccacaacguguacaucaccgucaaccacaucaacaaggugcuggagcucaagaacaaaaaggaccaggaaaucaucaucgacaacgaucaggauauccuggcaaucaagacccugugggggaagguggauaccgacaucaacaagaaggaccggcuccgggagcugaucaugaagcacuuccccuuccuggaggccgccacguaucagcagagcuccaccaacaacaccaagcagaaggaggaggagcaagccaaggcgcagagcuucgagucgcucaaggacugccuguuccuguuccucgagaaacuucgggaggcccgcaacuacuacagccacuacaagcacuccaagagccuggaggagccgaagcucgaggagaagcugcuggagaacauguacaacaucuucgacaccaacguccagcucgugaucaaggacuacgagcacaacaaggacaucaacccagaagaggacuucaagcaccugggccgggccgagggggaguucaacuacuacuucacgcgcaacaagaagggcaacaucaccgaguccgggcugcuauucuucgugagccuguuccuggagaagaaggacgccaucugggcgcaaaccaagaucaagggcuucaaggacaaccgggaaaacaagcagaagaugacccacgaggucuucugccgcucccggaugcuucugcccaagcugcgccucgagagcacgcagacccaggacuggauccugcuggacaugcucaacgagcugauccggugccccaagucccuguacaagcgccuccagggcgagaagcgggagaaguuccgcgugccguucgacccggccgacgaggacuacgacgccgagcaggagcccuucaaaaacacccuggugcggcaccaggaccgcuuccccuacuucgcccugcgguacuucgacuacaacgagaucuucaccaaccuccgcuuccagaucgaccuggggacguaucacuucagcaucuacaagaagcagaucggcgacaagaaggaggaccggcaccugacccacaagcucuacggguucgaacgcauccaggaguucgccaaggagaaccgcccggacgaguggaaggcgcuggucaaggaccuggacaccuucgaggaguccaacgagcccuacauuagcgagaccacgccccacuaccaccucgagaaccagaagaucggcauacgcaacaagaacaagaagaagaaaaagaccaucuggcccucccuggagaccaagaccaccgugaacgagcgcagcaaguacaaccuggggaaguccuucaaggcugaggccuuccucagcgugcacgagcugcugccgaugauguucuacuaccuccugcugaacaaggaggagcccaacaacggcaagaucaacgccagcaaagucgagggcaucaucgagaagaagauucgggacaucuacaagcuguacggggccuucgcgaacgaggagaucaacaacgaagaggagcucaaggaguacugcgagggcaaggacaucgccauccgccaccucccaaagcagaugaucgccauccugaagaacgaauacaaggacauggcuaagaaggccgaggacaagcagaagaagaugaucaaggacaccaagaagcggcucgcggcacuggacaagcaggucaagggggagguggaggacggcggccguaacaucaagccccugaaguccgggcggaucgccagcugguuagugaacgacaugaugcgcuuccagccggugcagcgggaccgcgacggcuacccccugaacaacuccaaggccaacagcaccgaguaccagcuguugcagagaacccuggcgcuguucggguccgagcgcgagcggcucgcgcccuacuuccgccagaugaaccugaucggcaaggacaacccccacccguuccugaaggacacgaaguggaaggagcacaacaacauccucagcuucuaccgguccuaccuggaggccaagaagaacuuccuggggagccucaagccggaggacuggaagaagaaccaguacuuccugaagcugaaggagcccaagaccaaccgcgagacccucgugcagggcuggaagaacggcuucaaccugccccgggggaucuucaccgagccgauccgcgagugguucauacggcaccagaacgagagugaggaguacaagaaggucaaggacuucgaccgcaucggccugguggcaaaggugaucccccucuucuucaaggaggacuaccagaaggagaucgaggacuacguccaacccuucuacggguaccccuucaacgugggcaacauccacaacagccaggaggggacguuccugaacaagaaggaacgggaggagcuguggaagggcaacaagaccaaguucaaggacuauaagaccaaggagaagaacaaggagaagaccaacaaggacaaauucaagaagaagacggaugaggagaaagaggaguuccgcuccuaccucgacuuccagagcuggaagaaguucgagcgcgagcugcggcuggugcgcaaccaggacaucgucaccuggcuccugugcauggagcugaucgacaagcucaagaucgacgagcugaacaucgaggagcuucagaagcuccggcugaaggacaucgacaccgacaccgccaagaaggagaagaacaacauccugaaccgcaucaugccgauggagcuccccgugaccgucuacgagacggacgacuccaacaacaucauaaaggacaagccccugcacaccaucuacauaaaggaggcggagaccaagcugcucaagcagggcaauuucaaggcccuggugaaggaccggcgccugaacggccuauucagcuucguggagaccuccagcgaggccgagcugaaguccaagccgaucagcaagucgcuggucgaguacgagcucggggaguaccagcgggcccgcguggagaucaucaaggacaugcugcggcuggaggagacgcucaucgggaacgacgagaagcugcccaccaacaaguuccgccagaugcuggacaaguggcucgagcacaagaaggagaccgacgacaccgaccugaagaacgacgugaagcugcucacggagguccggaacgccuucagccacaaccaguaccccaugcgcgaccggaucgcguucgccaacaucaagcccuucagccuguccagcgccaacaccuccaacgaagagggccuggggaucgccaagaagcucaaggacaagacgaaggagaccaucgaccgcaucaucgagaucgaggaacagacggccaccaaacgguga

SEQ ID NO: 11809 - RNA, 3402 nt, Artificial Sequence; identical to SEQ ID NO: 11219
  Cas13b variant__Prevotella intermedia__BAU18623.1__Cas13b

SEQ ID NO: 11810 - RNA, 3405 nt, Artificial Sequence
  Cas13b variant__Prevotella intermedia__AFJ07523.1__Cas13b
augaagauggaggacgacaagaagaccaaggagagcaccaacaugcuggacaacaagcacuucugggccgccuuccucaaccuggcgcgccacaacguguacaucacggucaaccacaucaacaaggugcuggagcucaagaacaagaaggaccaggacaucaucaucgacaacgaccaggacauccuugccaucaagacccacugggagaaggugaacggcgaccugaacaagaccgaacggcuccgcgagcugaugaccaagcacuuccccuuccuggagacggccaucuacaccaagaacaaggaggacaaggaggaggucaagcaggagaagcaggccaaggcccaguccuucgacagccucaagcacugccuguuccuguuccucgagaagcuacaggaggcgcggaacuacuacucccacuacaaguacagcgagucgaccaaggagccgaugcuggagaaggagcuccugaagaagauguacaacaucuucgacgacaacauacagcuggugaucaaggacuaccagcacaauaaggacaucaaccccgacgaggacuucaagcaccucgaccgcaccgaggaagaguucaacuacuacuucacgaccaacaagaaagggaacaucaccgccagcggccugcuguuuuucgugucccucuuccuggagaagaaggacgcgaucuggaugcagcagaagcugcggggguucaaggacaaccgcgagagcaagaagaagaugacccacgaggucuucugccggucccgcaugcuccugccuaagcugcggcucgaaagcacgcagacccaggacuggauccugcuggauaugcucaacgagcugauccgcugccccaagucccuguaugagcggcuccagggcgaguaccgcaagaaguucaacgugccguuugacagcgccgacgaggacuacgacgcagagcaggagcccuucaagaacacccuggugagacaccaagaccgcuuccccuacuucgccuugcgguacuucgacuacaacgagaucuucaccaaccuccgcuuccagaucgacuuggggacguaccacuucuccaucuacaagaagcugauuggcggccaaaaggaggaccggcaccucacccacaagcuguacggguucgagcgcauccaggaguucgccaagcagaaccggaccgacgaguggaaggccaucguaaaggacuucgacaccuacgagacgagcgaggagcccuacaucuccgagaccgccccgcacuaccaccuggagaaccagaagaucggcaucagauuccguaacgacaacgacgagaucuggcccagcuuaaaaaccaacggggagaacaacgagaagcgcaaguacaaguuggacaagcaguaccaagcggaggccuuccuguccgugcacgagcuccugcccaugauguucuauuaccugcuccugaagaaggaggagcccaacaacgacaagaagaacgccagcaucguugagggcuucaucaagcgcgagauccgggacaucuacaaacuguacgacgccuuugccaacggggagaucaacaacaucgacgaccuggagaaguacugcgaggacaaggguaucccgaagcgccaccuccccaagcaaaugguggcgauccuguacgacgaacacaaggacauggccgaggaggccaagcggaagcagaaggagauggugaaagacacaaagaagcugcucgccacgcuggagaagcagacccagggcgagaucgaggacgggggccgcaacauccggcugcugaaguccggggagaucgcccgcuggcuggugaacgacaugaugcgguuccagcccguccagaaggacaacgagggcaacccccugaacaacagcaaggcgaacucgaccgaguaccagaugcuccagcgcucccuggcccuuuacaacaaggaggagaagccgacccgguacuuccgccaggugaaccucauaaacagcuccaacccccaccccuuccugaaguggacgaagugggaggagugcaacaacauccugagcuucuaccgguccuaccucaccaagaagaucgaguuccugaauaaguugaagcccgaggacugggagaagaaccaguacuuccucaagcugaaggagccgaagacaaaccgcgagacccugguucagggguggaagaacggguucaaccucccccggggcaucuucacggagcccauccgcgagugguucaagcggcaccagaacgacagcgaggaguacgagaaggucgagacccuggaccgcguggggcuggugaccaaggucauuccccucuucuucaagaaggaggacuccaaggacaaggaggaguaccugaagaaagacgcccagaaggagaucaacaacugcgugcagcccuuuuacggcuuccccuacaacguggggaacauccacaagcccgacgagaaggacuuccugcccagcgaggagcggaagaagcucuggggcgacaagaaguacaaguucaagggcuacaaggccaaggucaaguccaagaagcugaccgacaaggagaaggaggaguaccgcagcuaccuggaguuccaguccuggaacaaguucgagcgggagcuccgccuggugcgcaaccaggacaucgucacguggcugcucugcaccgagcugaucgacaaacugaagguggaggggcucaacgucgaggagcugaagaagcugcggcucaaggacaucgacaccgacaccgccaagcaggagaagaacaacauccugaaccgcgucaugccgaugcagcugcccgugaccguguaugagaucgacgacagccacaacaucgucaaggaccggccccuccacacggucuacauugaggagaccaagaccaagcugcugaagcagggcaacuucaaggcgcucgugaaggaccgcaggcugaacggucuguucuccuucgucgacacaagcuccgagacggaacucaagagcaacccgaucuccaagagccugguggaauacgagcucggcgaguaccagaacgcucgcaucgagaccaucaaggacaugcuccugcuggaggagacccucauugagaaguacaagacccugcccacggacaacuucuccgacaugcugaacggguggcucgagggcaaggacgaggccgacaaggcccgguuucagaacgacgugaagcugcuggucgcggugcgcaacgccuucagccacaaccaguaccccaugcggaaccgcaucgccuucgccaauaucaaccccuucagccuuuccagcgccgacaccuccgaggagaagaagcuggacaucgcgaaccagcugaaggacaagacccacaagaucaucaagcggaucaucgaaaucgagaagccgaucgagaccaaggaguga

SEQ ID NO: 11811 - RNA, 3399 nt, Artificial Sequence
  Cas13b variant__Prevotella intermedia__WP_014708441.1__Cas13b
auggaggacgacaagaagaccaaggagagcaccaacaugcuggacaacaagcacuuuugggccgccuuccucaaccuggcgcgccacaacguguacaucacggucaaccacaucaacaaggugcuggagcucaagaacaagaaggaccaggacaucaucaucgacaacgaccaggacauccuggccaucaagacccacugggagaagguuaacggcgaccucaacaaaaccgagcggcuccgcgagcugaugaccaagcacuuccccuuccuggagacggccaucuacaccaagaacaaggaggacaaggaggaggucaagcaggagaagcaggccaaggcccaguccuucgacagccucaagcacugccuguuccuguuccucgagaagcugcaggaggcgcggaacuacuauucccacuacaaguacagcgaauccaccaaggagccgaugcuggagaaggagcuccugaagaagauguacaacaucuucgacgacaacauccagcuggugaucaaggacuaccagcacaacaaggacaucaaccccgacgaggacuucaagcaccucgaccgcaccgaggaggaguucaauuacuacuucacgaccaacaagaaggggaacaucaccgccagcggccugcuguucuucgugucccucuuccuggagaagaaggacgccaucuggaugcagcagaagcugcggggguucaaggacaaccgcgagagcaagaagaagaugacccacgaggucuucugccggucccguaugcuccugcccaagcugcggcucgagagcacgcagacccaggacuggauccuacuggacaugcucaacgagcugauccgcugccccaagucccuguacgagcggcuccagggagaguacagaaagaaguucaacgugccguucgacagcgccgacgaggacuacgacgcagagcaggagcccuucaagaacacccuggugcggcaccaggaucgcuuccccuacuucgcccugcgguacuucgacuacaacgagaucuucaccaaucuccgcuuucagaucgaccugggaacguaccacuucuccaucuacaaaaagcugaucggcggccagaaggaggaccggcaccucacccacaagcuguacggguucgagcgcauccaggaguucgccaagcagaaccggacugaugaguggaaggccaucgucaaggacuucgacacguacgagacgucagaggagcccuacaucuccgagaccgccccgcacuaccaccuggagaaccagaagaucggcauccgcuuccggaacgacaacgacgagaucuggcccagccucaagaccaacggggagaacaacgagaagcgaaaguacaaacuggacaagcaguaccaggcggaggccuuccuauccgugcacgagcuccugcccaugauguucuacuaccugcuccugaagaaggaggagcccaacaacgacaagaagaacgccagcaucguggagggguucaucaagcgcgagauccgggacaucuacaaacuguacgacgcauucgccaacggggagaucaacaauaucgacgaccuggagaaguacugcgaggacaaaggcaucccgaagcgccaccuccccaagcagauggucgcgauccuguacgacgagcacaaggacauggccgaggaggccaagcggaagcaaaaggagauggugaaggacaccaaaaagcuguuggccacgcuggagaagcagacucagggugagaucgaggacgggggccgcaacauccggcugcucaaguccggggagaucgccagauggcuggugaacgacaugaugcgcuuccagcccguccagaaggacaacgagggcaacccccugaacaacagcaaggcgaacagcaccgaguaccagaugcuccagcgcucgcuggcccuguacaacaaggaggagaaaccgacccgguacuuccgccaggucaaccucaucaacagcuccaacccccaccccuuccugaaguggaccaagugggaggagugcaacaacauacugagcuucuaccgguccuaccucaccaagaagaucgaguuccugaacaagcugaagcccgaggacugggagaagaaccaguauuuccucaagcugaaggagccgaagaccaaccgcgagacccugguccagggcuggaagaacggguucaaccucccccggggcaucuucacggagcccauccgcgaaugguucaagcggcaccagaacgacagcgaggaguacgagaaggucgagacccuggaccgcguggggcuggugaccaaggucauuccccuguucuucaagaaggaggacuccaaggacaaggaggaguaccugaagaaggacgcccagaaggagaucaacaacugcgugcagccguucuacggcuuccccuacaacguggggaacauccacaagcccgacgagaaggacuucuuacccagcgaggagcggaagaagcucuggggcgacaagaaguacaaguucaagggcuacaaggccaaggucaaguccaagaagcugaccgacaaggagaaggaggaguaccgcagcuaccuggaguuccaguccuggaacaaguucgagcgggagcuccgccugguacgcaaccaggacaucgucacguggcugcucugcaccgagcugaucgacaagcugaagguggaggggcucaacguagaggagcugaagaaguuacgguuaaaggacaucgacaccgacaccgcgaagcaggagaagaacaacauccugaaccgcgucaugccgaugcagcugcccgucaccguguacgagaucgacgacagccacaacaucgucaaggaccggccccuccacaccguuuacaucgaggagaccaagaccaagcugcugaagcaggguaacuucaaggcgcucgugaaggaucgccggcugaacgggcuguucuccuucgucgacaccagcuccgagacggagcucaagagcaacccgauuuccaagagccugguggaguacgagcugggcgaguaccagaacgcccgcaucgagaccaucaaggacaugcuccugcuggaggagacucucaucgagaaguacaagacccugcccacggacaacuucuccgacaugcugaacggguggcucgagggcaaggacgaggccgacaaggcccgguuccagaacgacgugaagcugcuggucgcggugcgcaacgccuuuagccacaaccaguaccccaugcggaaccgcaucgccuucgcaaacaucaaccccuucagccucuccagcgccgacaccuccgaggagaagaagcuggacaucgcgaaccagcugaaggacaagacccacaagaucaucaagcggaucaucgagaucgagaagccgaucgagaccaaggaguga

SEQ ID NO: 11812 - RNA, 3381 nt, Artificial Sequence
  Cas13b variant__Prevotella intermedia__WP_036860899.1__Cas13b
auggaggacgacaagaaaaccaccgacagcauccgcuacgagcugaaggacaagcacuucugggccgccuuccucaaccuggcgcggcacaacguguacaucacggucaaccacaucaacaagauccuggaggagggcgagaucaaccgcgacggguaugagaccacccucaagaacaccuggaacgagaucaaggacaucaacaagaaggaucggcuguccaagcugaucaucaagcacuuccccuuccucgaggccgccacguaccgccugaacccgaccgacaccaccaagcagaaggaggagaagcaggccgaggcccagagccuggagucccuccgcaagagcuucuucguguucaucuacaagcugcgggaccugcggaaucacuacucccacuacaagcacagcaagucccucgagcgcccaaaguucgaagaggggcugcuggagaagauguacaacaucuucaacgcgagcaucagacucgugaaggaggacuaccaguacaacaaagauaucaaccccgacgaggacuucaagcaccuugaccgcacggaggaggaguucaacuacuacuucaccaaggacaacgaggggaacaucaccgaguccggccuccucuucuucgucagccuguuucuggaaaagaaggacgccaucuggaugcagcagaagcuccggggguucaaggacaaccgcgagaacaagaagaagaugaccaacgagguguuuugccggucccgcaugcugcugcccaagcuccggcugcagagcacgcagacccaggacuggauucugcucgacaugcugaacgagcugauccgcugcccgaagucccucuacgagcggcugcgcgaggaggaccgggaaaaguuccgcgugcccaucgagaucgccgacgaggacuacgacgccgagcaggagcccuucaagaacacccuggucagacaccaggaccguuuccccuacuucgcgcuccgcuacuucgacuacaacgagaucuucaccaaccugcgguuccagaucgaccugggcacguaccacuucagcaucuacaagaagcagaucggcgauuacaaggagucccaccaccucacccacaagcuguacggguucgagcgcauucaggaguucaccaagcagaaccggccggacgaauggcgcaaguucgugaagaccuucaacagcuucgagacuuccaaggagcccuacauccccgagaccacgccccacuaccaccuggagaaccagaagaucggcauccgguuccgcaacgacaacgacaagauauggccgagccucaagaccaacuccgagaagaaugagaaguccaaguacaagcuggacaagagcuuccaggccgaggccuuccugagcgugcacgagcuccugcccaugauguuuuacuaccugcuccuuaagaccgagaacaccgacaacgacaacgagaucgagaccaagaagaaggagaacaagaacgacaagcaggagaagcacaagaucgaggagaucaucgagaacaagaucaccgagaucuacgcgcuguacgacacguucgccaacggggagaucaagagcaucgacgagcucgaggaguacugcaagggcaaggacaucgagaucgggcaccuccccaagcagaugaucgcgauccugaaggacgagcacaaggucauggccaccgaggccgagcggaagcaggaggagaugcugguggacgugcagaagucccuggagagccuggacaaccagaucaacgaggagaucgagaacgucgagcgcaagaacuccagccugaaguccggcaaaaucgccagcuggcucgugaacgacaugaugcgguuccagcccgugcagaaggacaacgagggcaagccgcugaacaacuccaaggccaacagcaccgaguaccagcugcuccaacgcacccuggcguucuucggguccgagcacgagcggcuggcacccuacuucaagcagacgaagcucaucgagagcucuaacccccaccccuuccugaaggacaccgagugggagaaguguaacaacauccugagcuucuaccgcuccuaccucgaggccaagaagaacuuccuggagagccugaagccggaggacugggagaagaaccaguacuuccucaagcugaaggagcccaagacaaaacccaagacccugguccagggcuggaagaacggguucaaccucccccgcggcaucuuuacggaaccgauccgcaagugguucaugaagcaucgggagaacaucaccguggccgagcugaagcgcgugggccuggucgccaaggugaucccccucuucuucagcgaggaguacaaggacucagugcagcccuucuacaacuaccacuucaacguggggaacaucaacaagcccgacgagaagaacuuccugaacugcgaggagcggcgcgagcugcuccggaaaaagaaggacgaguucaagaagaugaccgacaaggagaaggaggagaacccguccuaccuggaguucaagagcuggaacaaguucgagcgcgagcugcgccucgugagaaaccaggacaucgugaccuggcugcugugcauggagcuguucaacaagaaaaagaucaaggagcugaacgucgagaagaucuaccugaagaacaucaacaccaacacgacgaagaaggagaagaacaccgaggagaagaacggcgaggagaagaacaucaaggagaaaaacaacauccucaaccgcaucaugcccaugcggcugcccaucaagguguacggacgcgagaacuucagcaagaacaaaaagaagaagauccggcgcaacaccuucuucacggucuacaucgaggagaagggcaccaagcugcucaagcaggggaacuucaaggcgcuggagagggaccgccggcugggcggccucuucuccuucgugaagaccccgagcaaggccgaguccaagagcaacaccaucuccaagcugcgcguggaguacgagcugggggaguaccagaaggcccggaucgaaaucaucaaggacaugcucgcccuggagaagacgcugauugacaaguacaacagccucgacaccgacaacuucaacaagaugcugaccgauuggcuggagcucaagggcgagcccgacaaggccuccuuccagaacgacgucgacuugcugaucgcggugcgcaaugccuucagccacaaccaguaccccaugcgcaaccgcaucgccuuugccaacaucaaccccuucucccucagcuccgcgaacaccagcgaagagaaggggcugggcaucgccaaucagcugaaggacaagacgcauaagaccaucgagaagaucaucgaaaucgagaagccgaucgagaccaaggaauga

SEQ ID NO: 11813 - RNA, 3363 nt, Artificial Sequence
  Cas13b variant__Prevotella intermedia__WP_061868553.1__Cas13b
auggaagacgacaagaagaccaccgacagcauccgcuacgagcugaaggacaagcacuucugggccgccuuccucaaucuggcgcggcacaacguguauaucacggucaaccacaucaacaagauccuggaggaggacgagaucaaccgcgacggcuacgagaacacccucgagaacuccuggaacgaaaucaaagacaucaacaagaaggaucgccugucaaagcuaaucaucaagcacuuccccuuccucgaagccaccaccuaccgccagaacccgacggacacgaccaagcagaaggaggagaagcaggccgaggcccagucccuggagagccugaagaaguccuucuucguguucaucuacaagcuccgggaccugcgcaaccauuacagccauuauaaacacuccaagucucuggagcggccuaaguucgaggaggaccuccagaacaagauguacaacaucuucgacguguccauccaguucgucaaggaggacuacaagcacaacaccgacaucaaccccaagaaggacuucaagcaccuggaucgcaagagaaaggggaaguuccauuacagcuucgccgacaacgaggguaacaucacggagucagggcuacuauucuucgugagccuguuccuggagaagaaggacgccaucugggugcagaagaagcucgagggcuucaagugcuccaacaagaguuaccagaagaugaccaacgaggucuuuugucgcucccggaugcugcugcccaagcuccgccuggagagcacccagacccaggacuggauccuacucgacaugcugaacgagcugauccgguguccgaagucccucuaugagcgccugcagggggugaaccggaagaaauucuacgugagcuucgaccccgccgacgaggauuacgacgccgaacaggagcccuucaagaauacgcugguccgccaccaggaccgguuccccuacuuugcccuccgcuacuucgacuacaacgagguguucgcgaaccuacgguuccagaucgaccugggcaccuaccacuuuaguaucuacaagaagcucaucggcggccagaaggaggaccgccaccugacucacaaacuuuacggcuucgagcggauccaggaguucgacaagcagaaccgaccggacgaguggaaggccaucgugaaggacagcgacacauucaagaagaaggaggaaaaggaagaggagaagcccuauaucuccgagacgacaccccacuaccaccucgagaacaagaagaucgggauugccuucaaaaaccacaacaucuggcccuccacccagacugagcugaccaacaacaagagaaagaaguauaaccugggcaccaguaucaaggccgaggccuuccucaguguccacgaacugcugccgaugauguucuacuaccuccuacugaagacggaaaauaccaagaacgacaacaaggucgggggcaagaaggagacgaagaagcagggcaagcacaagaucgaggcgaucaucgagagcaagaucaaggacaucuacgcccuuuacgacgcauucgccaacggggagaucaacuccgaggacgagcugaaggaguaccugaagggcaaggacaucaagaucgugcaccuccccaagcagaugaucgccauccugaagaacgagcacaaggacauggcggaaaaggcugaggccaagcaggagaaaaugaagcuggccaccgagaaccggcugaagacccucgacaagcaacugaaggggaagauccagaacggcaagcgcuauaacagcgcccccaaguccggcgagaucgcgaguuggcuggugaacgauaugaugcgguuccagccagugcagaaggacgagaauggggagucccucaacaacaguaaggccaacuccaccgaguaccagcuguugcagcgcacgcucgccuuuuucggcagcgagcacgagcggcuagccccguacuucaagcagaccaagcugaucgaguccagcaacccccaccccuuccucaacgacaccgagugggagaagugcuccaacauccugagcuucuaccgcuccuaccugaaggcccggaagaacuuccucgagagccugaagcccgaggacugggagaagaaccaguacuuucugaugcucaaggagccgaagaccaaucgcgagacacugguccagggguggaagaacggcuucaaccugccccggggguucuucaccgagcccauccgcaagugguucauggagcacuggaaguccaucaaggucgacgaccucaagcgggugggccugguggcaaaggucacgccccuguucuucucggagaaguacaaggacagcgugcaaccguucuauaacuaccccuucaacguuggcgacgucaacaagcccaaggaagaggacuuccuccaccgcgaggagcggauagagcugugggacaaaaagaaggacaaguucaagggguacaaggcaaagaagaaguucaaggaaaugaccgacaaggaaaaggaggaacaccguuccuaccuggaguuccagagcuggaacaaguucgaacgggagcuccgccuggugcggaaccaggacaucgucaccuggcugcucugcaccgagcugaucgacaaguugaaaaucgacgaacucaacaucaaagagcugaagaagcugcgccucaaggacaucaacaccgacaccgccaagaaggagaagaacaacauacucaaccgcgugaugcccauggagcugccggugaccgucuacaaggucaacaaaggcggguacaucaucaagaacaagccccuccacacgaucuacaucaaggaggccgagacgaagcugcugaagcagggcaacuucaaggcgcucgugaaggaccgccgccugaaugggcuguucagcuucgucaagacccccucugaggccgaguccgagagcaacccgaucuccaagcuccggguggaguacgagcugggcaaguaccagaaugcccgccuggacauuaucgaggacaugcucgcccuggagaagaagcugaucgacaaguacaacucccucgacaccgacaacuuccacaacauguuaacgggcugguuagagcucaagggagaggccaagaaggcgcgguuccagaacgacgugaagcuguugacagccguccgcaacgccuucucccacaaccaguaccccauguacgacgagaaccucuucggcaacaucgagcgguucagucuguccagcuccaacaucaucgagagcaaggggcucgacaucgccgccaagcucaaggaggagguguccaaagcggccaagaagauccagaacgaggaagauaacaagaaggagaaggagaccuga

SEQ ID NO: 11814 - RNA, 3378 nt, Artificial Sequence; identical to SEQ ID NO: 11224
  Cas13b variant__Prevotella intermedia__KJJ86756.1__Cas13b

SEQ ID NO: 11815 - RNA, 3378 nt, Artificial Sequence; identical to SEQ ID NO: 11225
  Cas13b variant__Prevotella pallens__EGQ18444.1__Cas13b

SEQ ID NO: 11816 - RNA, 3453 nt, Artificial Sequence
  Cas13b variant__Prevotella saccharolytica__EKY00089.1__Cas13b
augauggagaaggagaacgugcagggcagccacaucuacuacgagcccacugacaagugcuucugggccgccuucuacaaccuggcgcgccacaacgccuaccucaccaucgcccacaucaacuccuucgucaacagcaagaaggggaucaacaacgacgacaaggugcuggacaucaucgacgacugguccaaauucgacaaugaccuguuaaugggagcacggcugaacaagcugauucucaagcacuucccguuccugaaggcgccccuguaccagcucgccaagcgcaagacgcggaagcagcaagggaaggagcagcaggacuacgagaagaagggcgacgaggaccccgaggugauccaagaggccaucgccaacgccuucaagauggcgaacguccguaaaacccugcacgccuucuugaagcagcucgaggaccugcggaaccacuucagccacuacaacuacaacucccccgccaagaagauggaggugaaguucgacgacggguucugcaacaaguuauacuacguguucgacgccgcccuccagauggucaaggacgacaaccgcaugaacccggagaucaacaugcagaccgacuucgagcaccuggugcggcugggccgcaaccggaagauccccaacaccuucaaguacaacuucacgaacagcgacggcaccaucaacaacaacgggcuccuguucuucgugucccuguuccucgaaaagcgcgacgcgaucuggaugcagaagaagaucaagggcuucaagggcgggaccgagaacuacaugcgcaugaccaacgaggucuucugccgcaaccggauggugauccccaagcugcgccuggagacggacuacgacaaccaccagcucauguucgacaugcugaacgagcuggugcggugcccccucagccuguacaagcgccugaagcaggaggaccaggacaaguuccgggucccgaucgaguuccuagacgaggacaacgaggccgacaaccccuaccaggagaacgccaacuccgacgagaaccccaccgaggagaccgacccccugaagaacacccuggugcgccaccagcaccgguucccuuacuucgugcuccgcuacuuugaccugaaugaggucuucaagcagcugcgguuccaaaucaaccucgggugcuaccacuucagcaucuacgacaagacgaucggagagcgcaccgagaagcgccacuuaacccggacccuguucggcuucgaccgccuccagaacuucuccgugaagcugcagcccgaacacuggaagaacauggugaagcaccuggacacggaggaaagcuccgacaagcccuaccucagcgacgccaugccccacuaccagaucgagaacgagaagaucgggauccacuuccugaagaccgacaccgagaagaaggagaccgucuggccgucccuggaggucgaggaggugagcuccaaccggaacaaguacaagagcgagaagaaccucacggccgacgcguucuuguccacccacgagcugcuccccaugauguucuacuaccagcuguugagcagcgaggagaagacccgcgccgccgccggcgacaagguccagggggugcugcaguccuaccggaagaaaaucuucgacaucuacgacgacuucgccaacggcaccaucaacagcaugcagaagcucgacgagcgccuggcgaaggacaaccugcuccggggcaacaugccccaacagaugcuggccauccuggagcaccaagagcccgacauggagcagaaggccaaggagaaguuggaccgccugaucacggagaccaagaagcggaucgggaagcuggaggaccaguucaagcagaaggugcgcaucggcaagcggcgcgccgaccucccgaagguaggguccaucgccgacuggcuggugaacgacaugaugcgguuccagcccgcgaagcgcaacgccgacaacaccggcguccccgacagcaaggccaauuccaccgaguaccggcugcuccaggaggcccucgcguucuacagcgccuacaaggaccgccuggagcccuacuuccgccagguaaaccucaucgggggcacgaacccgcaccccuuccugcaccggguggacuggaagaagugcaaccaccuccugucguucuaccacgacuaccuggaggccaaggagcaguaccugagccaccucucccccgccgacuggcagaagcaccagcacuuccugcugcucaagguccggaaggacauccagaacgagaagaaggacuggaagaagucccugguggccggcuggaagaacggguucaaccugccccgcggccucuuuaccgagagcaucaagaccugguucagcaccgacgcggacaaggugcagaucacggacaccaagcuguucgagaaccgcgucggguugaucgccaagcucaucccgcuguauuacgauaagguguacaacgacaaaccccagcccuucuaccaguacccguuuaacaucaacgaccgguacaaacccgaggacacccgcaagcgguucaccgccgccuccagcaagcuguggaaugagaagaagaugcucuacaagaacgcccagccugacuccagcgacaagaucgaguacccccaguaccuggacuuccuguccuggaaaaagcucgagcgcgagcugcggaugcugcgcaaccaagacaugauggugugguugaugugcaaggaccuguucgcgcagugcacggucgagggcguggaguucgccgaccugaagcucagccagcuggagguggacgucaacgugcaggauaaccugaacgugcucaacaacgucaguagcaugauccugccgcugagcguguaccccucugacgcccaggggaacgugcuccggaacagcaagccccugcacaccgucuacgugcaggagaacaacaccaagcuccucaagcaggggaacuucaaauccuugcugaaggaccgccggcucaacggccuguucagcuucaucgccgccgagggggaggacuuacagcagcacccccucaccaagaaccgccuggaguacgagcuguccaucuaccaaaccaugcguaucucuguguucgagcagacgcuucagcuggagaaggccauccucacccgcaacaagacccucugcggcaacaacuucaacaaccugcugaacuccuggagcgagcaccggaccgacaagaagacgcuccagccggacaucgacuuccucaucgccguccgcaacgccuucucccacaaccaguaccccaugagcacaaacaccgugaugcaggggaucgagaaguucaacauccagacacccaaguuggaggagaaggacggccucgggaucgccucccagcuggcgaagaagacgaaggacgccgccucgcggcugcagaacaucaucaacggcggcaccaacuga

SEQ ID NO: 11817 - RNA, 3969 nt, Artificial Sequence
  Cas13b variant__Prevotella sp.__WP_036929175.1__Cas13b
augagcaaggagugcaagaagcagagacaggagaagaagcggcgccugcagaaggccaacuucuccaucagccugaccggcaagcacguguucggggccuacuucaacauggcgcggaccaacuucgucaagacgaucaacuacauccugcccaucgccggcgugcgcgggaacuacuccgaaaaccagaucaacaagaugcugcacgcccucuuccugauccaggccggccggaaugaggagcugaccaccgagcagaagcagugggagaaaaagcuccgccugaacccggagcagcagaccaaguuccagaagcugcuguucaagcacuuccccgugcucgggccgaugauggccgacgucgcggaccacaaggccuaccucaacaagaagaaguccacggugcagaccgaggacgagaccuucgccaugcucaagggcguuagccuggccgauugccuggacaucaucugucucauggcggacacccugacggagugccggaacuuuuacacccacaaggaccccuauaacaagccgagccaacuggcugaccaguaccuccaccaggagaugauugccaagaagcuggacaaggucgugguggccucccgccggauucugaaggaccgcgagggccuuagcgucaacgagguggaguuucugacggggaucgaccaccuccaccaggaggugcucaaggacgaguucggcaacgccaaggucaaggacgggaaagugaugaagaccuucguggaguacgacgacuucuacuucaagaucuccggcaaacgccuggucaacggguacacggugaccaccaaagacgacaagcccgugaacgucaacacgaugcugcccgcgcucagcgacuucggacugcuguacuucugugugcuguuccuguccaaacccuacgccaaacuuuucaucgacgaggugcgcuuguucgaguacagcccguucgaugacaaggagaacaugaucauguccgagaugcuaagcaucuaccggaucaggacgccccgguuacauaagaucgacucccacgacagcaaggccacccucgcaauggacaucuucggcgagcugcgccggugccccauggagcuguacaaccuccuggacaagaacgccgggcagcccuucuuccacgacgaggucaagcacccgaacucccacacgcccgacgugagcaagcgccugcgguacgacgaucgcuucccuacccucgcgcugcgguacaucgacgaaacggaguuguucaagcgcauccgcuuucagcuccaguuaggcuccuuccgguacaaguucuacgacaaggagaacuguaucgacggaagggugcgggucagacggauccagaaggagaucaacggcuacggccgcaugcaggagguggccgacaagcguauggacaaguggggcgaccugauccagaagcgcgaggagcggagcgucaagcucgagcacgaggagcuguacaucaaccuggaccaguuccuugaggacaccgccgacagcacccccuacgugaccgaccgccggccugccuacaacauccacgccaaccgcaucgggcucuacugggaagacucccagaaccccaagcaguacaagguguuugacgagaacgggauguacauccccgagcuggucgugacggaggacaagaaggcucccaucaagaugccggcgccccggugcgcccuaagcguguacgaucuccccgccaugcuguuuuacgaguaccugcgcgagcagcaggacaacgaguuucccuccgccgagcaagugaucaucgaauacgaggacgacuaccggaaguucuucaaggccguggccgagggcaagcucaagccguucaagcgccccaaggaguuccgggacuuccugaagaaggaauacccgaaacuucgcauggccgacauccccaagaagcuccagcuguuccugugcagccacgggcuuugcuauaacaacaagccggagaccguguacgagcggcuggaccgccuuacccuccagcaccuggaggagcgcgagcugcacauccagaaccggcucgagcacuaccagaaggaccgcgacaugaucggcaacaaggacaaccaguacgguaagaaguccuucagcgacguccgacacggggcccuagcgcgcuaccucgcucaguccaugauggaauggcagcccaccaagcucaaggacaaggagaagggccacgacaagcugacggggcucaacuacaacgugcucaccgccuaccuggccaccuacggccacccccaaguuccggaagagggguucacgccccggacccuggaacagguccucaucaacgcccaucugaucggcggcagcaacccccaccccuucaucaauaaggugcuggcgcuugggaaccgcaacaucgaggagcuguaccugcacuaccucgaggaagaacugaagcacauccggucccgcauccagucgcugucuagcaacccguccgacaaggcccucagcgcccugcccuucauccaccacgaccggaugcgcuaccacgagcggaccuccgaggaaaugauggcccuggccgcgcgcuacaccaccauccagcucccugacggccuauucacgcccuacauccuggaaauccuccagaagcacuacaccgagaacagcgacuugcaaaacgcccugucccaggacgugccggucaagcucaacccgaccugcaacgcagcuuaccugaucaccuuauucuaccagaccgugcucaaggacaacgcccagcccuucuaccugagcgacaagacguacacccggaauaaggacggggagaaggcggaguccuucagcuucaagcgugccuacgagcuguucagcgugcucaacaacaacaagaaggacaccuuccccuucgagaugaucccccuguuucugaccuccgacgagauccaggagcgguugagcgcgaagcuguuagacggcgacgggaaccccguccccgaggugggcgagaagggcaagcccgccacggacucccaggggaacacgaucuggaaacgcagaaucuacagcgaaguggacgacuacgcagagaagcucaccgaccgcgacaugaagaucuccuucaagggcgaaugggagaaacugccucgguggaagcaggacaagaucaucaagaggcgggacgagaccaggcgccagaugcgggacgagcugcuccagcgcaugcccagguacauccgcgauaucaaggacaacgagcggacguuacgccgguacaagacccaggacaugguccuguuccuccuggcugagaagauguucaccaacaucaucagcgagcaguccagcgaguucaacuggaagcagaugcgccuuuccaaagugugcaacgaggcguuccuucgacagacccugacguuccgcgugccugucacggugggggagaccaccaucuacguggagcaggagaacaugagccugaagaacuacggcgaguucuaccgguucuuaacggacgaccgccugaugucccuguugaacaacauugucgagacgcugaagcccaacgagaacggcgaccucgugauccggcacaccgaccucaugagcgagcuggccgccuacgaccaguaccgcuccaccaucuucauguugauccagagcaucgagaaccucaucaucacgaacaacgccgugcuggacgacccggaugccgacggguucuggguccgggaggaccugccuaagcgcaacaacuucgccagccuccuggagcugaucaaccagcucaacaacguggagcugaccgacgacgagcggaagcuccucgucgccauccgcaacgccuucagccacaacuccuacaacaucgauuucagccugaucaaggacgucaagcaccuccccgaggucgcgaagggcauccuccaacaccuccagagcaugcuggggguggagaucaccaaguga

SEQ ID NO: 11818 - RNA, 3384 nt, Artificial Sequence
  Cas13b variant__Prevotella sp.__WP_007412163.1__Cas13b
augcagaagcaggacaagcuguucguggaccgcaagaagaacgccaucuucgccuuccccaaguacaucaccaucauggagaaccaggagaagccggagcccaucuacuacgagcucaccgacaagcacuucugggcggccuuccugaaccuggcccggcacaacgucuacacgaccaucaaccacaucaaucgccgguuagagaucgcggagcugaaggacgacggguacaugauggggaucaagggcagcuggaacgagcaggccaagaagcuggacaagaaggugcgccuccgggaccugaucaugaagcacuuccccuuccuggaggcggccgccuacgagaucacaaacagcaagagccccaacaacaaggagcagcgcgagaaggagcaguccgaggcccucagccugaacaaccugaagaacgugcuguucaucuuccuggagaagcugcagguccugcggaacuacuacucccacuacaaguacucagaggaguccccgaagcccaucuucgaaaccagccugcugaagaacauguacaagguguucgacgcgaacgugcgccucgugaagagagacuacaugcaccacgagaacaucgacaugcagcgcgacuucacgcaccugaaucggaagaagcaggucgggcgcaccaagaacaucaucgacucccccaacuuccacuaccacuucgccgauaaggagggcaacaugaccaucgccgggcugcuguucuucgugagccuguuccuggacaagaaggacgccaucuggaugcaaaagaagcucaagggcuucaaagacggcagaaaccugcgcgagcagaugaccaacgagguguucugccggucccgcaucucacugcccaagcucaagcuggaaaacgugcagacgaaggauuggaugcagcuggacaugcucaacgagcuggugcggugccccaagagccuguacgagcgccuccgggagaaggaccgcgagagcuucaaggucccguucgacaucuuuuccgacgacuacgacgccgaggaggagcccuucaagaacacccuggugcggcaccaggaccgauuccccuacuucgugcugcgcuacuucgaccucaacgagaucuucgagcagcugcgguuccagaucgaccuggggaccuaccacuucagcauauacaacaagcgcaucggcgacgaggacgagguccggcaccucacccaccaccuguauggguucgcgcgcauccaggacuucgccccgcagaaccagcccgaggaguggcggaaguuagugaaggaccucgaccacuucgagacgucgcaggagcccuacaucucgaagaccgcgccccacuaccaccuggagaacgagaaaaucggcaucaaguucugcuccacccacaauaaccuguucccgagccucaagcgcgagaagaccugcaacgggcggagcaaguucaaccugggcacgcaguucaccgccgaggcguuccuguccgugcacgagcuccugcccaugauguucuacuaccugcugcucaccaaggacuacagcaggaaggaguccgccgacaaggucgagggcaucauccggaaggagaucagcaacaucuacgccaucuacgacgccuucgccaacaacgagaucaacuccaucgccgaccugaccugccgccugcagaagacgaacauccugcagggucaccuccccaagcagaugaucagcauccuggagggccggcagaaggacauggagaaggaggcggagcgcaagaucggggagaugaucgacgacacccagcggcgccucgaccugcuguguaagcagaccaaccagaagauccggaucggcaagcgcaacgccggccuccugaaguccgggaagaucgccgacuggcuggugagcgacaugaugagauuccagcccgugcagaaggacaccaauaacgccccgaucaacaacuccaaggccaacagcacggaguaccgcaugcuccagcacgcgcuggcccuguucggcucggagagcucccggcucaaggccuauuuccgccagaugaaccuggucgggaacgccaacccccaccccuuccuggcggaaacccagugggagcaccagaccaacauccucagcuucuaccgcaacuaccuggaggcccggaagaaguaccugaagggccucaagccccagaacuggaagcaguaccagcacuuccugauccugaaggugcagaagaccaaccgcaacacgcucgugaccggguggaagaacuccuucaaccugccgcggggcaucuucacccagcccauccgcgagugguucgagaagcacaacaacagcaagcgcaucuacgaccagauacuguccuucgaccgcgucggcuucguggccaaggccaucccccucuacuucgccgaggaguacaaggacaacguccagcccuucuacgacuaccccuucaacaucgggaacaagcugaagccccagaaaggccaguuucuggacaagaaggagcggguggagcucuggcagaagaacaaggagcuguuuaagaacuaccccucggagaagaacaagaccgaccuggcuuaccucgacuuccuuuccuggaagaaguucgagcgcgagcugcgauuaaucaagaaccaggauaucgugacguggcugauguucaaggagcuguucaagaccaccaccgucgaggggcucaagaucggcgagauacaccuccgcgacaucgacacgaacaccgccaacgaggaaagcaacaacauccugaaucggaucaugccgaugaagcuccccgugaagaccuaugagaccgacaacaaggggaacauccugaaggagcgcccccuggccaccuucuacaucgaagagacggagaccaaggugcucaagcagggcaacuucaagguccuggccaaggaccggcgccuuaacggccuccugagcuucgccgagaccaccgacaucgaccuggagaagaaccccaucacgaagcuauccguggacuacgagcugauaaaguaccagaccacccggaucagcaucuucgagaugacccuggggcucgaaaagaagcuaaucgacaaguacuccacgcugccgaccgacagcuuccgcaacaugcucgagcgguggcuccagugcaaggcgaaccgccccgagcugaagaacuacgugaacucccucaucgccguccggaacgccuucagccacaaccaguaccccauguacgacgccacccucuucgccgaggugaagaaguucacccuguuccccuccguggacacgaagaagaucgagcucaacaucgcgccgcagcugcuggagaucguuggcaaggccaucaaggagaucgagaaguccgagaacaagaacuga

SEQ ID NO: 11819 - RNA, 3273 nt, Artificial Sequence
  Cas13b variant__Prevotella sp.__WP_044072147.1__Cas13b
augaacauccccgcccugguggagaaccaaaagaaguacuucgggaccuacagcgucauggccaugcucaacgcgcagaccgugcuagaccauauccagaaaguggccgacaucgagggggagcagaacgagaacaacgagaaccugugguuucacccggucaugucccaccucuacaacgccaagaacggcuacgacaagcagccugagaagacgauguucaucaucgagcgccugcagagcuacuuccccuuccuuaagaucauggccgagaaccagcgggaguacuccaacgggaaguacaagcagaaccgcguggaggugaacucaaacgacaucuucgaaguucucaaacgggccuucggcgugcugaagauguaccgcgaccaggcgucccacuacaagaccuacgacgagaagcugaucgacgggugcgaguuccucaccagcaccgagcagccccuguccggaaugaucaacaacuacuacacgguggcccugcggaacaugaacgaacgcuacggcuacaaaacagaggaccucgccuucauccaggacaagcgguucaaguucgucaaggacgccuacgggaagaagaagucccaggugaacaccggcuucuuccugagccugcaggauuacaacggggacacccagaagaaacuacaucugagcggcguggggaucgcgcuguuaaucugccuguuccuggacaagcaguauaucaacaucuuccucucccgccugccgauauucagcuccuacaacgcacagagcgaggagcggcgcaucauuauacgguccuucggcaucaacagcaucaagcagcccaaggaccgcauccacuccgagaaguccaauaagagcgucgccauggacaugcugaacgagaucaagcggugccccaacgagcuguucgagacgcugagcgccgagaagcaaagccgcuuccggaucaucuccaacgaccacaacgaggugcugaugaagcgcagcucugaccgguucgugccccuccugcugcaguacaucgacuacggcaagcuguucgaccacauccgcuuccacgucaacauggggaagcuccgguaccugcucaaggccgacaagaccugcaucgacggccagacccgcgugcgggugaucgagcagccgcugaacggguucggccgccuggaggaggucgagaccaugcgcaagcaggagaacggcacguucggaaacagcggcauccggauccgcgacuucgagaacaugaagcgggacgacgcgaaccccgccaacuaccccuacaucguggacaccuacacccacuacauccucgagaacaacaagguggagauguucaucuccgacgaggagaccccggccccgcugcugcccgucaucgaggacgaccgcuacguggugaagacgauccccagcugucggauguccacccucgagauccccgccauggccuuccacauguuccuguucgggagcaagaagaccgagaagcugaucgucgacgugcacaaccgcuacaagcgccucuucaaggcgaugcagaaggaggaggucaccgccgagaacauugccuccuucggcaucgcagagagcgaccugccgcagaagaucaucgaccugaucuccgggaacgcccacggcaaggacguggacgcguucauccggcucacgguggacgacaugcuggccgacaccgagcggcgcaucaagcgguucaaagacgaccgcaagagcauccggucugccgacaauaagaugggcaagcgcggguucaagcagaucagcaccggcaagcuggcggacuuccucgccaaggacaucguccuguuccagcccuccgugaacgacggggagaacaagaucaccggccugaacuaccggaucaugcagagcgcgaucgcaguguacaacuccggggaugacuacgaagccaagcagcaguucaagcugauguucgagaaggcccgcuuaaucggcaagggcacgaccgagccccacccguuccuuuacaaggucuucgugcgcagcaucccggcgaacgccguggacuucuacgagcgcuaccugaucgagcggaaguucuaccucaucgggcuguccaacgagaucaagaagggcaaccgggucgacgugccauucauccgccgggaccagaacaaguggaagacccccgccaugaagacccuggggcgcaucuacgacgaggaccuccccguggagcugccgcggcagauguucgacaacgagaucaagagccaccucaagagccucccccaaauggaaggcaucgacuucaacaacgccaacgucacguaccugaucgccgaguacaugaagcgcgugcugaacgacgacuuccagaccuucuaccaguggaagcggaauuaccgcuacauggacaugcuccgcggggaauacgaccggaagggcucccugcagagcugcuucaccuccguggaggaacgggagggccuguggaaggagcgcgcgagccgaaccgagcgcuaccggaagcucgccuccaacaagauacgcagcaaccggcagaugcgcaacgccuccagcgaggagaucgagacgauccuggacaagcggcuguccaacagccgcaacgaguaccagaaguccgagaaggucauacggcgcuaccgggugcaggacgcccuccuguuccuucucgccaagaagacccugaccgagcuggcggacuucgacggggagcgcuucaagcucaaggagaucaugcccgacgccgagaagggcauccuguccgagaucaugcccauguccuucaccuucgagaaaggcgggaagaaguacacgaucaccagcgagggcaugaagcugaagaacuacggggacuucuuugugcucgccuccgacaaacgcaucggcaaccugcuggagcucgucgggagcgacaccgugucgaaggaggacauuauggaggaguucaagaaguacgaccagugccggccggagaucagcagcaucguguucaaccuggagaaaugggccuucgacaccuaccccgagcuguccgcccgcgucgaccgggaggagaagguggacuucaagagcauccucaagauccugcuuaacaacaagaacaucaacaaggagcaguccgacauccuccgcaagaucaggaaugcguucgaccacaacaauuaccccgacaagggcguggucgagauccgcgcccugccggagaucgccaugagcaucaagaaggccuucggggaguacgcgaucaugaaguga

SEQ ID NO: 11820 - RNA, 3273 nt, Artificial Sequence; identical to SEQ ID NO: 11230
  Cas13b variant__Prevotella sp.__WP_042518169.1__Cas13b

SEQ ID NO: 11821 - RNA, 3273 nt, Artificial Sequence
  Cas13b variant__Prevotella sp.__WP_044074780.1__Cas13b
augaacauccccgcccugguggagaaccagaagaaguauuucggcacguacagcgucauggccaugcucaacgcgcagaccgugcuggaccacauccaaaagguugccgacaucgagggggagcagaacgagaacaacgagaaccugugguuucacccggugaugucccaccucuacaacgccaagaacggguacgacaagcaacccgagaagacgauguucauaaucgagcgccugcaguccuacuuccccuuccugaagauuauggccgagaaucagcgggaguacuccaacgggaaguacaagcaaaaccgcguggaggugaacagcaacgauaucuucgaaguccucaaaagagccuuuggcguccugaagauguaccgcgaccugaccaaccacuacaagaccuacgaggagaagcucaucgaugggugcgaguuccugaccucaacggagcagcccuucucugggaugaucuccaaguauuacaccguggcgcugcggaacacaaaagagcgcuacggcuacaaagccgaggaucucgccuucauccaggacaaccgguacaaguucaccaaagacgcuuacgggaagcgcaagagccaggucaacacgggcucguuccugagccuacaggacuacaacggggacaccacgaagaagcuccaccuguccggcguggggauagcgcugcugaucugccuguuccuggauaagcaguacaucaacuuguuucugagccggcugccgaucuucuccagcuacaaugcccaguccgaggaacgccggauuaucauccgcagcuucggcaucaacuccaucaagcagcccaaggaccggauccacagcgagaagaguaacaagagcguggccauggacaugcucaacgaggucaagcgcugccccgacgagcuguucaccacgcuuagcgcggagaagcagucccgguuccgcauuauuagcgacgaccacaacgaggugcucaugaagcggagcagcgaccgcuucgucccccugcugcuccaauacaucgacuauggcaagcuguucgaccacauccgguuucaugucaacauggggaagcucagauaccuacugaaggccgacaagacuugcaucgauggccaaacccgggugcgcguaaucgagcagccgcugaacggguucggccgccucgaggaggucgagaccaugcggaagcaagagaacggcacguucgggaacuccggcauccgcauacgggacuucgaaaacaugaagcgcgacgacgcgaacccggcgaauuaucccuacauaguggaaaccuauacccacuacauucuggagaacaacaagguggagauguucaucagcgacgaggaaaaucccaccccguuacuccccgucaucgaagaugaccgguacgucgugaaaacgaucccauccugccgcaugagcacccuggagauccccgccauggccuuccacauguuccuguucggguccgaaaagacugaaaagcucaucaucgacguccacgaccgguacaagcgccuguuccaggccaugcagaaggaggaggugaccgcggaaaacaucgcuagcuuuggaaucgcagaguccgaccugccgcaaaagaucauggaccucaucagcgggaacgcccacgguaaagacgucgacgcuuucauacggcugacgguggaugacaugcuaacagacacagagcgccggaucaagcgcuucaaggacgaccggaaguccauccgcagcgcggacaacaaaaugggcaaacgggguuucaagcagaucuccaccggcaagcucgccgacuuccuggccaaggacauugugcuguuccagcccagcgucaaugacggggagaacaaaaucacgggccugaacuaccgcauuaugcaguccgccaucgccguguacgacagcggcgacgacuacgaggcgaagcagcaguucaagcucauguucgagaaggcccggcugaucggcaagggcaccaccgagccccaccccuuccuguacaagguguucguccgguccaucccggcgaacgccguggauuucuacgagcgguaucucaucgagcgcaaguucuaccugauugggcucagcaacgagaucaagaagggaaaccgcguggacguccccuuuauccggcgcgaccagaacaaguggaagacccccgcgaugaaaacgcucggacggaucuacagcgaggaucuacccguggagcugccgcgccagauguucgacaacgagaucaagucccaccuaaaaucacuuccucagauggagggcaucgacuucaacaacgccaacgugaccuaccugaucgccgaguacaugaagcggguacucaacgacgacuuccagaccuucuaccaguggaaacgcaauuaccgguacauggauaugcugcgcggggaauacgaccggaagggcuccuugcagcacugcuucaccucuaucgaggagcgggagggccucuggaaagagcgggccucccgcacggagcgguaccgcaaacuggccagcaauaaaauccggagcaacaggcagaugcggaacgcgagcuccgaggaaaucgagaccaucuuagacaaacgccucagcaacugccggaacgaguaccagaaguccgagaagaucauccgccgguaccgcgugcaggacgcccugcuguuccuccuggccaagaaaacccugaccgagcucgccgacuuugacggggagcgcuucaaacugaaggagauaaugcccgaugcagagaagggcauacugagcgaaaucaugcccaugucauucaccuucgaaaaaggcgggaagaucuacacgaucaccagcggcggaaugaagcugaagaacuacggcgacuucuucguguuggccagugacaagcggaucgggaaccugcucgagcuggucggcagcaacaccguguccaaggaggacaucauggaagaauuuaagaaguacgaccaaugccgcccagaaauuuccucgauuguguucaaccuggaaaagugggccuucgacaccuaccccgagcuccccgcccgggucgaccgcaaggagaaaguggacuucugguccauacuggacgugcugaguaacaacaaagauaucaacaacgaacaguccuacauccuucggaagauccgcaacgccuucgaccacaacaacuacccugacaaggggaucgucgagaucaaggcgcugccagagauugcgaugagcaucaagaaggccuucggcgaguacgccaucaugaaauga

SEQ ID NO: 11822 - RNA, 3438 nt, Artificial Sequence; identical to SEQ ID NO: 11232
  Cas13b variant__Psychroflexus torquis__WP_015024765.1__Cas13b

SEQ ID NO: 11823 - RNA, 2847 nt, Artificial Sequence
  Cas13b variant__Riemerella anatipestifer__WP_049354263.1__Cas13b
auguuuuucuccuuccacaacgcccagcgagucaucuucaaacaccuauacaaagccuucgacgcaagccuacgcauggucaaagaagacuacaaagcacacuucaccgucaaccucacccgagacuucgcucaccuuaaccgcaaaggcaaaaacaaacaggacaaucccgacuuuaaccgcuaccgcuucgaaaaagacggauucuucacagagagcggccuacucuucuuuaccaaccucuuccuugacaaaagagacgccuacuggaugcucaagaaagucuccggcuucaaggcuucgcacaaacaacgcgagaaaaugacgacagaaguauucugccgcagccgcauccuccuccccaaacuccgacuugaaucccgcuacgaucacaaccaaaugcuacucgacaugcuaucagaacuuucccgcugucccaaacuccucuacgagaaacuaucggaagaaaacaagaagcacuuccagguugaagccgacggcuuccuggacgaaauagaagaggaacaaaacccguucaaggacacacuuauaaggcaccaagaucgauucccguauuucgcacuccguuaccucgaccugaacgaguccuucaaaagcauacgcuuucagguagaccucggaaccuaccacuacugcaucuacgauaagaaaaucggugacgagcaagaaaaacgacaucugacccggacacuccucucauucggaagacuccaagacuucaccgaaauaaaccgcccacaggaauggaaagcucucaccaaagaccuagacuacaaagaaaccucaaaucaaccguucaucuccaaaacgacaccucacuaccauauaacugacaacaaaauaggcuuccgccucggcaccucaaaagaacuauaccccagccucgagaucaaagacggcgcaaaccgcaucgcaaaauaccccuacaacagcggauucgucgcgcacgccuucauuuccguacaugaacugcuaccacuaauguucuaccaacaccuaaccggaaaauccgaagaccucuugaaagaaaccguacgacauauccaaagaauauacaaagacuucgaagaagaacgaaucaauacgauagaagaccuagagaaagccaaccaaggacgacuaccccucggcgccuucccaaaacaaaugcuuggccuccuccaaaacaaacaaccagaccuaucggaaaaagcaaaaauaaagaucgaaaaacucaucgcggagaccaaacuucucucccaccggcucaacacaaaauuaaaauccucaccaaaacucggaaaacgacgagaaaagcucauuaaaaccggaguacuagcagacuggcuagucaaagacuuuaugcgcuuucaaccugucgccuacgaugcccagaaccagccaauaaagucauccaaagcgaacuccaccgaguucugguucauccgccgagcccucgcgcucuacggaggcgagaaaaacagacuugaaggcuauuucaaacaaacuaaccuaaucggaaacacaaauccgcaucccuuccuaaacaaguucaacuggaaagcaugucgcaaccuagucgacuucuaccaacaauaucuagaacaacgcgaaaaguuccuagaagccaucaaaaaccagccaugggaaccauaccaauacugccuccuccucaaaauaccgaaagaaaaucgcaaaaaccuggucaaaggaugggaacaagguggcaucagccuuccccgaggccucuucacagaagcaauccgagaaacccuaagcgaagaucuaaugcuauccaagccgauccgcaaagaaauaaagaaacacggccgcgucggcuucauuucccgggcgaucacacuauacuucaaagaaaaauaccaggacaaacaccagucauucuacaaucuaucauacaaacuugaggcgaaggcaccccuccuuaaacgcgaagaacacuacgaauacuggcaacagaacaaaccccaaucccccaccgaaucccaacggcucgaacuccacacgagcgaccgauggaaagauuaucucuuauacaagcgcuggcaacaccuagagaagaaacuccgccucuaucggaaccaagacguaaugcuguggcucaugacccuagagcuaacuaaaaaccacuucaaagaauuaaaucuuaacuaccaccaauuaaaacucgagaaccucgccgucaacguacaagaagccgacgccaagcuaaacccccuaaaucaaacauugccaauggugcuaccgguaaaaguuuacccagccaccgccuucggagaaguacaauaccacaaaaccccgaucagaacagucuacauccgagaagaacacaccaaagcacuaaaaaugggcaacuucaaggcccucgucaaggaccgccgccuaaacggccucuucuccuuuauuaaagaagagaacgacacccagaaacacccuaucucccagcuccgacuccgccgggaacuagaaaucuaccagucacugcgcgucgacgccuucaaagaaacacugucacuggaagagaaacuacucaacaaacacaccucucucucaucacuagagaacgaguuccgagcccuccuagaagaauggaagaaagaauacgcggcgagcucaauggucacagacgagcacaucgccuucauagcauccguacgcaacgcauucugccacaaccaauaccccuucuacaaagaagcacuccacgcuccaauaccccucuucaccguggcacaacccaccacggaagagaaagauggacucgguauagccgaagcacuccucaaaguccugcgugaauacugcgaaauagucaaaucucaaaucuga

SEQ ID NO: 11824 - RNA, 3288 nt, Artificial Sequence
  Cas13b variant__Riemerella anatipestifer__WP_004919755.1__Cas13b
auggaaaaaccccuucucccaaacgucuacacccucaaacacaaauucuuuuggggcgccuuccucaauauugcccgccauaacgcauucauaaccaucugucacauaaacgaacaacucggucucaaaacaccaucgaacgacgacaaaaucgucgacguaguaugcgaaacauggaacaacauccucaacaaugaccacgaccuacugaagaaaucacaacucacagaacucauacuaaaacauuuuccuuuccucaccgccaugugcuaccacccaccgaaaaaggaggggaaaaagaaaggacaccagaaagagcaacaaaaagaaaaagaauccgaagcccaaucgcaggcagaggcccucaacccauccaaacuaauagaagcacuugagauauuggucaaccaacuccauagccuacgcaacuacuacucccacuacaaacacaagaaacccgacgccgagaaagacaucuucaaacaccucuacaaagccuucgacgccucccugcgcaugguaaaagaagacuacaaagcccauuucaccgucaaccuaaccagagacuucgcacaccuuaacagaaaaggcaaaaacaagcaagacaaccccgacuucaaccgcuauagguucgaaaaagacggcuucuucaccgaaagcggccuccuguucuucacaaaucucuuccucgacaagcgagacgcguacuggaugcuaaagaaagucuccggcuucaaagccucccacaaacaacgcgagaaaaugacuacagaagucuucuguaggucucgcauccuccuacccaaacuacgacucgaaucacgauacgaccauaaucagaugcuccuagacaugcucuccgaacuuucaagaugcccaaaacuccuauacgagaaacuuuccgaagaaaacaagaaacauuuccagguagaggcagacggcuuccucgacgaaaucgaggaagaacagaaccccuucaaagacacacugauccgacaccaagaccgcuuccccuacuucgcgcuucgguauuuagaccuaaacgaauccuucaaaucgauccgcuuucagguugaccuuggaacauaucacuauugcaucuacgacaagaaaaucggcgacgagcaagaaaaacgacaccuuacgcgaacacuacucucauucggacgccuccaggacuucacagaaaucaaccgcccacaagaauggaaagcccugacuaaggaccuugacuacaaagaaacaucgaaucaaccauucaucucaaaaacgacgccccacuaccacaucaccgauaacaagauaggauuucgccucggcaccagcaaagaauuguauccaagccucgaaaucaaagauggcgccaaccgaaucgcaaaguaccccuauaacuccggcuucguggcccacgcauucauaucgguccacgaacuccuaccacuaauguucuaccaacaccucacaggaaaaagcgaagaccugcugaaagaaacaguacgucacauacagcggaucuacaaggacuucgaagaagaacgcaucaacaccaucgaggaccucgagaaggccaaccaaggaagacucccacucggugccuucccaaaacaaaugcuaggccuccuccaaaacaaacaaccagacuuaucagaaaaagccaagauaaaaaucgagaaacucaucgccgaaacuaaacuccuaagccaccgccucaacacuaagcugaaaucaucacccaaauuaggcaaacggcgugagaaguuaauuaagacagggguccucgcagacuggcucgugaaagacuucaugagauuucaaccagucgccuacgacgcccaaaaccagcccauaaaauccagcaaagcaaacuccaccgaguucugguucauucggcgagcacuggcgcucuacgggggagagaaaaaccgccuggaaggcuauuucaaacagaccaaccuuaucggaaauacuaacccacacccuuuucucaauaaauucaacuggaaggcguguagaaaccuaguagacuucuaccagcaauaccucgaacagagagaaaaauuccuugaagcgaucaaaaaccaacccugggaacccuaucaauacugccuccuccucaagauccccaaagaaaaccgcaaaaacuuagucaagggcugggaacaaggcgggaucucucuuccgagaggacucuucacagaagcaauucgcgagacccucagcgaagaccuaaugcugagcaaacccauacgcaaggaaaucaagaaacacggacgcgucggcuucauaucccgagcuauuacccucuacuuuaaagaaaaguaccaggacaaacaccagagcuuuuacaaccucagcuacaaacuagaggccaaagccccacuacucaaacgcgaggaacacuacgaauacuggcaacaaaacaaaccccaaucaccaacagagucacagcgacucgagcuacacaccucagaccgcuggaaggauuaucugcucuacaaacgcuggcaacaccucgagaagaaacuuagacuauaccggaaccaagacgugaugcuauggcucaugacacucgaacucacuaaaaaucacuuuaaagaacucaaccucaacuaccaucaacucaaacuugagaaucucgcuguaaacgugcaagaagcggacgcgaaacuuaauccacuaaaccaaacacugccaaugguacuacccgucaaaguuuacccagcaaccgcuuucggagaaguccaguaccacaaaacuccaauccggaccguauacaucagggaggaacauacaaaagcgcuaaaaauggguaacuucaaagcccuaguaaaagacagacgccucaauggcuuauucuccuuuaucaaagaagaaaacgacacacaaaagcaucccaucucccaacuucgucuacgcagagaacucgaaauauaccaaucccuaagagucgacgcauucaaggaaacacuaucccucgaagaaaaacuccuaaacaaacacacaagccucuccagccuugaaaacgaguucagagcccuucucgaggaauggaagaaagaauacgcagcaaguucaaugguaaccgaugaacacauagcguucauagccucaguacgcaacgccuuuugccacaaccaguacccuuucuacaaggaggcacuacacgcccccaucccccucuucacaguagcgcaaccaaccacagaggaaaaggacggucuagguaucgccgaagcccuccuuaagguccuccgggaauacugcgaaauaguaaaaucccaaauuuaa

SEQ ID NO: 11825 - RNA, 3288 nt, Artificial Sequence
  Cas13b variant__Riemerella anatipestifer__WP_064970887.1__Cas13b
auggaaaaaccccuacccccaaauguauacacccuaaaacacaaauuuuucuggggcgccuuccuuaauaucgcacgccacaacgccuucaucaccaucugccacaucaacgagcaacuaggacucaccacacccccaaacgaugacaaaauagcagacgucguuugcggaaccuggaacaacauccuuaacaacgaccacgaccugcucaagaaaucacaacugaccgaacuaauccucaaacacuucccauuccuugccgcaaugugcuaccauccaccaaagaaagagggcaaaaagaaaggcagccaaaaagaacaacaaaaagaaaaagagaaugaagcacaaucacaagcugaagcucucaaccccuccgagcuaauaaaaguccucaaaacccucguuaaacagcuucguacccuccgcaacuacuacucacaccacucacacaagaaaccggaugcugaaaaagacaucuucaaacaccuguacaaagccuucgaugcuagccuccgcauggucaaagaagacuacaaagcccacuucacagugaaccuaacccaagacuucgcccaccuaaaucgcaaaggcaaaaacaaacaagacaaucccgacuucgaccgcuaccgguucgaaaaagacggcuucuucaccgaaagcggccuccucuucuuuaccaaucucuuccucgacaaaagagacgcauacuggaugcugaagaaaguuagcggcuucaaagccucccacaaacagucagagaaaaugaccacugaagucuucugucgcucgcgcaucuuacucccaaaacucagacucgaaucgcgauacgaccacaaccagaugcuccuagauaugcugucagaacucucgcgcuaccccaaacuccucuacgaaaaacucagcgaagaggauaagaaaagguuccaggucgaagccgacggguuccuggaugaaaucgaagaggaacagaacccauucaaagacacguuaauccgccaccaggaccgcuuccccuauuucgcccuacgguauuuagaccucaaugaauccuucaaaaguauacgauuccaagucgaccucggcacguaccacuauuguaucuacgauaagaaaaucggugacgaacaagagaaacgccaucucacgagaacguuacucuccuucggcagacuacaggacuucacugaaaucaaccgaccccaagaauggaaagcccuaacaaaagaccuagauuacaaagaaacaagcaaacaacccuucaucagcaagacgacaccccacuaccacauaaccgacaacaaaaucggcuuccgucucggcaccuccaaagaacuguacccaucccucgaaguaaaagacggagcaaaucgaaucgcccaauaccccuacaacucagacuucguagcucacgccuuuaucuccguacacgagcugcuuccccuaauguuuuaccagcaccuaaccggcaaauccgaagaccuccucaaagagaccgucagacacauccagcgaaucuacaaagauuucgaagaagaacgcaucaacaccauagaagaccucgaaaaggcuaaccaagggaggcuaccccuaggugcuuuccccaagcaaaugcuaggccuccuccaaaacaaacaaccagaccucucagaaaaagcuaagaucaagauagaaaaacuaaucgcugaaaccaaacuccuuucccaccgacuaaacacaaaacuaaaaagcucccccaaacucggcaaaaggagggaaaaacugaucaaaaccggugugcucgcagacuggcuggugaaggacuucaugcguuuccaaccaguagccuacgacgcccaaaaccagccaauagaaagcuccaaagccaacuccacagaguuccaacuaauccagcgagcccuggcccucuauggcggagaaaagaaccgccuagaagguuacuuuaaacaaacaaaccucaucggaaacacuaacccacaccccuuccuaaacaaauucaacuggaaagcaugccgaaaucucgucgacuucuaccagcaauaccucgaacagcgagagaaguuccuugaagcgauuaaaaaccaaccgugggaaccauaccaauauugccugcuccucaaaaucccuaaagaaaaccgaaagaacuuggucaaaggcugggagcaagggggcaucagccucccccgcggucucuucaccgaagccauccgcgaaacccuuagcaaagaccuuacgcuaucaaaaccuauacggaaagagaucaagaaacacggaagagucgguuuuauaucgcgcgccaucacccucuacuuucgugaaaaauaccaggaugaccaccaguccuucuacgaccuccccuauaaacucgaagccaaagcauccccacuaccaaagaaagaacacuacgaauauuggcaacaaaacaaaccucagagccccaccgaacuccaacgccuagaacuccacaccuccgaucgcuggaaagacuauuuacuauacaaacgguggcaacaccuagagaagaaacuacgccucuaccgcaaccaagacguaaugcucugguuaaugacccucgaacuaaccaaaaaccacuucaaagaauuaaaccucaauuaccaccaacucaagcuagaaaaccucgcugugaacguucaagaagccgacgccaaacuuaauccacuaaaucaaacacugcccaugguccuccccgucaaaguguacccagccacagccuuuggcgaaguucaauaccaagaaaccccaauccgcacaguuuacauccgcgaagaacaaaccaaggcacuaaaaaugggcaauuucaaagcccuagucaaagacagaagacucaacggacucuucagcuucaucaaagaagaaaacgacacacagaaacaccccaucagucaacucagacuccgcagggaauuagaaaucuaccagagccuacgagucgacgccuucaaagaaacccuaaaccucgaagaaaaacugcuaaagaaacacacuagccuuucuuccguagagaacaaauucagaauacuccucgaggaauggaagaaagaauacgcagccagcuccauggucacagacgaacacaucgcuuucaucgcaucgguacgcaacgcauucugccacaaccaauaccccuucuacgaagaagcucuacacgcaccaaucccccuauucaccgucgcucagcaaaccacggaagaaaaagacggcuugggaaucgcagaagcccugcuccgaguacuacgcgaauacugcgagaucguaaaaucccaaaucuag

SEQ ID NO: 11826 - RNA, 2853 nt, Artificial Sequence
  Cas13b variant__Riemerella anatipestifer__WP_061710138.1__Cas13b
auguucuucuccuuucacaaugcacaacgugucauauucaaacaucucuacaaggcuuucgacgcgucucuccgcaugguuaaagaagacuauaaagcccacuucaccgucaaccugacccgugacuucgcucaccucaaccgcaaaggcaagaacaaacaagacaacccggauuucaaccgauacagauucgaaaaagacggguucuucacugaaagcggccuucuuuucuucaccaaccuauuucucgacaaaagagacgcuuacuggaugcucaagaaaguauccgguuucaaagccucacacaaacaauccgagaaaaugacaaccgaaguauuuuguaggucccgcauacuacucccuaaacuacgacuggaaucgcgcuacgaccacaaucagaugcuucuagacaugcucagcgaacucucuagaugccccaaacuacuauacgaaaaacuguccgaaaaggacaagaaaugcuuccaaguagaagcagacggcuuccuagacgagauagaagaggaacaaaacccauucaaagacacauuaauccgccaccaagaccgcuuccccuauuucgcccuacgcuaccuggaccucaaugaauccuucaaauccauccgauuccaagucgaccucggcaccuaccacuacugcauauacgacaaaaagaucggcuaugagcaagaaaaacgccaccucacucgaacacuccuuaacuucggacgccuccaagacuucacugaaaucaaccgcccgcaagaauggaaagcccucacaaaggaccuggauuacaacgaaaccucgaaucaaccguucaucuccaaaaccacaccacacuaccacaucacagacaacaagauaggcuuucggcuccgaaccucgaaagagcucuaucccucgcucgaagucaaggacggcgccaaccgcauugcgaaauacccauauaacagcgacuucgucgcacacgcguuuaucucaaucuccguccaugaacuccucccacucauguuuuaccaacaccucacgggaaaaucggaagaccuccucaaggagaccguacgacacauccaacgaauuuacaaagacuucgaagaggaacggauaaacacuaucgaagaccucgaaaaagcaaaccagggccgccucccccucggugcuuuccccaaacaaaugcucgggcucuuacaaaacaaacaacccgaccuaucggaaaaggcgaaaaucaaaauagaaaaacugaucgccgaaacaaagcuacucucccaccgccucaacacaaaacuuaaaagcaguccgaaacucggcaaacgaagggaaaaacucaucaaaaccggaguacucgccgacuggcugguaaaagacuucaugcgcuuccaaccugugguguaugacgcacaaaaucaaccaaucaaaucguccaaagccaacagcacagaaucccggcuaauacgacgcgcccucgcacucuacggcggcgagaaaaaccgccuagaaggcuacuucaaacaaacgaauuuaaucggcaacaccaauccacacccauuccuuaacaaguucaacuggaaagcgugccgcaaccucgucgauuuuuaccaacaauaccuagaacagcgggaaaaauuccucgaggccauaaaacaccaaccaugggaaccauaccaauacugccuccuccucaaagucccgaaagaaaaccgcaaaaaccuugucaaagggugggagcaagggggaaucucacucccacgaggccuuuuuaccgaagccauaagagaaacccuaucaaaagaccucacccucucaaagcccauccgaaaagagauuaagaaacacggccggguaggcuucaucucccgcgccauaacacucuacuucaaagaaaaauaccaagacaaacaccaauccuucuacaaccuguccuacaaacuagaggcuaaagccccucuccucaagaaagaagaacacuacgaauacuggcagcaaaacaaaccccaaucccccaccgagagccaacgccuagaacuccacaccucugaccguuggaaagacuaccugcuguacaaacgguggcaacacuuggagaagaaauuacgccuauaccgaaaccaagacauaauguuaugguuaaugacccucgaacugaccaaaaaccacuucaaagaacucaacuuaaacuaccaccaacucaaacucgaaaaccucgcagucaacguacaagaggcagacgccaaacuaaacccccugaaucaaacccuacccaugguacuccccguuaaaguguaccccaccaccgccuucggugaaguacaguaucacgagacgcccaucaggaccgucuacauccgcgaagaacaaacaaaagcccugaagaugggcaacuucaaagcgcuggucaaggaccgucaccucaacggucuauucuccuucaucaaagaggaaaacgauacgcaaaaacacccaaucucacaacuccgccuccgccgcgagcuggaaaucuaccaaucucuccgagucgacgcauucaaagaaacacuaucccuggaggaaaagcuccucaacaagcacgccagucuuuccucucucgaaaacgaguuccgcacgcugcuugaagaguggaaaaagaaauacgcugccagcuccaugguuacggacaaacacauagccuucaucgccagcguccgcaacgcguuuugccacaaccaguaccccuucuacaaagaaacccuacacgcccccauccuacucuucacaguagcccaacccaccacagaagaaaaagacggccuuggcaucgcagaagcacuccuacgcguccuacgagaguacugugaaauaguaaaaucccagauuuag

SEQ ID NO: 11827 - RNA, 2850 nt, Artificial Sequence
  ARMAN Cas9 variant__Candidatus Micrarchaeum acidiphilum__OJI07263.1__Cas9
augcgagacucaaucacagcaccccgauacucauccgcccuagcggcccgcaucaaagaguucaacucugccuucaaacucgggauagaucuaggaaccaaaaccggcgggguggcacuggugaaagacaacaaaguacuccuagcaaaaacuuucuuagacuaccacaagcagacgcuagaggaaagacgcauccaccgacguaaccgcaggucacgccucgcccgccgcaagcggaucgcaaggcucaggagcuggauacuuagacaaaagaucuacgggaagcagcuccccgacccauacaaaaucaagaaaaugcaacuaccaaacggcguaaggaaaggggaaaacuggauagaucugguggucucaggacgagaccugaguccggaagcauucguacgcgccaucacccucauauuccagaaaaggggccaacgcuacgaagaagucgcgaaggagauugaggaaauguccuacaaagaguucucaacccauauuaaggcacucaccagcguaacggaggaggaauuuacagcgcucgcagccgaaaucgaacggagacaagacgucguagacacugacaaagaggcggaaagauacacccaacugagcgaguuacucucaaaagucucagagucuaaaagcgaaagcaaagaccgcgcacaaagaaaggaagaccucggcaagguggugaacgcauuuugcagcgcccacagaauagaagacaaagacaaauggugcaaagaacucaugaagcuguuggaccgcccagugcgacacgcccgcuuccucaacaagguucucauccggugcaacauaugcgaccgcgcaacacccaagaaauccagaccagacguccgcgaacuccuauacuucgacaccgucagaaacuuccugaaagcuggacgaguggagcagaaccccgacgucaucucauauuacaagaaaauauacauggacgccgagguaaucagggucaaaauccuaaacaaagaaaaacuaacagacgaagacaagaaacagaaacggaaacucgcauccgaauugaaccgauacaaaaacaaagaauacguaaccgacgcccaaaagaaaaugcaagaacaacucaaaacacuacuauuuaugaaacucacaggccgcucgcgauacugcauggcacaccuaaaagaaagagcagcaggaaaagacgucgaagaagggcuccauggcgucgugcaaaagcgccacgaccggaacauagcacagcgcaaccaugaucuccgaguaauaaaccugaucgaaagccuccuauucgaccaaaacaaaagccucagcgaugccauccgcaagaacggacucauguacgucaccauagaagcaccagagcccaagacaaaacacgcaaagaaaggcgccgccgucguccgagacccccgaaaacucaaggaaaaacuauucgacgaccaaaacggcguaugcauauacacaggauuacaacuggacaaacucgagauuuccaaauaugaaaaagaccacaucuuccccgacuccagggacggcccgagcauacgggacaacuuaguccugaccacaaaggaaauuaacucugacaaaggagauagaacgccaugggaauggaugcacgacaaccccgaaaaauggaaagccuuugaacgcagaguagcggaguucuacaagaaaggccgcauaaaugaacgaaaaagagaacucuugcucaacaaaggaaccgaauacccaggcgacaauccgacugagcucgcacgaggcggcgcccgggucaacaacuucauaacagaguucaacgauaggcuaaaaacccacggagugcaagaacuacaaaccauauucgaacgcaacaagccaauaguacaagucguucgcggagaagaaacacagcgccugcgacgccaguggaacgcacugaaccaaaacuucaucccucucaaggacagagccaugagcuucaaccacgccgaagacgcugcaauagcugccucaaugccacccaaauucuggcgagaacaaauauaccgcacggcauggcacuucggacccagcggaaacgagaggccggacuucgcacucgccgaacuagccccgcaguggaacgacuucuucaugacaaagggcggacccauaaucgcaguguuaggcaaaaccaaauauucauggaaacacucaaucauagacgacacaauauacaaacccuucuccaaaagcgccuacuacguggggaucuauaagaaacccaacgccauaaccagcaacgcuauaaaaguccuaagacccaagcuccuaaacggagaacacaccaugucuaaaaacgccaaguacuaccaccaaaagaucggaaacgaacgguuccuaaugaagucccaaaaaggaggauccaucaucaccguuaaaccccacgacggcccagaaaagguucugcaaaucagccccaccuacgaaugcgccguacuaaccaagcaugacggcaagaucaucguaaaguucaaaccaauaaaaccccuccgagacauguacgccaggggcguaaucaaagcaauggacaaggaacucgaaacuucccuaagcucgauguccaagcacgccaaauacaaggaacuccacacccacgauauuaucuaccuccccgcgacuaagaaacacguagacggcuacuucauaaucacaaaacuaagcgccaaacacgguaucaaagcacuaccggaauccauggucaaagucaaauacacucaaaucggcagcgagaacaacucagaaguaaaacuaaccaaaccaaaacccgagaucacccucgacagcgaagacaucaccaacaucuacaacuucacgcgcuag

SEQ ID NO: 11828 - RNA, 2904 nt, Artificial Sequence
  ARMAN Cas9 variant__Candidatus Parvarchaeum acidiphilum__APG80630.1__Cas9
augcuaggcagcucccgcuaccuccgguacaaccugaccagcuucgaggggaaggagcccuuucugaucaugggcuauuacaaagaguacaacaaggaacucagcagcaaggcccagaaagaguuuaacgaccagaucagcgaguucaacagcuacuacaagcuggggauugaccugggcgacaagaccgggauugccaucgugaagggcaacaagaucauccucgcgaagacgcugaucgaccugcacucccagaagcucgacaagcgccgggaggcccgccggaaccgccggacccgccugagccggaagaagcgccuggcccggcuccgcuccugggugaugcggcagaaggugggcaaccaacgccugccggaccccuacaagaucaugcacgacaacaaguacuggagcaucuacaacaaguccaacagcgcaaacaagaagaauuggauugaccugcucauccacuccaacucucugagcgccgacgacuuugugcgggggcugaccauaaucuuccgcaagcggggcuaccuugcguucaaguaccugagccgccuguccgacaaggaguuugagaaguacaucgacaaucucaaaccgcccaucagcaaguacgaguacgacgaggaccuugaggagcuuuccagccgggucgagaacggggagaucgaggagaagaaguucgagggcuuaaagaacaaauuagauaagaucgacaaggagagcaaagacuuccaggugaagcaacgcgaggaagugaagaaggaauuagaggaccuagucgaccuguucgccaaguccguagacaacaagaucgacaaggcccgguggaagagggagcugaacaauuugcuggacaagaaggugcgaaagauccgguucgacaaccgcuucauccugaaaugcaagauaaaggggugcaacaagaacacccccaagaaggagaagguccgggacuucgagcucaagauggugcugaacaacgcccgcagcgacuaccagaucuccgacgaggaccugaauagcuuccggaacgaggugaucaacaucuuccagaagaaggagaaccucaagaagggcgaacugaagggcgucacgaucgaggaccugcgaaaacagcucaacaagaccuucaacaaagcgaagaucaagaaggggauccgggagcagauccgcuccaucguguucgagaagaucagcggccgguccaaguuuugcaaggaacaucugaaggaguucagcgagaagcccgcacccuccgaccgcaucaacuacggagugaacagcgcccgggagcagcacgacuuccgcguccugaauuucaucgacaagaagaucuucaaggacaagcucaucgaccccuccaagcugcgguacaucaccaucgagagcccggagcccgaaaccgaaaagcuggagaagggccagaucuccgagaaauccuucgagacgcucaaggagaagcuggccaaggagaccggcgggaucgacaucuacaccggggagaaguugaagaaggacuuugagaucgagcacauuuucccccgcgcccggauggggcccuccauccgcgagaacgagguggcgagcaaccucgagacaaacaaagagaaggccgaccggacgccgugggagugguucggucaggacgagaaaagaugguccgaguucgaaaagcgggugaacagccuguacuccaagaagaagaucagcgagcgcaagcgcgagauccugcugaacaagagcaacgaguaccccgggcucaaccccaccgagcugucccggauccccagcaccuuauccgacuucgucgaaagcauccgcaagauguucgugaaguacggcuaugaggagccgcagacccucguacagaagggcaagcccaucauccagguagugcgggggcgcgacacgcaggcccugcgguggcgcuggcaugcacuggacuccaauaucauccccgagaaggaccgcaagagcuccuucaaccacgcugaagacgcggugaucgccgccugcaugcccccguacuaucuccggcagaagaucuuccgagaggaggccaagaucaaacgcaaggucagcaacaaggagaaggaggugacgcggcccgacaugcccaccaagaagauagccccaaacuggagcgaguucaugaaaacccgcaacgagccggucauugagguuauuggcaaggugaagccaucuuggaagaacuccaucauggaccagacguucuauaaguaccugcugaagcccuucaaggacaaccucauaaagauccccaacgucaagaacaccuacaaguggaucggggugaacggucaaaccgacagccugucccugccgagcaaggugcucuccaucucgaacaagaaggucgauuccagcaccgugcugcuggugcacgacaagaagggcgggaagcggaacuggguaccaaagagcaucggcgggcuccugguguacaucacgcccaaggacggcccgaagcgcaucguucaggucaagcccgcgacccaggggcuccucaucuaccggaacgaggacggccgcguugacgccgugcgggaguuuaucaaccccgucaucgagauguacaacaacgggaagcuggccuucguggagaaggaaaacgaggaggaacugcucaaauacuucaaccugcuggagaagggacagaaguucgagcgaauccggcgcuacgacaugaucaccuacaacuccaaguucuacuacgugaccaagaucaauaagaaccacagggucacgauccaggaggagagcaagaucaaggccgagucagacaaggucaagagcuccagcggcaaggaguacacccgcaaggagaccgaggaguuauccuugcagaagcuggcggaacucaucagcaucuaa

SEQ ID NO: 11829 - RNA, 2850 nt, Artificial Sequence
  ARMAN Cas9 variant__Candidatus Micrarchaeum sp.__OJT94500.1__Cas9
augcgagacaguaucacggcaccccgcuacaguucagcgcucgccgcaagaauaaaagaauuuaacucagcguucaaacuaggaaucgaccuaggcacgaaaacagggggcguagcccucguaaaagacaacaaaguccuccuagcaaaaaccuuccucgauuaccauaagcaaacccuagaagagaggcgcauccaccgcagaaaccgccguucacggcucgcccgacgcaaacgaaucgcgagacuccgaagcuggauacuacgccaaaagaucuacgggaaacaacugcccgacccguauaaaauaaagaaaaugcaacugccgaacggcguccgcaaaggcgaaaacuggaucgaccuagucgucagcggucgggaccucagcccagaggccuucgugcgggcaaucacgcucauauuucaaaagagaggccaacgcuacgaagaagucgccaaagaaauugaagagaugagcuacaaagaguucuccacccacauaaaagcgcuaaccucggucacagaggaagaguucaccgcccucgcagccgaaaucgagcgacgccaagacguagucgacaccgacaaggaggcagaacgcuacacgcaacucagcgaacuacucucaaaggucucagagagcaaaucugaaucaaaagaccgcgcacaaagaaaagaggacuuaggaaaggugguaaacgccuucugcuccgcccaucgcauagaagacaaagacaaguggugcaaagaacuaaugaaacuccuggaccgaccaguccgccacgcacgguuccucaacaaaguccuaauacgcugcaacauaugcgaccgagcaacucccaaaaagagccgaccagacgucagagaacuccucuacuucgacaccguccguaauuuccuuaaagcgggccgcguagaacaaaacccagacguaaucagcuacuacaagaaaauauacauggacgcagaaguuauccgagucaaaauccugaacaaagaaaaacuaaccgacgaggacaagaagcaaaaacgaaaauuagcgagcgaacucaaccgcuacaaaaacaaggaauacguaacagacgcacaaaagaaaaugcaagaacaacuaaaaacccuccucuucaugaaacucacaggacggucccgauacugcauggcgcacuugaaagaaagagccgccggcaaagacguagaagagggccugcacggcguagugcagaaaagacaugaccgaaacauagcccagcgcaaccacgacuuacgggugauaaaucucaucgagucacuccuguucgacccgaacaaaagccugucagacgccauccgcaagaacgggcucauguacguaaccauagaggcccccgaacccaaaaccaaacacgcuaagaaaggcgccgcagucguccgcgacccccggaagcugaaagagaaacuguucgacgaccagaaugguguaugcauauacacgggacuacagcucgacaaacucgagaucuccaaguacgaaaaagaucacaucuucccagacagcagagauggaccauccauccgggacaaccucguacuaaccaccaaagaaaucaacagcgacaagggagaccgaacacccugggaauggaugcacgacaacccagagaaauggaaagccuucgaaagacgggucgcagaguucuacaagaaagggcggauaaacgaacgaaaaagagaacuucuacucaauaaaggcaccgaauauccgggcgacaaccccacggagcucgcacgcggcggcgcgcgagucaacaacuucaucacugaguucaacgaccgccucaaaacgcacggcgugcaagaacugcaaacaaucuucgaacgcaauaaacccauaguccagguggugcgcggagaggaaacccaaaggcuaagacgccaauggaacgcccuaaaucaaaacuucauaccacucaaagacagagccaugagcuucaaccacgccgaagacgcagcaaucgcugcaagcaugcccccgaaauucuggcgagaacaaauauaccgcacagcauggcacuucgggccaucagguaacgaacgccccgacuucgcacucgccgaacuagccccgcaauggaacgacuucuuuaugaccaaaggaggcccaaucaucgccguccuaggcaaaacaaaauauuccuggaaacacagcauaauagaugacacaauauacaaaccauucagcaaaagcgcuuacuacguuggaaucuacaagaaacccaacgccaucaccaguaacgccaucaaaguccuaagaccgaaacuccucaacggagaacacacuaugucuaagaacgcuaaauacuaccaccagaaaaucggaaacgaaagauuccuaaugaaaagccaaaagggaggcagcaucaucacagucaagccacacgacggcccagaaaagguacugcaaauaucaccaacauaugaaugcgcaguacuaaccaagcaugacggaaagaucaucgucaaauucaaacccauaaaaccacuacgagacauguacgcaagaggggucauaaaggcgauggacaaagaauuagaaacaagccuaagcuccaugucaaaacacgccaaauacaaagaacuacacacccacgacaucaucuaccuccccgcaacaaagaaacacgucgacggcuacuucaucaucacaaaacucagcgccaaacacggcauaaaagcccucccggagucuaugguaaaagucaaauacacacaaauaggguccgaaaacaacagcgaagucaagcugacuaaacccaaacccgagaucacccucgacagcgaagauaucaccaauauauauaacuucacccgauaa

SEQ ID NO: 11830 - RNA, 2961 nt, Artificial Sequence
  CasX variant__Deltaproteobacteria bacterium__OGP07438.1__CasX
auggaaaaacgaauaaauaaaauccguaagaaacuaucagccgacaacgccacaaagcccgucagcagauccggacccaugaaaacgcuucuagugagagucaugacugacgacuuaaagaaacgucuggagaaaagacguaaaaagcccgaagucaugccccaaguaaucagcaacaacgcagcaaacaacuuacgcaugcuccucgacgacuacaccaaaaugaaagaagcaauacuccagguguacuggcaagaguucaaagacgaccacguaggucuaaugugcaaauuugcccagccagccagcaagaaaauagaccagaacaaacucaagccagaaauggacgaaaaaggaaaccugaccacagcaggauucgcaugcucccaaugcggacagccgcuguucguauacaaacucgaacaaguaagcgaaaagggcaaagcauacacgaacuacuucggacgauguaacguggcagaacacgaaaaacuuauacuccuagcacaacuaaaacccgaaaaggacucugacgaagccguaaccuacagccucggaaaauucggccaacgcgcccuagacuucuacaguauccacguuacaaaggaaucgacacaccccguaaaaccgcucgcucaaauagccggcaaccgauacgcaagcggcccaguaggcaaagcgcuaagcgacgccugcauggggaccaucgcgagcuuccuaagcaaauaccaagauaucauaauagaacaccagaaggucgucaaaggcaaccagaaaaggcuggaauccuugagagaacuggccggaaaagagaaccucgaauaccccagugucacccuaccgccacaaccucacacaaaagaaggcgucgacgcauacaacgaagugauagcccgcguccgcauguggguuaaucucaaccucuggcaaaaacuuaaacucucacgcgacgacgccaaaccauuacuacgacucaagggcuuccccagcuuccccgugguagaacgccgcgaaaacgaaguagacugguggaacaccauaaaugaagucaagaaacucauagacgccaagcgcgacaugggccgaguguucuggucgggugugaccgccgagaaaagaaacaccauccucgaaggguacaacuaccuccccaacgaaaacgaccacaagaaacgcgaaggcucgcucgagaaccccaagaaaccugccaaacgccaauuuggcgaccuccuacucuaucuggaaaagaaauacgccggcgacugggggaaaguauucgaugaagcgugggaacgcauagacaagaaaauugccggccugacaagccacaucgagagagaggaagcacgcaacgcugaagacgcacaauccaaagccguccucaccgacuggcuacgagcaaaagcauccuucguccuagaacgacuaaaagaaauggacgaaaaagaguucuacgccugcgaaauucaacuacaaaagugguacggagaccugagaggaaacccuuucgccgucgaagccgaaaaccgagucguagacaucuccggcuucaguaucgguucggacggacacagcauacaauaccgcaaccuccucgcauggaaguaccuggaaaacggcaaaagagaauuuuaccugcucaugaacuacggcaaaaagggaagaauccgauucacggacggaacugacaucaagaaaagcggaaaauggcagggauugcuauacggcggcggcaaagcaaaaguaauagaccucaccuucgaccccgaugacgaacaacucauaauacucccccucgcguucggaacgagacaaggccgggaguucauauggaacgaccuacugucccuagaaaccgggcuaaucaaacuggcaaauggccgcgugauagagaaaacaauauacaacaagaaaaucggccgcgacgaaccggcccucuucgucgcgcugacauucgaacgaagagaagucgucgacccgagcaacauaaaacccgucaaccuaaucggagucgaccgaggagaaaacaucccagccgucauugcccugacggaccccgaaggaugcccacugccagaguucaaagauagcucuggaggaccaaccgacauccuccgaaucggagaaggauacaaagaaaaacaacgagccauacaagcagccaaagaaguagaacagagacgagccggagguuacagccgaaaauucgcaucgaaaucgcgaaaccuugcggacgacaugguaaggaacucagcacgagaucucuucuaccacgccguaacacacgacgccgugcucgucuuugaaaaccucucccgcggguucggaagacaaggaaaaaggaccuucaugacagaacgacaauacacaaaaauggaagacuggcugacagcaaaacuagcauacgagggacuuaccucgaaaacauaucugagcaaaacccuagcccaauacacaagcaaaacgugcucuaacugcggauucacaaucacaaccgcagacuacgacggaaugcugguccgccuaaagaaaaccuccgacggaugggcgaccacgcugaacaacaaagagcugaaagccgagggccagaucaccuacuacaaccgauacaaacgacaaaccguagaaaaagaacuaagcgccgagcuggaccgacuuuccgaagaaucaggcaacaacgauauaagcaaauggaccaaaggacgacgggacgaggcacuauuccuacugaagaaacgcuucagccaccgaccaguccaagagcaauucgugugccuggacugcggacacgaaguacacgcggacgagcaggcagcacuaaacauagcccggucuuggcuauuccucaacuccaacagcacggaguucaaauccuacaaauccgguaagcaacccuucgucggcgcauggcaagcauucuacaaacgaagacuaaaagaagucuggaaaccaaacgccuag

SEQ ID NO: 11831 - RNA, 2937 nt, Artificial Sequence
  CasX variant__Planctomycetes bacterium__OHB99618.1__CasX
augcaagaaaucaaaagaauuaauaaaauccgcagaagacucgugaaagacuccaacacuaagaaagcaggcaagacaggacccaugaaaacccuccuaguccgagucaugacacccgaccuacgcgagcgccuagagaaccuucgcaagaaacccgaaaacaucccccagcccaucuccaacacaucacgcgcaaaccucaacaaacuacuaacggacuacacagaaaugaagaaagcuauccuccacguguacugggaagaguuccaaaaagacccaguaggccuaaugagccgagucgcacaaccagcccccaaaaacaucgaccagcgcaaacuaaucccggucaaagacggcaacgaacggcuaaccaguagcggcuucgccugcagccagugcugccaacccuuauacguauauaaguuagaacaaguaaacgauaaaggaaaaccacacaccaacuacuucggccggugcaacguaagcgaacacgagcgacucauacuccuauccccgcacaaaccagaagccaacgacgagcuagucaccuacagccucgggaaauucggccaacgagcccucgacuucuacuccauccacgugacccgugaaucaaaccaccccgugaaaccacuagaacagauaggcggaaauucaugcgccagcggccccguagguaaagcauuauccgacgccugcaugggggccgucgcgucguuccugaccaaguaccaggacauaauccuagaacaccaaaaagucauaaagaaaaaugagaaaagacuagcaaacuugaaagacauagcauccgcgaacggucucgcuuuucccaaaaucacacucccgccucaaccccacacaaaggaaggaauagaagcguacaauaacguagucgcacagauagugauaugggucaaccucaaccuuuggcagaaacucaaaauaggccgggacgaagcuaagccauuacaacggcugaaagguuucccaucguucccacucguagaacgacaagccaacgaagucgacuggugggauauggucugcaacguaaagaaacucaucaacgagaaaaaggaagacggcaaagucuucuggcaaaaccuugcaggguacaaacgccaggaagcacuccucccauaccuaagcucagaagaagaucggaagaaaggcaagaaauucgcgcgcuaccaguucggagaccuccuccuccaccucgagaagaaacacggcgaagacuggggcaaaguauacgacgaagccugggaacguaucgacaagaaagucgaaggccucaguaaacacaucaaacucgaagaagaacgccgguccgaagacgcgcagucaaaagcagcacuaacagacuggcuccgcgccaaagccagcuucgucaucgaagggcuaaaagaagcagacaaagaugaguucugccgcugcgaacugaaacugcaaaaaugguacggcgaccuccggggcaagccauucgcaaucgaagcagaaaacagcauccuagacaucaguggcuucagcaaacaauacaacugcgcauucaucuggcaaaaagauggcgucaagaaacucaaucuauaccuuaucauaaacuacuucaaaggcggcaaacuacgcuucaagaaaauuaaaccagaagccuucgaagccaaucgguucuacacuguuaucaacaagaaaagcggcgaaauaguccccauggaggucaauuucaacuucgacgaucccaaucucauuauccuaccccucgcauucggaaaaagacaaggccgagaguucauauggaacgaccuccucagccucgagaccggcagucuaaaauuggccaacggccgggucauagagaaaacccuuuacaaucgacgaacccgccaagacgagccagcccucuuugucgcccuaaccuuugaacgacgugagguacucgacucauccaacauaaaaccaaugaaccucaucggcaucgaccgcggagaaaacauacccgccguaauugcccugaccgaccccgaagggugcccacucucgagguucaaagacagccuuggaaacccaacacacauccuccgcauaggagaauccuacaaagaaaaacagcgcacuauccaagcagccaaagaggucgaacaacgacgagcagggggcuauagcagaaaauacgccagcaaagccaaaaaccuggcagaugacaugguccgcaacacagcacgagaccuccuguacuacgcaguaacacaggacgccaugcuaauauucgaaaaccuaucacgaggcuucggacgacaaggcaagcgcacguucauggccgaacgacaauacacacguauggaggacuggcucaccgcaaaacucgcauacgaaggacucccaagcaaaaccuaccucuccaagacgcuagcccaauauaccuccaagacaugcuccaacugcggauuuacaauaaccagcgcagacuacgaccggguacucgagaagcuaaagaaaacagccaccgguuggaugacaacgaucaacggcaaagaacucaaaguggaagggcaaauaaccuacuacaaucgauacaaacggcaaaacguggucaaggacuuaucagucgagcucgaucgacuauccgaggaaagcguaaauaacgacauauccagcuggaccaaaggccggagcggcgaagcccuaucgcuacugaaaaagcgcuucagccaucgaccuguccaagaaaaauucgucugccucaacugcggcuucgaaacacacgcagacgaacaagcggcucugaacauagcccgaagcuggcuguuccuccgcagucaagaauacaagaaauaccagaccaacaaaaccacaggcaacaccgacaaacgcgccuucguugaaaccuggcagucauuuuacaggaagaaacuuaaagaaguauggaaacccgccgucuga

SEQ ID NO: 11832 - RNA, 3378 nt, Artificial Sequence; identical to SEQ ID NO: 11242
  CasY variant__Candidatus Katanobacteria bacterium__OJI08769.1__CasY

SEQ ID NO: 11833 - RNA, 3864 nt, Artificial Sequence
  CasY variant__Candidatus Kerfeldbacteria bacterium__OGY82221.1__CasY
augaaacgcauacuaaacucccuaaaaguagcagcacuacggcuccuauuccgcggaaaagggucagaacuugucaaaaccgucaaauauccucucguaucccccguacaaggcgcaguagaggagcuagccgaagcuauacgccacgacaaccuucaccuuuuuggccagaaagaaaucgucgaccuaauggagaaagaugaaggaacccaggucuacuccguuguugauuucuggcuagacacucuccgccuagguauguucuucuccccguccgccaacgcacucaaaaucacacucggcaaauuuaacucagaccaaguauccccuuuucgcaaaguauuggaacagagcccguucuuccuggccggccgacucaaaguugagcccgcagagcguauacucucaguugagauucgaaaaaucggaaaacgagaaaaccgagucgaaaacuacgccgcugacguagagacuugcuucaucggccaacucagcuccgacgaaaaacagucaauacaaaaacuagcuaacgacaucugggacagcaaggaccacgaagaacaacgcaugcucaaggccgacuuuuucgccaucccccucauaaaagauccgaaagcggucacagaggaagaccccgaaaacgagaccgcaggcaaacaaaaaccacucgaacucugcgucugccuaguacccgaacucuacacccgcggauucggcagcaucgccgacuuucuaguacaacgacucacacuccuucgggacaaaaugagcacagacacagcagaagacuguuuggaauacguaggaauagaggaagaaaaggggaacggcaugaacucacuccucgguacuuuccuuaagaaucuucaaggggauggauucgagcagaucuuccaguucaugcucggcuccuacguaggauggcagggcaaagaggacguucuccgagaacgccuggaccucuuagccgaaaaagugaaacgacuacccaaacccaaguucgcaggcgaguggucuggccaccgcauguuccugcauggccaacucaaaagcuggucgagcaacuuuuuccgucuauucaaugagacccgugaacuccuggaauccauaaaguccgauauccaacacgcaacaaugcuuauaucauaugucgaagaaaagggcggauaccacccccagcuucugucgcaauaccggaagcucauggaacagcucccagcgcuccguacaaaggucuuagaccccgaaaucgaaaugacucauaugucggaagccgugcggagcuacauaaugauacacaaguccguugccggauuucuccccgacuuacucgaaucccucgaccgcgacaaagaccgggaguuccugcuguccauauucccucgcauccccaaaaucgacaagaaaacuaaagaaaucguagcuugggaacugcccggcgagcccgaagaaggauaccucuucaccgcaaauaaccuguuccgcaacuuccuugagaauccuaaacacguuccccgcuucauggcagaacgaauaccagaggacuggaccagacuacgauccgccccaguuugguucgauggcauggucaagcaguggcaaaaaguugucaaccagcucgucgaauccccaggugcccucuaccaauucaacgaauccuuccuacgccagcggcuacaggcaaugcugacagucuacaaaagagaccuacaaacagaaaaauuccucaaacuacuugcugacgucugccguccccuaguggacuucuuugggcugggaggcaacgacaucaucuucaaaucgugccaggacccacggaaacaguggcaaacagucaucccccucucagucccugccgacgucuacaccgccugcgagggccuagcgauacgacuccgugaaacucucgguuucgaauggaagaaccuaaaaggacacgagcgcgaggacuuccuccgccuccaccaacuacucgguaaccuacuauuuuggauacgcgacgccaaacucguaguuaaacuagaagacuggaugaacaauccaugcguccaagaguacguugaagcccgcaaggccaucgaccuaccgcucgaaauauucggauucgaagugcccauauuccuuaacggauaucucuucucagaacuaagacaacuugaacuccuauuacgccgaaagucagucaugacgagcuacuccguuaaaacuacagguuccccaaaccgacucuuccaacuuguauaucuaccacuaaauccaagcgaccccgaaaagaaaaauuccaauaauuuucaggaacgacucgacaccccaacaggucuaagucgcagauuccucgaucugacauuagaugcguucgcaggcaaacuacucaccgacccuguuacccaagaacuuaaaacaauggccggauucuacgaccacuuguucggcuucaagcucccgugcaagcuggcagcaaugaguaaccacccgggcuccagcuccaaaaugguggugcuagccaagccgaagaaaggaguagcaagcaacaucggcuuugaacccauaccagacccagcccacccagucuuccgaguccgcagcucauggccagaacucaaguaccuagagggccugcuguaccugcccgaagacaccccgcuuacuauagaacuagcggagacguccgucucuugccagucagugagcuccguagccuucgaccucaaaaaccucacaaccauuuuaggcaggguaggggaguuccgcgucaccgcggaccaacccuucaaacuaacacccauuauccccgaaaaagaggagagcuucauagggaaaaccuacuuaggacucgacgccggagaacgcuccggcguaggcuucgccauaguaaccguggacggcgauggcuacgaaguccaacgacucgguguccaugaagacacucaacuaauggcgcuccagcaagucgccucgaaaagucuaaaagaaccagucuuccaaccgcuccguaagggcaccuuccgccaacaggaaagaauacggaaaagccuacgaggcugcuacuggaacuucuaccacgcccucaugaucaaguaccgagcgaaagugguccaugaagaaucuguagguaguagcggacucguaggccaguggcuccgggcauuucaaaaggaucucaagaaagccgaugugcugccgaagaaaggcggcaaaaacggagucgacaaaaagaaacgcgaguccagcgcacaagacacccucugggguggcgccuucagcaagaaagaagaacaacaaauagcauucgaaguacaggccgcaggcagcucccaauucugccuaaaaugcggcuggugguuccaacucggcaugcgugaaguaaaccgcguucaggaauccggggucguguuagacuggaaccguuccaucguaacguuccucaucgaaagcuccggggagaaaguauaugguuucagcccccaacaacuggaaaaaggguuccgaccugauaucgagaccuucaagaaaauggugcgcgacuuuaugcgaccaccuauguucgacagaaaagggcgcccugcugccgccuaugaaagguucguccucggccgcagacaccgacgcuaccgcuucgacaaaguauucgaagaacgcuucggccgguccgccuuauucaucugcccaagagucggcugcgggaacuucgaccauucgucugagcaaagcgccguaguacuagcccuaaucggguacaucgccgauaaagagggcauguccggcaagaaacuggucuacguccgccucgcagaacuaauggcagaauggaaacuuaagaaacucgaacgcagccgagucgaagaacaguccuccgcccaauaa

SEQ ID NO: 11834 - RNA, 3579 nt, Artificial Sequence
  CasY variant__Candidatus Komeilibacteria bacterium__OJI06454.1__CasY
auggccgagucaaaacagaugcaaugcagaaaauguggggccucgaugaaauacgaagucaucgggcuuggcaaaaagagcugccgguauaugugcccagacugcggaaaccacaccagcgcacgcaaaauacaaaacaaaaagaaacgcgacaaaaaguaugguagcgcuaguaaagcccagucccagcgaauagcaguagcgggcgcccucuaccccgacaaaaagguacaaaccauuaaaaccuacaaauaccccgccgaccucaacggcgaaguacacgaccggggcguagcagagaaaauagaacaagccauacaagaagaugaaauagggcuacucggccccucuucggaauacgcaugcuggauagcgucucagaaacaaucggagcccuacagugugguagacuucugguucgacgccgucugcgcaggaggcgucuucgccuacucaggggcaaggcugcuaagcacgguacuacaacuaagcggggaagagagcguccucagggccgcccuagcaucaucacccuuugucgacgacaucaaccuagcacaagcagagaaauuccuugcgguaucccgccggacaggccaagacaaacugggaaaacgcauaggcgaaugcuucgcagaaggccgacuggaggcacugggaauuaaagaccgaaugcgagaguucgugcaagccaucgacguagcccagacggccggccaacgcuucgccgcgaaacucaaaauauucggcauaagccaaaugcccgaagcaaagcaauggaauaaugacucaggacuaacaguaugcauccuucccgacuacuacguccccgaagaaaaccgagccgaccaacuuguaguccuacugcgcagguuacgagaaaucgcauacugcaugggaaucgaagacgaagccggcuucgagcaccucggaauagaccccggagcacuaagcaacuucuccaacggaaacccaaaacgcggcuuccuaggcagacuguugaacaacgacauaauagcccucgccaacaacauguccgccaugacacccuacugggaagggcgcaaaggcgaacucaucgagagacuugccuggcugaaacaccgugcagaaggccucuaccuaaaagagccacacuucggaaauagcugggcugaccaccgaagucgaaucuucagccgcaucgcaggaugguugucaggcugcgcgggcaaacugaagauagccaaagaccaaauaagcggaguccgaaccgaucucuuccuccuuaaacgauuacuagacgccguaccucaaagcgcaccauccccagacuucauagccucaaucuccgcccuagaccguuuccuugaagcugcagaaucgucccaagacccugcagaacaaguaagggcguuauacgccuuucaccuaaacgccccagcaguccguuccauagcaaacaaagcaguacaacgcagcgacucgcaagaaugguuaauaaaagaauuagacgcagucgaucaccucgaguucaacaaagccuuccccuuuuucucagacacaggcaagaaaaagaaaaagggagccaacucuaacggagcaccuuccgaagaagaauacacggaaaccgaauccauucaacaacccgaagacgcugagcaagagguaaacggccaagaaggaaacggagccuccaaaaaccagaagaaauuccaacgaaucccccgauucuucggcgaaggaagccgaucagaguacaggauacuuaccgaagccccgcaauacuuugacauguucugcaacaacaugagagcaaucuucaugcagcuugaaucccagccccgaaaagcaccacgggacuuuaagugcuucuuacaaaaccgccuccagaaacucuacaagcagaccuuccuaaacgcucgguccaauaaaugcagagcacuccuagaguccgugcucaucuccuggggugaauuuuacaccuacggagccaacgaaaagaaauuccgccuccggcacgaagcaagcgaacggucguccgacccagacuacguaguacaacaggcccuggagaucgcgagacgucuauuccucuucggcuucgaauggcgcgacugcucugccggcgaaagaguagacuuagucgaaauacacaagaaagccauaucauuccuccucgcaauuacccaagccgaaguauccgugggcuccuacaauuggcucgguaacaguacagucucaagauaccuaucaguagcaggaaccgacacacuguacggaacccaacuugaagaguuccuaaacgcaacgguacuaucacaaaugcgagggcuagcaauccgacuuuccucacaagaacugaaagacgguuucgacguacagcucgaauccucaugccaagauaaccuacaacaccuccuaguauaccgcgccagccgagaccucgcagccuguaaacgagcgaccugccccgcggaacuagacccgaaaauacucguccuaccagcaggagcauucauagccagcgucaugaaaaugaucgaacggggagacgaaccccucgcaggcgcauaccugagacacagaccacacagcuucggcuggcaaauucgcguccgaggggucgccgaaguaggcauggaccaaggcaccgcccucgcuuuccaaaaaccgaccgaaagcgaacccuucaaaauaaaaccauucagcgcccaauacggacccguguuauggcucaacagcagcagcuacucucaaagccaauaucucgacggcuucuuaucccaacccaaaaacuggucgaugagagugcuuccccaagcagguuccguacgcguagaacaacguguagcgcucauauggaacuuacaggccggcaaaaugagacuggagcgauccggggccagggcauuuuucaugcccguuccuuucuccuucagaccaagugguagcggagacgaagcaguauuagcccccaaucgauaccuaggccuguucccgcauuccgggggaaucgaauacgccgucguugacguacuagacucggcgggauucaaaauccuagaaagagggaccaucgcgguaaacggcuucagccagaaaagaggagaacgucaagaagaagcccaccgugaaaaacaacggcgaggcauaagugacauaggccgcaagaaaccaguccaagcagaggucgacgccgccaacgaacugcaccgcaaauacacagacgucgcuacaagacucggaugcaggauaguuguccaaugggcgccgcaaccaaaaccggggaccgccccaaccgcacaaacaguauacgcgcgagccguccgcacagaagcgccacgcucaggcaaccaagaagaccacgcuaggaugaaauccuccuggggcuacaccuggucaaccuacugggagaaaagaaaaccggaagauauacugggaauauccacacagguuuacuggacagggggaauaggagaaagcugccccgccguagccguagcauuacucggacauauccgagcgaccuccacucagacagaaugggaaaaagaagaaguggucuucggccgacucaaaaaguucuuccccuccuaa

SEQ ID NO: 11835 - RNA, 3633 nt, Artificial Sequence
  CasY variant__Candidatus Parcubacteria bacterium__APG80656.1__CasY
augagcaagagacacccccggaucuccggcgugaaagguuaccgccugcacgcccagcggcuugaauacaccggcaagagcggggccaugcgcaccaucaaauacccucuguacuccagcccaagcggcgggcggacggucccccgcgagaucgugagcgccaucaacgacgacuacgugggccuguauggccucuccaacuucgacgaccuguacaacgcagagaagcggaacgaggagaaggucuacagcgugcuggauuucugguacgacugcgugcaguacggggccgucuucuccuacaccgcccccggccuccugaagaacguggccgaggugcgcgggggcagcuacgaacugaccaagacacuuaaagggucccaccuguacgacgagcugcaaaucgacaaggugaucaaguuccugaauaagaaggagaucagccgggcuaacggcucccuggauaaacugaagaaggacaucaucgacugcuucaaggccgaguaccgcgagcggcacaaggaccagugcaacaagcucgccgacgacaucaagaacgccaagaaagacgcgggcgcgagccugggggagcgccagaaaaagcuguuccgggacuucuucgggaucuccgagcaguccgagaacgacaagccguccuucacgaauccccucaaccugaccugcugccugcucccguucgacaccgugaacaauaaccggaaccgcggggagguguuguucaacaagcugaaggaguacgcccagaagcucgauaagaacgagggcagccuggaaaugugggaguauaucggcaucggcaacuccgggaccgccuucuccaacuuucugggggagggcuuccucgggcggcugcgggagaacaagaucacggagcugaaaaaggccaugauggacaucaccgacgccuggcgcggccaggagcaggaggaggagcucgagaagaggcugcgcauccuggccgcccucaccaucaagcugcgggagccaaaguucgacaaccacuggggcggguaccgcagcgacauaaacggcaagcuguccagcugguugcagaauuacaucaaccagaccgucaagaucaaggaggaccugaaggggcacaagaaggaccugaagaaggccaaggagaugaucaaccgcuucggcgaguccgacacgaaggaggaggcgguggugagcucgcuccuugagagcaucgagaagaucgucccggaugacuccgcggacgacgagaagcccgacauccccgccaucgccauauaccggcgcuuccugagcgacgggcggcuuacccugaaccgcuucgugcaacgagaggacgugcaggaggcccugaucaaggagcgccucgaggccgagaagaagaagaagcccaagaaacgaaagaagaaguccgacgccgaggacgagaaggagaccaucgacuucaaggagcuguucccgcaccuggcgaagccccucaagcugguccccaacuucuacggcgacagcaaacgugaacuguacaagaaguacaagaacgccgccaucuacaccgacgcccuguggaaggcgguagagaagaucuacaaguccgccuucagcuccagccucaagaacuccuucuucgacacggacuucgacaaggacuucuucaucaaacggcugcagaagaucuucagcguguaccgccgguucaacaccgacaaguggaagcccaucgucaagaacuccuucgcaccguacugcgacaucgugagccuggccgaaaaugaggugcucuacaaacccaagcagucccgcagccgcaagagcgcggccaucgacaagaaccggguccggcugcccuccaccgagaacaucgccaaggccggaaucgcccuggcgagggaacucagcguggccggcuucgacuggaaggaccugcugaagaaggaggagcacgaggaguacauagaccuaaucgaacuccacaagaccgcccuggcccuccugcuggccgucacggaaacucagcucgacaucuccgcgcuagacuucguggagaacggcacagugaaggacuucaugaagacccgggacgggaaucugguccucgagggccgcuuucuggagauguucagccaguccaucguguucagcgaacugcgagggcucgccggccugaugucccgcaaggaguucaucacgcgcagcgccauccagaccaugaacggcaagcaggcggagcugcucuacaucccccacgaguuccaguccgccaagaucaccaccccgaaggaaaugucgcgggcguuccuggaccuggcccccgccgaguucgccacuucccucgagcccgagagccugagugagaagucccuccucaagcugaagcagaugcgcuacuacccccacuacuuuggguacgagcugaccagaaccggccaggggaucgacggcggcguggcugaaaacgcccuccgccuggagaaguccccggucaagaagcgggagaucaagugcaagcaguacaagacccuggggcgcggccagaacaagaucgugcucuacgugcggagcagcuacuaccagacucaguuccuggagugguuccugcacagacccaagaacguccagaccgacguggccgugagcgggagcuuccucauagacgagaagaaggucaagacccgguggaacuacgacgcccugaccguggccuuggagcccgugucuggcucagagcgcgucuucgugucccagcccuucacgaucuucccugaaaagagcgcugaggaggaggggcagcgguaucucggcaucgacaucggcgaguacgggaucgccuacaccgcccuggagaucaccggcgacagcgccaagaucuuggaccagaacuucaucagcgacccccagcucaagaccuugcgggaggaggugaaagggcugaagcucgaccagcggcgcggcaccuucgccaugcccuccacgaagaucgcgcggauccgcgagagccugguccacuccuugcggaaccgcauccaccaccuugcccugaagcacaaggccaagaucguguacgagcuggaggugucacgguucgaggagggaaagcagaagaucaagaaggucuacgccaccuuaaagaaggccgacguguacuccgagaucgacgcggauaaaaaucugcagaccaccguguggggcaagcucgccgucgccagcgagaucuccgccagcuacacgucccaguucugcggugcgugcaagaagcucuggcgcgccgagaugcaggucgacgagaccaucaccacccaggagcugauugggacggugcgggugaucaagggcgggacccugaucgacgccaucaaggacuucaugcgcccgcccauauuugacgagaacgacaccccuuuucccaaguaccgcgacuucugcgacaagcaccacaucagcaagaagaugcggggcaacuccugccucuucauaugcccauucugccgcgccaacgccgacgcggacauccaggccagccaaaccaucgcccugcugcgguacgugaaggaggagaagaagguggaggauuacuucgagcgcuuccggaagcucaagaacaucaagguucugggacagaugaaaaagaucuga

SEQ ID NO: 11836 - RNA, 3681 nt, Artificial Sequence
  CasY variant__Candidatus Vogelbacteria bacterium__OJI07455.1__CasY
augcagaaggugcgcaagacccugagcgagguccacaagaaccccuacggcaccaaggugcggaacgccaagacgggguacucccuccagaucgagcgccugagcuacaccggaaaggaggggaugcgguccuucaagaucccgcuggagaacaagaacaaggagguguucgacgaguucgucaaaaagauccgcaacgacuacaucagccaggugggacucuugaaccuguccgacugguacgagcacuaccaggagaagcaggagcacuacagccucgccgacuucuggcuggacucccugcgggcgggggugaucuucgcccacaaggagaccgagaucaagaaccucaucagcaagauccgcggcgacaagucuaucgucgacaaguucaacgccagcaucaagaagaagcacgccgaucuguaugcccugguggacaucaaggcgcucuacgacuuccugaccuccgacgcccggcggggccugaagacggaggaagaguucuucaacagcaagcggaacacccucuuccccaaguuccgcaaaaaggacaacaaggccguggaccugugggucaagaaguucaucgggcuggacaacaaggacaagcucaacuucaccaagaaguucaucggcuucgaccccaauccccagaucaaauacgaccacaccuuuuucuuccaccaggacaucaacuucgaccuggagcggauaacgaccccgaaggagcugaucuccaccuacaagaaguuccucgggaaaaacaaggaccuguacggcagcgacgagaccacggaggaccagcugaagauggugcucggguuccacaacaaccacggcgccuucuccaaguacuucaacgcgagccuggaggccuuccgaggcagagacaacucccugguggagcagaucaucaacaacagccccuacuggaacucccaccgcaaggaacucgagaagcggaucaucuuccugcagguccagagcaagaagaucaaggagaccgagcuggggaagccccacgaguaccucgccagcuucggcgggaaguucgaguccugggugagcaauuaccugcgccaggaggaggaggugaagcggcagcuguucggcuacgaggagaacaagaagggccagaagaaguucaucgucgggaacaagcaggagcucgacaagauuauccgcggcacggacgaguacgagaucaaagccaucuccaaggagaccaucgggcugacgcagaagugccugaagcuccuggagcagcugaaggacagcguggacgacuacacucucucccuguaccggcagcugaucguggagcuccgcauccggcugaacgucgaguuccaggagaccuaccccgagcugaucggcaagagcgagaaggacaaggagaaggacgccaagaacaagcgcgcggacaagcgcuacccgcagaucuucaaggacauuaagcucauccccaacuuccugggggagaccaagcagaugguguacaagaaguucauccgguccgccgacauccuguacgaaggcaucaacuucaucgaccagaucgacaagcagauaacgcagaaccuccugcccugcuucaagaacgacaaggagcgcaucgaguucaccgagaagcaguucgagacccugcggcgcaaguacuaucugaugaacagcucccgguuccaccacgugaucgaaggcaucaucaacaaccgcaagcucaucgagaugaagaagcgggagaacagcgagcugaagaccuuuuccgacuccaaauucguacuguccaagcuguuccugaagaaggggaagaaguacgaaaacgagguguacuacacuuucuacaucaaccccaaggcccgcgaccagcggcgcaucaagaucgugcuggacaucaacgggaacaacagcgucgggauccuccaggaccuggugcagaagcugaagccaaagugggacgacaucaucaagaagaacgauaugggcgagcucaucgacgccaucgagaucgagaagguccggcugggcauccugaucgcccucuacugcgagcacaaguucaagaucaagaaggagcugcugucccucgaccuguucgcgagcgccuaccaguaccuggagcucgaggacgaccccgaggaacuguccggcaccaaccuuggccgcuuccuccagagccuggugugcuccgagaucaagggggccaucaacaagauaagccggaccgaguacaucgagcgcuacaccgugcagcccaugaacacggagaagaacuacccccugcucaucaacaaggagggcaaggccaccuggcacaucgccgcgaaggacgaccugaguaagaaaaagggcggcgggaccgucgccaugaaccagaagaucgggaagaacuucuucggcaagcaggacuauaagaccguguucaugcugcaggacaagcgguucgaccuccugacguccaaguaccaccuccaguuccucagcaagacccuggacaccgggggcggguccugguggaagaacaagaacaucgaccugaaccucagcuccuacagcuucaucuucgaacagaaggugaaggucgagugggaccugaccaaccuggaccacccgaucaagaucaagcccuccgagaacagcgacgaccgccgccucuucguguccauccccuucgugaucaagcccaagcagacgaagcggaaggaccugcagacccgggucaacuacaugggcaucgacaucggcgaguacgggcuggccuggaccaucaucaacaucgaucucaagaacaagaagaucaacaagaucagcaagcagggcuucaucuacgagccgcugacccacaaggugcgcgacuacguggccaccaucaaggacaaccagguccgcgggacguucggcaugcccgacaccaagcuggcccggcuccgcgagaacgcgaucaccucccugcggaaccaggugcacgacaucgccaugcgguacgacgccaagcccguguacgaguucgagaucagcaacuucgagaccgggucgaacaaggucaaggugaucuacgacagcgugaagcgggccgacaucggccgcggccagaacaacacggaggcggacaacaccgaagucaaccuggugugggggaaaacuuccaagcaguucggcagccagaucggggccuaugccaccuccuacaucugcagcuucugcggcuacagcccuuauuacgaguucgagaacuccaagagcggggacgaggagggcgcccgggacaaccucuaccagaugaagaagcugucccgcccgagccuggaggacuuccuccagggaaaccccguguacaagacguuccgggacuucgauaaguacaagaaugaccagcgccugcaaaagaccggggacaaggacggcgaguggaagacccaccgggggaacaccgccaucuacgcgugccagaagugccgccacaucuccgacgccgacauacaggccagcuacuggaucgcccugaagcagguugugcgggacuucuauaaggacaaggagauggacggcgaccucauccagggggacaacaaggacaagcgcaaggugaacgaguuaaaccggcugaucggcguccacaaggacgugcccaucauuaacaagaaccucaucacauccuuggacauuaaccugcucuga

SEQ ID NO: 11837 - RNA, 3603 nt, Artificial Sequence; identical to SEQ ID NO: 11247
  CasY variant__Candidatus Vogelbacteria bacterium__OJI09436.1__CasY

SEQ ID NO: 11838 - RNA, 3462 nt, Artificial Sequence; identical to SEQ ID NO: 11248
  CasY variant__Candidatus Vogelbacteria bacterium__PIP58309.1__CasY

SEQ ID NO: 11839 - RNA, 3480 nt, Artificial Sequence
  Cas13a variant__Leptotrichia buccalis__WP_015770004.1__Cas13a
augaaaguaaccaaaguuggaggaauaucgcauaaaaaauacaccagcgaagggagacuaguaaagucagagagugaagaaaacagaaccgacgaaagauuaagcgcucuacuaaauaugagacuagacauguacaucaaaaauccaagcucaacagaaacaaaagaaaaccaaaaacgcauaggcaaauuaaaaaaauucuucucaaauaaaaugguguaccuaaaagacaacaccuuaagcuuaaaaaauggaaaaaaagaaaacauugaucgcgaauauucagaaacagacauacuagaaagcgacguaagagacaaaaaaaauuucgccgugcuaaaaaaaaucuaccuaaaugagaauguuaacucugaagaacucgaaguauucagaaaugacauuaaaaaaaaacuaaacaaaauuaacucccuaaaauauaguuucgaaaaaaacaaggcaaacuaccaaaagauaaacgagaacaacauagaaaaaguagaaggaaaaagcaaaagaaauauaauauacgauuauuaccgggaaagcgcaaaaagggacgcauauguaucgaaugugaaagaagcuuucgacaaacuauacaaagaggaagacauagcaaaacuuguacuggaaauagaaaauuugacaaaacucgaaaaauauaaaauccgagaguucuaucaugaaaucauaggaaggaaaaaugacaaagaaaacuucgcaaaaauuauuuacgaagaaauccaaaacgucaacaauaugaaagaacuaauagaaaaagucccagauaugagcgaauuaaagaaaucccaaguuuucuauaaauacuaccuagacaaagaggaacucaacgacaaaaacaucaaauaugcauucugccacuuugucgaaaucgaaaugagccaacuccuaaaaaacuacguauacaaacgacuaagcaauauuucaaacgacaaaaucaaaagaauauuugaguaccaaaaucuaaaaaaauugauagagaacaaauuacuuaauaaacuagauacauauguacguaacuguggaaaauacaacuauuaccugcaggacggagaaauagcaacuucugauuuuauagcacgcaacagacaaaaugaagcauuccuacgaaauauaauuggagugagcucaguagccuacuucucccuaagaaauauacucgaaacugaaaacgagaacgacauaaccggccgcaugcgcggaaagacaguuaaaaacaacaaaggagaggaaaaauauguguccggcgaaguagacaaaaucuacaacgaaaacaaaaaaaacgaagugaaagaaaacuuaaaaauguucuacagcuacgauuucaacauggacaacaagaacgaaauagaagacuucuucgcaaacauagaugaagcaaucucaagcaucagacauggaauuguucacuucaaccucgaauuagaaggaaaagauauauucgccuucaaaaacauagcaccaagcgagauuucaaaaaaaauguuccaaaacgaaauaaaugaaaaaaaacuaaaacuaaaaauauuccgccaacuaaacucagcuaacguauucagauaccuagaaaaauacaagauuuuaaacuaccuaaaaagaacacgcuuugaguucguuaauaagaacauaccauucguaccaagcuucacaaaacuauacucccgaauagaugaucuaaaaaacagccuuggaauauacuggaaaacucccaaaaccaacgacgacaauaaaacaaaagaaauaauagacgcacaaaucuaccugcuaaaaaauauauacuauggagaguuccuaaacuauuucaugagcaacaauggcaauuuuuuugaaaucucaaaggaaauaauagaacuaaacaaaaacgacaaacgaaaccuuaaaacaggauucuacaaauuacaaaaauuugaagacauacaagaaaaaauuccaaaggaguaccuagccaacauacaaucacuauacaugauuaacgcagguaaccaagacgaagaagaaaaagacacauacaucgauuuuauacagaaaaucuucuuaaaaggauuuaugacauauuuggccaacaacggcagacucucccuaauuuacauaggaucugacgaagagacaaauacaucccuagcagaaaaaaaacaggaauucgacaaauuccuaaaaaaauacgagcaaaauaacaacaucaaaaucccguacgaaauaaacgaauuccuaagagaaauaaaguuaggaaauauccuaaaguauacagaaagacuaaacauguuuuauuuaauauuaaagcuacuuaaucacaaagaacuaacuaauuuaaaagggagccuagaaaaguaucagagcgcgaauaaagaagaagccuucucagaccaacuugaacuaauaaaucuacuaaaucuggacaauaaucguguaacagaagacuucgaauuagaggcugaugaaauaggaaaauuucuagauuuuaacggcaacaagguaaaagauaacaaagaauuaaaaaaauuugacacuaauaaaaucuacuucgacggagaaaacauuaucaaacaucgcgcauucuauaauaucaagaaguauggaauguuaaaccuacuagaaaaaauagcagauaaggcaggcuauaaaauuuccauagaagaacuuaaaaaauauagcaauaaaaaaaacgaaaucgaaaaaaaucauaaaaugcaagaaaauuugcaccguaaauaugcacggccgcgaaaagacgaaaaguuuacugacgaagacuacgaauccuacaaacaagccauagagaauauagaagaauacacacaucuaaaaaauaaaguugaguuuaacgaacucaaccuccuacaaggacuacuccuaagaaucuuacaccgauuaguagguuauaccucaauaugggaaagagaucuaagauucagguuaaaaggagaauucccagaaaaucaguacaucgaagaaauauucaacuucgaaaacaaaaaaaaugucaaauauaaagggggacaaauaguagaaaaauacauaaaauuuuauaaagaacuacaccaaaacgaugaagucaagauaaauaaauacucuucagcaaacauuaaaguucucaaacaagagaaaaaagaccuuuacauccgaaacuacauugcacacuuuaacuacauaccacacgcagaaauaagccuacuagaaguccuagaaaaccugaggaaacuauuauccuaugacaggaaauuaaaaaacgcaguuaugaagucagugguagacauacucaaagaauacggauucgucgcgacauuuaagauaggagcagacaaaaaaauaggaauacaaaccuuagaaucugaaaaaaucguacaccuaaagaaccuaaaaaaaaaaaaauuaaugacagacagaaacucagaagaacuaugcaaacuagucaaaauaauguuugaauauaaaauggaagaaaaaaaaagcgagaacuaa

SEQ ID NO: 11840 - RNA, 3480 nt, Artificial Sequence
  Cas13a variant__Leptotrichia buccalis__WP_015770004.1__Cas13a(R472A,H477A)
augaaagucacaaaagugggcgggauaucccacaaaaaauauacaagcgaaggacgacucgucaaaagcgaaucagaagaaaacagaaccgacgaaagacuaucugcacuccucaacaugagauuagauauguauauaaaaaaucccuccucaaccgagacaaaagaaaaccaaaaacgaauaggcaaacuaaaaaaauucuuuucaaacaaaauggucuaucucaaagacaauacacuaagccuaaaaaacggaaaaaaagagaacauagaccgagaauacagugaaacggauauacuagaaagcgacguccgagauaaaaaaaauuucgcaguauuaaaaaaaaucuacuuaaaugaaaacgucaacucagaagaacuagaagucuucagaaacgauaucaaaaaaaaacuaaacaaaauaaacucucuuaaauauucauucgaaaaaaacaaagccaauuaucaaaaaauaaacgaaaauaauauagaaaaaguugaaggaaaaagcaagcgaaacaucauauacgacuacuacagggagucagcaaaacgagaugccuaugucuccaauguaaaagaagccuucgacaaacuuuacaaagaagaagacaucgcaaaguuaguacucgaaauugaaaaccuaacaaaauuagaaaaauacaaaauacgagaguucuaccaugagauaauaggccgaaaaaacgacaaagaaaauuucgcaaaaauaauauaugaagaaauucaaaauguaaacaacaugaaagaauuaaucgaaaaagucccggacaugucagaacuaaaaaaaagucaaguauucuauaaauacuaucucgacaaagaggagcuaaaugacaaaaacauaaaguacgcauucugccacuucgucgaaauugaaaugagucaacuacuaaaaaacuauguauacaaaagauuaucaaauauaagcaaugacaaaauaaaacgaauuuucgaauaccaaaaucuaaaaaaacucauagaaaauaaacuacuaaacaaauuggauacauacguacgcaauugcggaaaauauaauuacuauuuacaggacggcgaaauagccacaucagacuuuauagcaagaaauagacaaaaugaagcuuuccuacgaaauauuauaggagugaguucaguugcauacuuuagcuuaaggaacaucuuagaaacggaaaaugaaaacgacauaacaggaagaaugcgaggaaaaacaguuaaaaauaacaaaggugaagaaaaguacgucagcggagaaguagauaagauauacaacgaaaauaaaaaaaaugaaguuaaagaaaaccucaaaauguucuacagcuacgacuuuaacauggacaauaaaaacgaaauagaagacuuuuuugcaaacauagacgaagcaaucucaucgaucgcgcauggcaucguagccuuuaacuuagaacuagaagggaaagacauauucgccuucaaaaacaucgcacccagcgaaauaucaaaaaaaauguuccaaaacgaaauaaacgaaaaaaaauuaaagcuaaaaaucuucagacaguuaaacucagcaaacguauuuagauaccuagaaaaauauaaaauccuaaauuauuugaaaaggacacguuucgaauuuguaaacaaaaacauacccuucguuccuucauucacaaagcuuuauagccgaauagacgauuuaaagaacucacuagggauuuauuggaagacgccaaaaacgaacgaugacaacaaaaccaaggaaauaauagacgcacaaauauauuuauuaaaaaacauauauuauggagaauuccuaaauuacuuuauguccaauaacggaaauuucuuugaaauaagcaaagaaauaauagaacuaaacaaaaacgauaaaagaaauuuaaaaacaggauuuuacaaacuccaaaaauuugaagacauucaagaaaaaauacccaaagaauacuuagcaaacauacaaagucuauauaugauaaaugccgguaaccaagacgaggaagaaaaagacacauacaucgauuucauacaaaaaaucuuccucaagggcuuuaugacauaccuugcgaauaauggacguuugucgcucauuuauauaggaucggacgaggaaaccaacacaucacuugcagaaaaaaaacaagaauucgauaaauuucuaaagaaauacgaacaaaauaauaacauaaaaauaccauaugaaauaaaugaauuuuugagagaaauaaaauuaggaaacauucucaaauauaccgagaggcuaaauauguuuuaccuaauacucaaacuguuaaaucauaaagaacuaacaaauuuaaaaggaagcuuggaaaaauaucaauccgcaaacaaagaagaggcauucagcgaccaauuagaauuaauuaaccuccuaaaccucgauaauaacagagucacagaagauuucgaacuugaagcagacgaaauaggaaaauucuuagacuucaacggaaacaaaguaaaggacaacaaagaauuaaaaaaauuugacacuaauaaaaucuacuucgacggagaaaacauaauaaaacauagggccuuuuacaacauaaaaaaauauggcaugcuaaaucuuuuagaaaaaauagcugacaaagccggauacaaaauaucuauagaagaacuaaaaaaauauuccaauaaaaagaaugaaauugagaaaaaccacaagaugcaagaaaaccuacacaggaaauacgcaagaccaagaaaagacgagaaguuuacagacgaagauuaugaaaguuacaaacaggcaauagaaaauauagaagaauacacacaucuaaaaaacaaaguugaauucaacgaacuaaaccucuuacaagguuugcuacucagaauauuacacagacuagugggcuacacgaguauaugggaacgcgaccuaagguucagacuaaaaggagaguuccccgagaaucaauacaucgaagaaauauucaacuucgaaaauaaaaaaaauguaaaguacaaaggagggcaaauaguagaaaaauacauaaaauucuauaaagaacuacaccaaaacgacgaagucaaaauaaacaaauauagcucagcaaacauaaaaguauuaaaacaagaaaaaaaggauuuauauauaagaaacuauauagcacacuucaacuauauaccacaugcagaaaucaguuuacuagaaguacuagagaaccugagaaagcugcuaucauaugacagaaaauuaaaaaaugcaguaaugaagagcguagucgauauucuaaaagaauacggauuuguugcaacuuuuaaaauaggagcagacaaaaaaauaggcauccaaacauuagaaucggaaaaaauaguucacuuaaagaacuuaaaaaaaaaaaagcuaaugacggacagaaauagugaggaacuaugcaaacuuguaaaaauuauguuugaguauaaaauggaggaaaaaaaaucugaaaauuaa

SEQ ID NO: 11841 - RNA, 3480 nt, Artificial Sequence
  Cas13a variant__Leptotrichia buccalis__WP_015770004.1__Cas13a(R1048A,H1053A)
augaaagucaccaaaguaggaggaaucagccacaaaaaauacaccucagaagggagacuaguaaaaagugaaucagaagaaaaccgaacagacgaaagacugagcgcgcuucuaaacaugagacucgacauguacaucaaaaauccaucgagcaccgaaacuaaagaaaaccaaaaaagaauaggcaaacugaaaaaauucuucagcaacaaaauggucuaucuaaaagacaacacacucucucucaaaaacggcaaaaaagaaaauauagaccgagaauacagcgagacagacauauuagagagcgacguaagggacaaaaaaaacuucgcaguucuuaaaaaaauauauuugaacgaaaauguaaauucagaagaauuagaagucuucagaaacgacaucaagaaaaaauuaaacaaaauaaacagucuaaaauacuccuucgaaaaaaauaaagcaaauuaucaaaaaauaaacgaaaauaauaucgaaaaaguagaaggaaaaucaaaaagaaauauaauauacgauuacuaccgagaaucagcaaaaagagaugcauauguaagcaacgucaaagaagcuuuugacaaauuauacaaagaagaggacauugcuaaacuaguacuugaaauagaaaacuuaacaaaacuagaaaaauacaaaauacgagaauucuaccacgaaaucauaggacgaaaaaacgacaaagaaaauuuugcaaaaaucauauacgaagaaauucaaaauguaaauaacaugaaagaacuaaucgaaaaagucccagauaugucggaauuaaaaaaaagccaaguauuuuauaaguacuaccuagacaaagaagaacucaacgacaaaaauauaaaauacgccuuuugccauuucgucgaaauugaaaugucacaacuauuaaaaaacuaugucuauaaaagauuaagcaacauauccaacgacaaaauaaaacgaauauucgaauaucaaaaucuaaaaaaacugauugaaaacaaacuacuaaauaaauuggauacauaugucaggaacugugguaaauacaauuauuaucuccaagacggagaaauagcaacuuccgauuuuaucgcaagaaaucggcaaaaugaggccuuucuccgaaacauaauuggcguaagcucaguagccuauuucucacugagaaacauauuagaaaccgaaaaugaaaacgauauaacaggacgaaugcgaggcaaaacaguuaaaaacaacaaaggagaagaaaaauaugugagcggagaagucgacaaaaucuauaacgaaaacaagaaaaaugaggugaaagaaaaccuuaagauguucuacagcuacgacuuuaacauggauaacaaaaacgaaauagaagauuuuuucgcuaacauugacgaagcaauauccucuauacgacauggaauuguacauuuuaaccucgaacuugaaggaaaagacauauuugcauuuaaaaacauagccccgagugaaauaaguaaaaaaauguuucagaaugaaauaaacgaaaaaaaacuaaaacuaaaaauauuucgccaauuaaacagcgcuaacguauucagguaucuagaaaaauacaagauacuaaacuaccucaaacggacccgauucgaauucgucaacaaaaacauacccuucguccccucauuuacaaaacucuacucgaggauagacgauuuaaagaacucccuaggaauauacuggaaaacacccaaaacaaaugacgacaacaaaacaaaagaaaucauagaugcacaaauauaucuacuuaaaaacaucuauuacggggaauuccuaaacuacuuuaugucuaauaacggaaacuucuucgaaauaucgaaagaaauaauagaguugaacaaaaacgacaaaagaaaucuaaaaacugguuuuuacaaacuacagaaauucgaagacauacaagaaaaaaucccgaaagaguaccuagcuaauauucagucacuauacaugauuaacgcaggaaaccaagaugaagaagaaaaagacacauacauugacuuuauccaaaaaauauuccuaaaagguuucaugacauaccuagccaauaauggucgauuaagucuaauuuacauaggcagcgaugaagaaacaaauacuucgcuugccgaaaaaaaacaagaauucgacaaauuccuaaaaaaauaugaacaaaacaacaacauaaaaauucccuaugaaaucaacgaauuccuucgagaaauaaaacuuggcaacauccugaaauacacugaacgauuaaacauguucuaucuaauucuaaagcuacugaaccauaaagaacuaacaaaccugaaaggcucacuugaaaaauaccaaucagccaauaaagaggaggccuuuucagaccaauuagaauugauaaaucuacuaaaucucgacaauaaucgaguaacagaagauuucgaacuagaagcagacgaaauaggcaaauucuuagacuuuaaugggaauaaaguaaaagauaacaaagaacuaaaaaaauucgauacaaauaaaauuuauuucgauggugaaaacauaaucaaacacagagcauucuacaacauuaaaaaauacggcaugcuaaaccuucuagaaaaaauagcagauaaagcaggauacaaaauaucuauagaagaacuuaaaaaauacagcaauaagaaaaaugagaucgaaaaaaaucacaaaaugcaagaaaaccuacaccgaaaauaugcacgaccacgaaaagacgaaaaauucacugacgaagacuacgaaagcuauaagcaggcgauagaaaacauagaggaauacacacauuuaaaaaacaaaguagaauucaaugaauuaaauuuauuacaaggacuauuauugcgaauacuacauagacucguaggauauacaucaauaugggaaagagaucuuagauuuagacuaaaaggagaguucccagaaaaccaguauauagaagaaauauuuaacuucgaaaacaaaaaaaaugucaaauacaaaggaggacaaauaguugaaaaauauauaaaauucuauaaagaauuacaucaaaacgaugaaguaaaaauaaauaaauacagcuccgccaauauaaaaguauugaaacaagaaaaaaaagacuuauacauagccaacuauauagccgcauucaacuacauaccacaugcagaaaucucacuacuagaaguccucgaaaaccuuagaaaacuccuaagcuacgaccgcaaguuaaaaaaugccguuaugaaaagugugguagauauacuaaaagaauacggauucguagccaccuuuaagauaggagcagacaaaaaaaucggcauucaaacauuggaauccgagaaaaucguccacuugaaaaauuuaaaaaaaaaaaaauuaaugaccgauagaaauucugaagaauuaugcaaacucguaaaaaucauguuugaauacaagauggaagaaaaaaaaucggaaaacuaa

SEQ ID NO: 11842 - RNA, 3480 nt, Artificial Sequence
  Cas13a variant__Leptotrichia buccalis__WP_015770004.1__Cas13a(R472A,H477A,R1048A,H1053A)
augaaaguaaccaaaguuggagguauaagccauaaaaaauauacgucagaaggaagguuaguuaaaucugaauccgaagaaaauagaacugacgaaagacuaagugcccucuuaaacaugcggcuagacauguauauaaaaaaccccucguccacagaaacaaaagagaaccaaaagcgaauaggaaaacuaaaaaaauucuucagcaauaagauggucuaucucaaagacaacacccuaucacuaaaaaauggaaaaaaagaaaauauagacagagaauacucggaaacggacauauuagaaagugacguaagggacaaaaaaaauuuugcgguccuaaaaaaaauauaccuaaaugaaaauguaaauucagaagaauuagaagucuuuagaaacgauaucaaaaaaaaauuaaacaaaauaaacucacuaaaauacagcuuugagaaaaauaaagcaaauuaucaaaagauaaacgaaaacaacaucgaaaaaguagaggggaaaucaaaaaggaauauaauuuaugacuacuacagagaaagugcuaaaagagacgcuuaugugucaaauguaaaagaagccuucgauaaacuauacaaagaagaagacauagcaaaacuaguucuagaaauugaaaaccuuacaaaauuagagaaauacaaaaucagagaauucuaccacgaaauaauugggagaaaaaacgauaaagaaaauuucgccaaaaucaucuacgaagagauccaaaaugucaauaacaugaaagaacuuauagaaaaaguaccagacaugagcgaauuaaaaaaaucacaaguauucuacaaauauuaccuagauaaagaagaacuaaacgauaaaaauauaaaauaugcguucugccauuuuguagaaaucgaaaugagucagcuauugaaaaauuauguauacaaaagacucagcaauauaagcaaugacaaaaucaaaagaauauucgaauaucagaaucuaaaaaaacuaauagaaaacaaacuacuaaauaaacuagauacauaugucagaaacuguggcaaauacaacuauuaucuacaagauggagaaaucgcaacaagcgacuuuauagccagaaaucgacaaaacgaagcuuuccuacguaacauaauaggagucucaagcguggcguacuucucccuacgaaauauacuugaaacagaaaaugaaaacgacauuaccgguagaaugagaggaaaaacaguaaaaaacaacaaaggagaagaaaaauacguaucuggugaaguagacaaaauauacaacgaaaacaaaaaaaacgaaguuaaagagaaucuuaaaauguucuacagcuacgacuucaacauggacaacaaaaacgaaaucgaagacuucuuugcaaacauagacgaggcaauuaguaguauagcccacggcauaguagcauucaaucuagagcuggaaggcaaagacauauucgcauucaaaaacauagcaccaucggaaauuucaaaaaaaauguuccagaaugaaaucaaugaaaaaaagcuaaaauuaaaaauuuuccgacaacucaacagcgcaaacguuuuuagauaccuugaaaaauacaagauacugaauuaccucaaacgaacacgauucgaauucguaaauaaaaacauaccauucgucccuagcuucacaaaacuauauagucgaaucgaugaucugaagaauagccucggaauauauuggaaaacaccaaaaacgaacgaugacaacaaaacaaaagaaauuauagaugcacaaauauaccuacuaaaaaauauauauuauggugaauucuugaauuacuucaugucaaauaacggaaauuucuucgaaauaucaaaagaaauaaucgaauugaacaaaaacgacaaacguaaccuaaaaaccggauuuuacaaacuacaaaaauuugaggacauccaagaaaaaaucccaaaagaauaucucgcaaauauacaaucauuguauaugauuaacgcaggaaaucaagaugaagaggaaaaagacacauauauagacuucauacaaaagauuuuccuaaaaggauucaugaccuaccuagccaacaacggaagauuaagucuaauauacauagggagcgacgaagaaaccaacacaagccuagcagagaaaaaacaggaauuugauaaauuucuaaaaaaauacgaacaaaauaacaauauaaaaauaccauaugaaauaaaugaauuucuccgagaaauaaaacucggcaauauacuaaaauacaccgaacgucucaacauguuuuaucucauacuaaaauuacuaaaucacaaagagcuaacuaaucuaaaaggaucacuagaaaaauaucaaagcgcaaacaaagaagaagcauuuucggaucaacucgaauuaauaaacuuacuaaaccuagauaauaauagaguaacagaagauuucgaacuagaagccgacgagaucggaaaauuucuugacuuuaaugggaacaaaguuaaagauaauaaagaacuaaaaaaauucgacacuaacaaaauauacuucgauggugaaaacaucaucaaacaccgcgcuuuuuauaacauuaagaaauacggcaugcuuaaucucuuagaaaagauagcagauaaagcaggauacaaaauauccauagaagaauugaagaaauacuccaauaaaaaaaacgagaucgaaaaaaaccauaaaaugcaagaaaaucuccaccgaaaauacgcaagacccagaaaagaugaaaaguuuaccgaugaagauuaugagaguuacaaacaagccauugaaaacauugaagaauauacacaccuaaaaaauaaaguagaauucaaugagcucaaccuccuacaaggauuauuacucagaauucuucacagguugguaggauauacaucaauaugggagagagauuuaagauucagacucaaaggugaauucccagaaaaccaauacauugaagaaauauuuaauuucgaaaacaaaaaaaacgucaaauacaaaggaggccaaauaguagagaaguacauaaaauucuauaaagaacuacaccaaaacgaugagguaaagauaaacaaauauagcucagccaacauaaaaguuuuaaaacaagaaaaaaaagauuuauacauagcaaacuacauagcagccuucaauuacauaccgcaugcggaaauaagccuacuagaaguacucgaaaaccuacgaaaacuccucucauacgacagaaagcuaaaaaacgcaguuaugaaaucugucguagacaucuuaaaagaauauggauucgucgcuacauuuaaaauuggugcagacaaaaaaaucggaauacaaacauuagaauccgaaaaaauaguacaccuuaaaaaccucaaaaaaaaaaaacuaaugacugacagaaauagugaagaacuuugcaaacuuguaaaaauaauguucgaauacaaaauggaagaaaaaaaaucagaaaacuaa

SEQ ID NO: 11843 - RNA, 3480 nt, Artificial Sequence
  Cas13a variant__Leptotrichia buccalis__WP_015770004.1__Cas13a(R1079A)
augaaagucaccaaaguagguggcauaagucacaaaaaauacaccucugaaggacgucuaguuaaauccgaaucugaagagaacagaaccgacgagcgucucagugcucuauugaacaugcgccuagacauguauauuaaaaacccaucaagcaccgagaccaaagagaaccaaaaacggauaggaaaacuaaagaaguucuuuagcaacaaaaugguauacuugaaagauaacacacuaagucuuaaaaauggaaaaaaagaaaacauagauagagaauacucagaaacagauauucuagagucggacguaagagauaaaaaaaauuuugccguccucaaaaaaauauauuugaaugaaaacguaaauucagaagaacuagaaguuuucagaaacgacauaaaaaaaaaauuaaauaaaauaaauucacuuaaauacucauucgaaaaaaauaaagcaaacuaucaaaagaucaacgaaaacaauauagaaaaaguugaaggcaaaagcaaaaggaauauaauauaugacuauuaccgagaaucagccaaacgagaugcauauguuucaaaugucaaagaagccuuugacaaacuauacaaagaagaagauauugcaaaacuaguucuagaaauugagaacuuaaccaagcuagaaaaauauaaaauccgagaauucuaccaugaaaucaucggaagaaaaaacgauaaagaaaacuuugcaaaaauaaucuacgaagaaauccaaaacguuaacaauaugaaagagcucauugaaaaaguuccagauaugagugaauuaaaaaaaagucaaguauucuacaaauacuaccuggauaaggaggaacuaaacgacaaaaauauuaaguaugcauucugccauuuuguagaaauagaaaugucacaauuacuaaaaaauuacguauacaaaagacucagcaauaucuccaacgauaaaauaaaacgaauauucgaguaccaaaaccuuaaaaaacuuauagaaaacaaacucuuaaauaaauuagacacuuacgucagaaacugcggcaaguacaauuauuaccuacaagacggugaaaucgccaccucagacuucaucgcaagaaauaggcagaacgaggcuuucuuacgaaacauaauuggaguauccucaguagcauacuucucacucagaaauauacuagaaaccgaaaacgagaacgauaucaccggacguaugcgcggaaaaacugugaaaaacaauaaaggcgaggaaaaauacguuucaggcgaaguggacaaaauauauaacgagaacaaaaaaaaugaagucaaagaaaacuugaaaauguucuauucauacgacuuuaacauggauaacaaaaacgagauagaagacuucuucgcaaauauagacgaggccaucaguuccauccgucacggaauaguccauuucaaucuagaacuggaaggaaaagacauauucgcauucaaaaacauugcaccaucugaaauaucaaaaaagauguuucaaaaugaaaucaaugagaaaaaacuaaaauuaaaaaucuuuagacaacuaaacucggccaacguauucagguaccuagaaaaauacaaaauauugaacuaccuaaaacguacuagauucgaauuuguaaacaaaaauaucccauuuguaccaaguuucacaaaacuauacucacgcauugacgaucucaaaaacucacuaggcaucuacuggaaaacgccuaaaacaaacgacgacaauaaaaccaaagagauaauagacgcacaaauauacuuacuaaaaaacaucuacuacggagaguucuuaaauuacuucaugucuaacaauggaaacuucuucgaaauauccaaagaaauaaucgaauuaaauaaaaacgauaaaagaaaccucaaaaccggguuuuauaaacuccagaaauucgaagacauccaagaaaaaauccccaaagaauauuuggcaaacauacagucccucuacaugauaaaugcaggcaaucaagacgaggaagaaaaagacacuuauaucgacuucauccagaaaauauucuuaaaaggauucaugacauaucuagcuaacaacggaagacuaucauuaauauauauagggagcgacgaggaaaccaacacuagccucgccgaaaaaaaacaagaauucgauaaauuuuuaaaaaaauacgagcagaacaauaacauaaagauaccauacgaaauaaaugaauucuuaagagaaaucaaacuaggaaacauacuaaaauauacugaaagauuaaacauguucuaccuaauacugaaacuccuaaaccacaaagaacuaaccaaccuaaaaggaaguuuagagaaauaucaguccgcaaauaaagaagaggcauuuagcgaccaacuagaacuuaucaaucuauuaaaucuugacaacaauagaguaaccgaagacuucgaacucgaagcagacgaaauaggcaaauucuuagauuucaauggaaacaaaguaaaagauaacaaagagcuuaaaaaauuugauacuaacaaaauauacuucgacggagaaaacauaauaaaacaucgagcuuucuauaauauaaaaaaauauggaaugcucaauuuauuagaaaaaauugccgauaaagcaggauacaaaaucucaauagaagaacucaagaaguacuccaauaaaaaaaacgaaaucgaaaaaaaccauaagaugcaagaaaaucuacaccgaaaauacgcaagaccaagaaaagaugaaaaguucaccgaugaagacuacgaauccuacaaacaagcaaucgagaacauagaagaauacacgcacuuaaaaaacaagguagaauucaacgaacucaaucuauuacaaggacuauuacuaagaauccuacacagacuaguaggauacaccucuaucugggaacgcgaccuccgauuccgcuuaaaaggggaguuuccagaaaaucaauacaucgaagaaaucuucaacuucgaaaauaaaaaaaacguaaaauauaaaggaggacaaauagucgaaaaauacauaaaauucuacaaggaacuacaccaaaacgaugaaguaaaaaucaacaaauauaguagugccaacauaaaaguuuuaaaacaagaaaagaaggacuuauacauuaggaauuacauagcucauuucaacuacaucccacacgcagagaucagccuacuugaaguacuagaaaaccugagaaaacuacucagcuaugaugcaaaacuaaaaaacgcaguuaugaaaucaguaguugacauacuaaaggaauacggcuuuguagcaacuuucaaaaucggagcagacaagaaaauaggaauacaaacacuugaaagugaaaaaauugugcaccuuaaaaaccuuaaaaaaaaaaaacugaugacagacagaaauucggaagaacucugcaaacuagucaaaauaauguucgaauacaaaauggaggaaaaaaaauccgaaaacuga

SEQ ID NO: 11844 - RNA, 3480 nt, Artificial Sequence
  Cas13a variant__Leptotrichia buccalis__WP_015770004.1__Cas13a(E299A)
augaaaguaacuaaaguuggaggcauaucacauaaaaaauauacaucggaaggaagauuggucaagucggaaagcgaagaaaacagaacagacgaaagacucagcgcgcuacucaacaugcgccuggauauguauauaaaaaacccgucaucaaccgagacaaaagaaaaucaaaagagaauaggaaaauuaaaaaaauucuucucgaauaagauggucuaucuaaaagacaacacauuaagccuaaaaaacggaaaaaaagaaaacauagacagagaguacucagaaacagacauccuagaauccgacguaagagacaaaaaaaacuucgcaguucuaaaaaaaauauaccuuaaugaaaacgugaauagcgaagaauuagaaguuuucagaaacgacauaaaaaaaaaacuaaauaaaauaaacucacuuaaauacucauucgagaaaaauaaagcuaauuaucaaaaaaucaacgagaacaacauagaaaagguagaaggaaaauccaaacgaaacauaauauacgauuauuacagagaaagugcaaaaagagaugccuacguaucaaacgucaaggaagccuucgauaaacuauacaaggaagaagacauugcaaaacucguauuagaaauagaaaauuuaacaaaacuugaaaaguauaaaauccgcgaauucuaccacgaaauuauaggacgaaaaaaugacaaagaaaauuuugccaaaauaaucuacgaagagauucaaaacguaaacaauaugaaagaauugauagaaaaaguacccgauaugucagagcuuaaaaaaucacaaguuuuuuacaaguacuaccuagauaaagaagaauugaacgacaaaaauauuaaauacgcauuuugccacuucguagagauugcaaugagccaacuuuuaaaaaacuaugucuauaaaagacuuucaaacauaaguaacgacaaaauaaagcgaauauucgaauaucaaaaccuaaagaaacucaucgaaaacaaacuacuaaacaaacuagacacuuacguacgaaauuguggaaaauacaacuacuaccuacaagacggagaaauagcaaccagcgacuucauagccagaaacaggcaaaaugaagccuucuuacgcaauauaauaggcgucuccuccguggcauacuuuucacuacgcaacauacuagagaccgaaaaugaaaaugacaucacaggaagaaugagaggcaaaacaguaaaaaacaacaaaggagaggaaaaauaugucucuggcgagguagacaaaauauacaaugaaaauaaaaaaaacgaagugaaagaaaauuuaaaaauguucuacucauacgacuucaauauggacaauaaaaacgaaauagaagacuucuucgcaaacaucgaugaagcaauauccucuauaagacacggcauuguacacuucaacuuagaauuagaaggaaaagacauuuuugccuucaaaaacaucgccccaucagaaaucucaaaaaagauguuccaaaacgaaauaaacgaaaaaaaacucaaauuaaaaauuuucagacaacuaaacagcgcaaacgucuuuagguaccuagaaaaauacaaaauauuaaacuaccuaaaaagaacaagguucgaauucgugaauaaaaauauccccuucguaccaagcuucacaaaacuuuacucacggaucgacgacuuaaaaaacucauuaggaauauauuggaaaacaccaaaaacaaacgacgacaauaaaacaaaagaaaucauagacgcacaaaucuaucuauuaaaaaauaucuauuauggagaauuccuaaauuauuucaugucuaauaacggaaacuucuuugaaauaaguaaagagauaaucgaauuaaauaaaaaugacaaaagaaacuuaaaaacaggauucuacaaacuacaaaaauucgaagacauacaagaaaaaauaccaaaagaauaccucgccaacauccagucccuuuacaugauuaacgcuggcaaucaagaugaagaagaaaaggacaccuacauagauuuuauacaaaaaauauuuuuaaaaggcuuuaugacauaccuagcaaauaacggaagacuuucacuaauauacaucggaagugaugaagaaacgaauacaucacuagcagaaaagaaacaagaauuugauaaauuccuaaaaaaauacgaacaaaacaacaacauaaaaauaccguacgaaaucaacgaauuccucagagaaaucaagcuaggaaauauacuaaaauacaccgaacgacuuaacauguuuuaucuaaucuuaaaacuacuaaaccauaaagagcuaacaaaccuaaaaggcagucuugaaaaauaucaaucagcaaacaaagaagaagcauucagugaccaauuagaacuaaucaaucuacuaaacuuagauaacaauaggguaacggaagacuucgagcuugaagccgacgaaaucggaaaauuccuagacuuuaacggaaauaaagugaaagacaacaaagaacucaaaaaauucgacacaaauaaaaucuacuuugacggagaaaacauaauaaaacacagggcguucuacaacaucaaaaaguacggaaugcuaaaucuacuugaaaaaauagcggacaaagcaggauacaaaauaucaauugaagaauuaaaaaaauacucaaacaaaaaaaacgaaauagaaaaaaaccauaaaaugcaagaaaaucuccacagaaaauaugcaagaccaagaaaagacgagaaauucaccgaugaagauuacgaauccuacaaacaagcaauagaaaauauagaggaguacacccauuuaaaaaacaaaguagaauuuaacgaacuaaaccuccuccaaggccugcuauuacgcauccuccacagacuaguuggauauacgagcauuugggaaagagacuuaagauucagacuaaaaggggaauuuccagaaaaccaauacauagaagaaauauucaacuuugaaaauaaaaaaaacgucaaauacaaggggggccagaucguagaaaaauauauaaaauuuuacaaagaauuacaccaaaacgaugagguuaagaucaauaaauacucaucugccaauauuaaagugcuaaaacaagaaaaaaaagauuuauauauaagaaacuacaucgcucauuucaauuauauaccccaugcugaaauaaguuuacuagaaguacuugagaaccuaagaaaacuccuaucauaugauagaaaacuaaaaaacgcagugaugaaaagcguuguagacauauuaaaagaauacgguuucguagcaacauuuaaaauaggagcagauaaaaaaauaggaauacagacucuagaaagcgaaaaaaucguacacuugaaaaaccuaaaaaaaaaaaaacuaaugacugaccguaacucagaagaacuauguaaacugguaaaaauaauguucgaauacaaaauggaagagaaaaagucagaaaacuaa

SEQ ID NO: 11845 - RNA, 3480 nt, Artificial Sequence
  Cas13a variant__Leptotrichia buccalis__WP_015770004.1__Cas13a(K310A)
augaaagucacaaaaguuggaggaauaucacauaaaaaauauacaucagaaggcagacuuguaaaaucagaaucagaagaaaauagaacugacgaacgacuaagugcacuacuaaauaugagacuugauauguacauuaaaaaccccagcuccacagaaacaaaagaaaaccaaaaacgaauagguaaacuaaaaaaguuuuuuagcaacaaaaugguuuaucucaaggacaacacacuaucauuaaagaacgguaaaaaagaaaauauagaccgcgaauauucagaaacugauaucuuggaaagugacguuagagacaaaaaaaacuucgcaguacuaaaaaaaauauaccuaaacgaaaacguaaacucagaagaauuagaaguguucagaaacgacauaaaaaaaaaacuaaacaaaaucaacucccuaaaauacucauucgaaaaaaacaaagcaaauuaucaaaaaauaaaugaaaauaauaucgaaaaaguugaaggaaaauccaaaagaaacaucauauacgacuacuacagagaaucagccaaacgagacgcauauguuuccaacgucaaagaagcuuucgauaaacuauauaaagaagaagacauugcaaaacuaguuuuagaaauagagaacuuaacaaagcuagaaaaauauaaaaucagggaauucuaccacgaaauaaucggcagaaaaaacgacaaagaaaacuuugcaaagaucauauaugaagaaauacaaaacguaaacaacaugaaagaacuaaucgagaaagucccagauaugucggaacuaaaaaaaucucaaguauucuacaaauauuacuuagacaaagaagaauuaaacgacaaaaacauaaaguacgccuucugccacuucguagaaauagaaaugucccaacuucuaaaaaacuaugucuaugcccgacuauccaacauaucaaacgacaaaauaaaaagaaucuucgaauaccaaaaccuaaaaaaauugauagaaaauaaacuacuaaacaaacuggacaccuauguccgaaacugcgggaaauauaacuacuacuuacaagauggagaaauagcaacguccgauuucauagcgagaaacagacagaaugaagcauuccuaagaaauauuauaggaguuuccagcguagcguacuucagucuucgaaauauucuagaaacagaaaaugagaacgacauaacaggccgcaugcgaggaaaaacaguaaagaacaauaaaggagaagagaaauacguaagcggcgaaguggauaagauauacaacgaaaacaaaaaaaacgaaguaaaagaaaacuuaaaaauguucuacucauacgacuucaacauggauaauaaaaacgaaaucgaagacuucuucgccaacauagaugaagccauaagcaguauaaggcaugggaucguacauuucaaccuagaacuagaaggaaaagacauauucgcauucaaaaacauugcacccagugagauaucgaagaagauguuucaaaacgaaauaaacgaaaaaaaacucaaauuaaaaauauucagacaauuaaauuccgcaaacguauuuagguaccuugaaaaauacaagauucucaauuaucuaaaaagaacacgcuuugaauucgugaacaaaaauauaccauucguacccucauucacaaaacuauacaguagaaucgacgaucuaaaaaacagucuagguaucuauuggaaaacucccaaaacaaacgacgauaacaaaaccaaagaaauaauugacgcacaaaucuacuuacuaaaaaacauauauuacggcgaauuccuaaacuacuucaugucaaauaacggaaacuuuuuugaaauuucuaaggagaucauugaacuaaacaaaaacgacaaaagaaaccucaaaacaggauuuuacaagcuccaaaaauucgaggacauucaggaaaagaucccaaaagaauaccucgccaacauccaaagucuuuacaugauaaacgcaggcaaccaggacgaagaagaaaaagacacauacauagauuucauacaaaagaucuuucucaaaggauucaugacauaccuggccaacaacggaagacucagucuuauauauauagguagugacgaagaaaccaacacaagucucgcagaaaagaaacaagaauucgacaaguuccuaaaaaaauaugagcaaaacaacaauaucaaaauaccuuacgaaauuaaugaguuccuuagagaaauuaaacuaggcaauauuuuaaaauacacagagagauuaaacauguuuuaccugauacuaaaacuacuaaaccauaaagaacugacgaaccugaaaggcucauuagaaaaauaccaaagcgcuaacaaagaggaagcguuuagugaccaacuagaacuaaucaaucuacuaaacuuagacaauaacagaguaacggaagacuuugaauuagaagcagacgaaauagguaaauuccuagacuuuaacggaaauaaaguuaaagacaauaaggaacugaaaaaguuugacacgaacaaaauauacuucgauggcgaaaacauaaucaaacaccgagcauuuuauaacauaaaaaaauacggaauguuaaaccuacuagaaaaaauagcggacaaagcuggauacaaaauuucaaucgaagaacucaagaaauauucaaauaaaaaaaaugaaauugaaaaaaaucacaaaaugcaggaaaacuuacaccgaaaauaugcccgaccgagaaaagacgaaaaauuuacagacgaagauuacgaguccuauaagcaagccauagaaaacauagaagaauauacccauuuaaagaauaaaguagaauucaacgaacuaaaccuacuacaaggauugcuucuaaggauacuucaucgauuaguaggauacaccucaauaugggaaagggaccuacgcuuucgacuuaagggagaauuuccagaaaaucaauauauagaagaaaucuuuaacuucgagaacaaaaaaaacguaaaauacaaaggaggacaaaucguagaaaaauauaucaaauuuuacaaagaauugcaccagaacgacgaaguaaaaaucaauaaauacagcagugcaaacaucaaaguucuuaaacaagagaaaaaagaccuuuacauacgcaacuacauagcucacuucaacuauauaccacacgccgaaauaucacuacuagaaguucuagaaaaccuccgaaaauuacuaagcuaugaucgcaaauuaaaaaaugcuguaaugaagucaguagucgauauacuaaaagaguacggauucguagcaaccuucaaaauaggcgcagauaaaaaaauagguauccaaacacucgaaagugagaaaaucguacaccucaaaaaccucaagaaaaaaaaacuuaugacagaccgaaauagugaagagcucugcaaacucguaaaaauuauguucgaauacaaaauggaggaaaaaaaaagcgaaaacuaa

SEQ ID NO: 11846 - RNA, 3480 nt, Artificial Sequence
  Cas13a variant__Leptotrichia buccalis__WP_015770004.1__Cas13a(N314A)
augaaaguaacaaaaguaggaggaaucucacacaaaaaauauacgucagaaggaagacuagucaaaucagaaagcgaagaaaaucguacugacgaaagacuauccgcauuacuaaacaugagauuagacauguauaucaaaaauccaagcaguacagaaacaaaagaaaaucaaaaaagaauagguaaacuuaaaaaauucuucuccaauaaaaugguauacuugaaagacaauacgcuuaguuuaaaaaauggaaaaaaagaaaacauugauagagaauacucagaaacugacauauuagaaucagacguuagagacaaaaaaaacuucgcaguccuaaaaaaaaucuaucucaacgaaaauguaaacucagaagagcuagaaguauuccgcaacgauaucaaaaaaaaacucaauaaaaucaauucacuaaaauacucuuucgaaaaaaacaaagcuaacuaucaaaaaauaaacgaaaacaacaucgaaaaaguagaaggaaaaaguaaacgaaacauaaucuaugacuacuaccgcgaaagugcaaaaagagacgcguacguuucaaacguaaaggaagccuucgauaaacuauacaaagaagaagacauagcuaaacuaguacuagaaaucgagaaccuuaccaaacuagaaaaauauaagauuagagaguucuaucacgaaaucauagguagaaaaaacgauaaagaaaauuucgcaaaaauaauauacgaagaaauacaaaauguaaacaauaugaaagaacuuaucgaaaagguaccggacaugucagaacuaaaaaaaucucaaguauucuacaaguauuaccuagacaaagaagaacuaaacgacaaaaacaucaaauacgcauuuugccacuucguagaaauugaaaugagucaguuauuaaaaaacuaugucuacaaaagauuaucagccaucucuaacgacaaaauuaaacgaaucuucgaauaccaaaaucuaaaaaaguuaauagaaaauaaacuacucaacaaacuagauacguacguacggaacuguggaaaauauaauuacuaucuucaagacggggaaauagcaaccucagacuucauagcacgaaacagacaaaacgaagcauuccugagaaauauaauaggcgucucaucugucgcauacuucagcuuaagaaacauuuuggaaacugaaaaugaaaacgacaucaccggacgaaugagaggcaaaaccguaaaaaauaauaaaggcgaagagaaauacguaucaggcgaaguagauaaaaucuacaacgaaaacaaaaaaaacgaaguuaaagaaaaccucaaaauguucuacuccuaugauuucaacauggauaacaaaaacgaaauagaagacuuuuucgcaaacauugacgaagcaaucucuucaauaagacacggcauaguacauuucaaccuugaacuggaagguaaagacauuuucgcauuuaaaaacauagcaccgucugaaauaucaaaaaaaauguuccaaaacgagaucaacgaaaaaaaacuaaaguuaaaaaucuucagacagcucaacuccgccaauguauuucgauacuuggagaaguacaaaauacucaacuauuuaaaaagaacaagauuugaauucgugaauaagaacauaccauuugucccaucauucacaaaacuauacucaagaauagacgaccuaaaaaauagccucggcauuuacuggaaaacaccaaagacaaacgaugacaauaaaacaaaagaaauaauagaugcccaaauauaccugcuaaagaacauuuacuacggugaauuuuuaaacuacuucaugucaaauaacgguaacuucuuugaaauaucuaaagaaauuaucgaacuaaauaaaaacgacaaaagaaaucuaaaaacagguuucuauaaacuacaaaaguucgaagauauacaagaaaaaauaccaaaagaauaccuagcaaacauacagagucuauacaugauaaaugccggcaaccaagacgaagaagaaaaagacacauauauagauuuuauacaaaaaauauuccuuaaaggauucaugacauauuuagccaacaauggaagacuuucauuaauauauaucggaagugaugaagaaaccaacacuucauuagcggaaaaaaagcaagaauucgauaaauuccuaaaaaaauacgaacaaaacaacaacauaaaaauaccauacgaaauuaaugaauuccuacgagaaauaaaacucggaaauauauuaaaguauaccgaaagacuaaauauguucuaucucauucucaaauuauugaaucauaaagaauuaaccaaccugaagggaagucuggaaaaauaccaaagcgccaacaaagaagaagcauucagcgaccaauuagagcuuauuaaccucuuaaauuuagacaauaacagagucaccgaggauuucgaacuagaagcugacgaaaucgguaaauucuuagauuuuaacggaaacaaagucaaggauaacaaagaacuuaaaaaauuugacaccaacaaaaucuauuuugacggcgaaaacauuauaaaacauagggccuucuauaacauaaaaaaauauggaaugcuuaauuuacuagaaaaaaucgcagacaaagcgggauacaaaauaucaauagaagaacucaaaaaguauucaaacaaaaaaaacgaaauagaaaagaaccacaaaaugcaagagaauuuacacaggaaauacgcacggcccagaaaagaugaaaaauuuaccgaugaagauuacgagucauacaaacaagccaucgaaaacauagaagaauacacacaccuaaaaaauaaaguagaauucaacgaacucaaccucuuacaaggacuucuacuccgaauacuacacagguuaguaggcuauacaucuauaugggaaagggacuugagauuucggcuuaaaggagaauucccagaaaaccaguacauugaagaaaucuucaauuuugaaaacaaaaaaaaugucaaguauaaaggaggacaaauaguagaaaaauacaucaaguucuacaaagaauuacaucaaaacgacgaaguaaaaaucaacaaauacuccagugccaacauaaaaguacucaaacaagaaaaaaaagaccucuacauccgaaauuauauugcucacuucaauuacauuccacaugcugaaauuucauuacucgaaguucuugaaaauuugcguaaauuacuaucauacgauaggaaauuaaaaaacgcgguaaugaaaaguguagucgauauucugaaagaauauggauuuguagcuacauuuaagaucggugcagacaaaaaaauagggauacagaccuuggaaagugaaaaaauaguccaccugaaaaacuuaaaaaaaaaaaaauugaugaccgaccguaacagcgaagaacuaugcaaacuaguaaaaauaauguuugaauacaaaauggaagaaaaaaaaagugaaaacuag

SEQ ID NO: 11847 - RNA, 3480 nt, Artificial Sequence
  Cas13a variant__Leptotrichia buccalis__WP_015770004.1__Cas13a(R1072A)
augaaggucaccaaaguaggcggaauaagccacaaaaaauacacaucagaaggacgauuaguuaaaucagaauccgaggagaaccgcaccgaugaaagacuaagcgcauuauuaaauaugagauuagacauguacauaaaaaaccccucuaguacagaaacgaaagaaaaccaaaaaagaauaggaaaguuaaaaaaauuuuucaguaacaaaaugguuuaucucaaagacaauacacuuucccuaaagaacggcaaaaaagaaaauauagacagagaguacagugaaaccgacauucuagaaagcgacguacgugacaaaaaaaauuucgccguacuuaaaaaaauauaucucaacgaaaauguaaacagcgaagagcuagaaguuuuccgaaacgauaucaagaaaaaacuaaacaaaauaaacucgcucaaauacuccuucgaaaaaaauaaagcaaacuaccaaaaaauaaacgaaaacaauauagaaaagguagaagguaaaagcaaacgaaauauaauauacgauuacuauagagagucugcaaaaagagaugcauaugucagcaauguaaaagaagcauucgacaaacuauauaaagaagaagacauagcaaaacuaguacuagaaaucgaaaauuugaccaaacucgaaaaauacaaaauuagagaauucuaccaugaaauaauaggacgaaaaaacgacaaagaaaacuucgccaaaauuauuuaugaagaaauacaaaacguaaacaacaugaaagaacucauagaaaagguaccagauaugucagaauuaaaaaagucccaaguauucuacaaauacuaucuggacaaagaagagcuaaacgacaaaaacauaaaauacgccuuuugccacuuuguagagauagaaaugucacaacuccuaaaaaauuacguuuauaaaagacugucgaacauaagcaacgauaaaaucaaaagaauauuugaauaccaaaaucuaaaaaagcuaaucgaaaacaaacuacucaacaaacucgacacauacguaaggaacugugguaaauacaauuacuacuugcaagauggcgaaaucgcaaccucagacuucauagcacgaaaucgacaaaacgaagcauuucuaaggaauauaauaggcgucagcucaguagccuacuucucacuaagaaauauacucgaaacagagaaugaaaaugacauaacaggaagaaugcgaggaaaaacuguaaaaaacaacaaaggggaagaaaaauacguaucaggagaaguggacaaaauauacaaugaaaacaaaaaaaaugaaguaaaagaaaauuugaaaauguucuacucuuacgacuuuaacauggacaacaaaaacgagaucgaagacuucuucgccaacaucgacgaagcaauuagcucgaucagacacggaauaguacacuuuaaucuagaacucgaagguaaagauaucuuugcauucaaaaacaucgcuccaucagaaaucagcaaaaaaauguuccaaaacgaaauaaacgaaaaaaaauuaaaacuuaaaauuuuccgacaacuaaauagugcaaacguauuucgauacuuagaaaaauauaaaauauuaaacuaccugaaaagaaccagauucgaauucgucaacaaaaacaucccuuucgucccaucguucacaaaguuguacucccgaauugaugaccuaaaaaauagcuuaggaauauauuggaaaacuccuaaaacaaaugacgacaacaaaacaaaagagauuauagacgcccaaauauaccuauuaaaaaacaucuauuacggagaauuccuuaauuacuuuaugagcaacaacggaaauuucuucgaaauuucgaaagaaauuauagaguuaaauaaaaacgacaaaaggaaucuaaaaacaggguucuacaaacuucaaaaauuugaagacauccaagaaaaaauaccuaaagaauaccucgcaaacauccagagcuuauacaugauaaacgcaggaaaucaagacgaagaagaaaaagauacauacauagauuucauacaaaaaauauucuuaaaaggauuuaugacauacuuagccaacaacggaagguuaagucuaauauauaucgguagcgacgaagaaacaaauaccucacuagccgaaaaaaaacaagaauuugauaaauuccuuaaaaaauacgaacagaacaacaauauaaaaauaccguacgaaauaaaugaauucuuacgagaaauuaaacuagguaacauccucaaauacacggagagacuaaacauguuuuauuuaauacugaaacuacuuaaucauaaagaacugaccaaccuaaaaggauccuuagaaaaauaucaaagcgcaaacaaggaagaagccuucucagaccaacuagaacucauuaaucugcuuaaccuugacaacaacagaguaacagaagauuuugaguuagaagcagacgaaaucggaaaauuuuuagauuuuaacggcaacaaaguaaaagauaauaaagaacucaaaaaauucgacacuaauaaaauauacuuugacggagaaaauauaauuaaacacagggcguucuacaacauuaaaaaauacggaaugcuuaaucuccuagaaaaaauagcagacaaagcuggauacaaaauaucaauagaagaauuaaaaaaauacucgaauaaaaaaaaugagauugaaaaaaaucacaaaaugcaagaaaacuuacacagaaaauaugccaggcccagaaaggaugaaaaauucacugacgaagacuaugaaaguuauaagcaagcaauagaaaacauagaagaauacacacaucuuaaaaauaaaguggaguucaacgaauuaaauuugcuccaaggacuuuuacucagaaucuuacaucgauuaguagguuacacauccauaugggaacgagaccuaagauuucggcucaaaggcgaauuucccgaaaaucaauacauugaagaaauauucaacuucgaaaacaaaaagaauguaaaauauaaaggaggacaaaucgucgaaaaauauaucaaauucuauaaagaauuacaccaaaacgacgagguaaaaauaaauaaauauuccucagccaauauaaagguacucaaacaggaaaaaaaagaucuuuacauuagaaauuacauagcucacuucaauuauauaccacacgccgaaauaagucuacuagagguacucgaaaaucuagcaaagcuccuaaguuaugaccguaaauuaaagaaugcagugaugaaaagcguuguggacauacuaaaggaauacggauucgucgcuacguucaaaauaggagcagauaaaaagauaggaauacaaacuuuagagagugaaaaaauaguacaccuuaaaaaccuaaaaaaaaaaaagcucaugaccgaucgaaauucagaagaacuaugcaaacucgucaaaauaauguucgaauacaaaauggaagaaaaaaaauccgaaaacuaa

SEQ ID NO: 11848 - RNA, 3480 nt, Artificial Sequence
  Cas13a variant__Leptotrichia buccalis__WP_015770004.1__Cas13a(D1078A)
augaaggugaccaaaguugggggcaucagccacaagaaauacaccucugaaggaagauugguaaaaucggaaucagaagaaaaccgaacagaugaaaggcuaucagcauuacugaauaugagauuagauauguacauaaaaaacccaaguucaaccgaaacaaaagaaaaccaaaaaagaauaggaaaguugaaaaaauucuuuucaaauaaaauggucuaccugaaagauaauacacuaucgcuaaaaaacggcaaaaaagaaaauauagaccgcgaauauagugaaacugacauccuagaaagcgacgucagagacaaaaaaaacuucgcuguccuaaaaaaaaucuaccucaaugaaaaugucaacagugaagaacuagaagucuucagaaacgacauaaaaaagaaacucaauaaaauaaacucccuaaaguacagcuucgaaaaaaacaaggccaacuaccaaaaaauaaacgaaaauaacauagaaaagguagaaggcaaaaguaaaagaaacauaaucuaugacuacuaccgagaauccgccaaacgcgacgccuacgucagcaacgucaaagaagcauuugacaaacuauacaaagaagaagacauagcaaaacuuguucuagaaauugaaaaccucaccaagcuagaaaaauacaaaaucagggaauuuuaucacgaaauaauagggcgcaaaaaugacaaagaaaauuucgcaaaaauaaucuacgaagaaauacaaaacguaaauaacaugaaagaauugauugaaaaaguuccagacauguccgaacuaaaaaaaagccaaguguuuuacaaauauuauuuagacaaagaggaacucaacgacaaaaacauaaaauacgccuuuugccacuucguagaaauagaaaugucacaacuacuaaaaaacuauguuuacaaaagacugagcaauauuuccaaugacaaaauaaaacgaauauucgaauaccagaaucucaaaaagcuuauagaaaauaaacuguuaaauaaacuagacacuuacguaaggaacuguggaaaauacaauuacuaccugcaagacggcgaaauugcaacgucggauuucauagcccggaacagacaaaacgaagcguuucuucgaaauauaauaggaguaagcucaguugcuuacuucucauuaagaaauauacuagaaacagagaaugagaacgacauaacuggaagaaugcgcggaaaaacaguaaaaaacaauaaaggagaagaaaaguacguaagcggagaagucgauaaaaucuacaacgaaaacaaaaaaaaugaaguaaaagaaaacuuaaaaauguucuacuccuaugauuuuaauauggacaacaaaaacgaaauagaagacuucuuugcaaacauagaugaagcaauaagcaguauacggcauggcaucguccacuuuaaccuagaacuagaaggaaaagacauauucgcauuuaaaaacauagcacccagcgaaauaagcaaaaaaauguuccaaaacgaaauaaacgagaaaaaauuaaaacucaaaaucuucagacaacuaaauagcgcaaacguauuuagauaccuagaaaaauacaaaauccuuaacuaccucaaacgcacaagauuugaauucguuaacaaaaauauacccuuugucccauccuuuacuaaacuauauucacgaauagacgacuuaaaaaauucauuaggaaucuauuggaaaacaccaaaaacuaaugacgacaacaaaacaaaagaaauaauagacgcccaaauauacuuacuaaagaauauauacuacggagaauucuuaaauuacuucauguccaauaauggaaacuucuuugaaauaaguaaagaaaucauagaacuuaacaaaaaugacaaaagaaaccuaaaaacaggauucuauaaacuacagaaauucgaagauauccaagaaaaaauacccaaagaguacuuagcaaacauacaaucacuauacaugauuaacgcuggaaaccaagaugaagaagaaaaagauaccuacauagauuucauacaaaaaauauucuuaaaaggauucaugaccuaucuagcaaauaauggaaggcugucuuuaauauacauaggcuccgacgaagaaacaaacacaucccuagcagaaaaaaagcaagaauucgacaaguucuuaaaaaaauacgaacaaaacaacaacauaaaaaucccauacgaaauuaaugaauuuuuaagggaaaucaaacucggcaauauacuuaaauacaccgaaagauugaauauguucuaccuaaucuuaaagcuacuaaaucauaaagaauuaaccaaucuaaaagguagccucgaaaaauaccaaucagcuaacaaagaggaagccuucagcgaccaacucgaacugauaaaucuacuuaacuuagacaacaaccgagucacagaggauuuugaacucgaggccgacgaaaucggcaaauucuuagacuucaacgggaacaagguaaaagacaacaaagaacuaaagaaauucgauacgaacaaaauauacuuugacggcgaaaacauaauaaaacauagagcauucuacaacauuaaaaaguacggcaugcuaaaucuacuagaaaaaaucgcagauaaggcaggauacaaaauaucuauugaagaguuaaagaaauauucgaacaaaaagaacgaaauagaaaaaaaucauaaaaugcaagagaacuuacaucggaaguaugcaagaccaagaaaagaugaaaaauucacagacgaagauuacgaaucauacaaacaggccauagaaaacauagaggaauacacacaccugaagaacaaaguggaauucaacgaacuaaaccuguuacaaggccuauuauuaagaauauugcacagacuaguaggauacacauccauaugggaacgcgaucuaagauuccgucuaaaaggagaauucccagaaaaucaauacauagaagagauauucaacuuugaaaacaaaaaaaacgucaaauauaagggaggacaaauagucgaaaaauacauaaaauuuuauaaagaauuacaucaaaacgaugaaguaaaaauaaacaaauacuccuccgcuaauauaaaaguacuaaaacaagaaaagaaagaucuauacaucagaaacuauauagcucacuucaacuacaucccucacgcagaaaucucauuacucgaaguacuugaaaaccucagaaaacucuugucuuacgcccgaaaacuaaagaacgcagucaugaaaucggucguagacauauuaaaggaauacggcuuuguagccacauuuaaaauaggugcagauaaaaaaauaggaauccaaacucuagaguccgaaaagaucguucacuuaaaaaaccuaaaaaaaaaaaaacuaaugacagauagaaacagcgaagaacugugcaaacuagucaaaaucauguucgaauacaaaauggaagaaaaaaaaagugaaaauuaa

SEQ ID NO: 11849 - RNA, 3480 nt, Artificial Sequence
  Cas13a variant__Leptotrichia buccalis__WP_015770004.1__Cas13a(R1079A,K1080A)
augaaaguaacaaaagucggaggaauaucacacaaaaaauacaccagcgaaggaaggcugguaaaaucagaaagugaagaaaaucgaaccgacgaaagacuaucagcuuuacucaauaugcgccuagauauguacauaaaaaacccaucaucuacagaaacaaaagaaaaccaaaaaagaaucggcaagcuuaaaaaauucuuuucaaauaaaauggucuacuuaaaagacaacacccuaucacugaaaaacgggaaaaaagaaaauaucgacagagaguacucagaaacagacauacuagaaagcgacgucagagacaaaaaaaacuucgcagugcuaaaaaaaauauacuuaaacgaaaauguaaacagcgaagaacucgaaguguuccgaaaugacauuaaaaaaaaacuaaacaagauuaauucacuaaaauauucauucgaaaaaaacaaagcaaacuaucaaaaaauuaaugaaaacaacauagaaaaagucgaaggaaaaucaaaaagaaacauaauauacgauuauuauagagaaucagccaaaagggacgcauauguaucuaacguuaaagaagcauucgacaaacucuacaaagaagaagauauagcuaaacugguacuagaaauagaaaaucuuacaaagcucgaaaaauacaaaaucagagaauucuaccaugaaaucauaggccgaaaaaacgacaaagaaaacuuugcaaaaauuauauacgaggagauccaaaauguaaacaauaugaaagaacuaaucgaaaaagucccggacaugucagaacugaagaaaucacagguauuuuauaaauauuaccuagacaaagaagagcuaaaugacaaaaacauaaaauacgccuuuugucacuuuguugaaauagaaaugagucaacuauuaaaaaauuacguauacaaaagauuaucaaauauaucuaacgauaagauuaaaagaauauucgaauaucaaaaccugaaaaaacuaaucgaaaauaaacuacuaaauaaauuagauacauacgugagaaauugcggcaaauacaacuacuacuuacaggauggcgaaauagccaccuccgacuuuauagcaaggaacagacaaaacgaagcauuccuuaggaacauuauaggaguaucaucaguagcuuacuucagucuacgaaauauacuagaaaccgaaaaugaaaaugacauaacaggccgaaugagaggcaaaacagugaaaaauaauaaaggagaagaaaaauacgugucuggagaaguugacaaaauauauaaugaaaacaagaaaaaugaagucaaagaaaaucucaaaauguuuuacaguuaugauuucaacauggacaacaaaaacgaaauagaagacuuuuucgccaauauagaugaagcaauaucaaguauacgacacggcauaguacauuucaaccuagaacuagaaggaaaagauauauuugcauucaagaacauagcaccuuccgaaauaagcaaaaagauguuucagaacgaaauaaaugagaaaaaauuaaaacugaagauauucagacaauuaaacucagcaaacgucuucagauauuuagaaaaauacaaaauccuaaauuaucuaaaacgaacaagauucgaauuuguaaacaaaaauauaccauucgucccgucauucaccaaacuauauucacggaucgacgaccuaaaaaauagucuuggcauauacuggaaaacaccaaaaacaaacgacgauaacaaaaccaaagaaauaauagaugcacaaauauaccuacugaagaauauauacuauggagaauuucuaaacuauuuuaugucaaauaacggaaacuucuucgaaauaucaaaagaaauaauagaacuaaauaagaaugacaaaagaaaccuaaaaaccggcuucuacaaauuacaaaaauuugaagauauacaagaaaaaauacccaaagaauacuuagcaaacauacagucauuguacaugauuaaugcagguaaccaagacgaagaagaaaaagacacauauauugacuucauacaaaaaauauuucuaaagggguucaugacauaucuagcaaacaacggacgacugucauuaauauauauaggaagcgacgaagagaccaauaccucccuugcagaaaaaaagcaggaauucgacaaauuccuaaaaaaauacgaacaaaacaacaauauaaagauuccguacgaaauaaacgaauuccucagagaaaucaaacuaggcaacauacucaaauauacagaacgauuaaauauguucuacuuaauucucaagcuacuuaaccauaaagaacuaacuaauuuaaaaggaucgcuagaaaaauaucaaagugcuaauaaagaagaggcauuuagcgaccaauuagaauuaauaaaucuacuaaacuuagauaacaacagagucacagaggauuuugaauuagaggccgacgagauaggaaaauuucucgauuuuaacggaaacaaaguaaaagauaacaaagaauuaaaaaaauuugacacaaacaaaauauacuucgauggcgaaaauaucauaaaacaccgcgcauucuauaauaucaaaaaauauggcauguuaaacuuacucgaaaaaauagcugauaaggcaggauacaaaauaaguauagaagaacuuaaaaaauacucuaacaaaaaaaaugaaauagaaaaaaaucacaaaaugcaagaaaaucuacacagaaaauacgcgcgaccaagaaaagacgagaaauucacagacgaagacuacgaaaguuacaaacaagccaucgaaaauauugaagaauauacucaccuaaagaauaaaguagaguuuaacgagcuaaacuuacuccaaggcuuacuacuccgaauccuacaucggcuaguaggcuauacaaguauaugggaacgagaccuuagauucaggcuaaaaggagaguucccagaaaaucaauacaucgaagaaauauucaauuucgagaacaagaaaaacguaaaauacaaagguggacaaaucguugaaaaauauaucaaauucuacaaagaauugcaucaaaacgaugaaguuaaaauaaacaaauauaguagugccaacauaaaaguacuaaaacaagaaaaaaaagauuuauauaucagaaacuacaucgcacacuucaauuauauaccccacgcggaaaucucacuccuagaagugcuagaaaaucuaagaaaauuauuaaguuaugaugccgcucuaaaaaacgcaguaaugaaaagugugguagacaucuugaaagaguauggauucguagccacauucaaaauaggagcggauaaaaagaucggaauccaaacacuugaauccgagaagauaguacaccucaaaaauuuaaaaaaaaaaaaacucaugacagauaggaacucugaagaacuaugcaaauuagucaaaauaauguucgaguacaaaauggaagaaaaaaaaagugagaauuaa

SEQ ID NO: 11850 - RNA, 3480 nt, Artificial Sequence
  Cas13a variant__Leptotrichia buccalis__WP_015770004.1__Cas13a(K1080A)
augaaaguuaccaaaguaggaggaauaagucacaaaaaauacacgagcgaaggaagacuagugaaaucagaaagugaagaaaauagaacagacgaaagacuaucagcacuacuuaauaugagauuagacauguacauaaaaaaccccaguucuacugaaaccaaagaaaaccaaaaacgaauagguaaauuaaaaaaauucuucucaaauaaaaugguguacuuaaaagacaauacauuaucgcuaaaaaacggaaaaaaggaaaauauagaccgcgaauauucagagacagauauauuagaaagcgauguucgagacaaaaaaaacuucgcuguauuaaaaaaaauauacuuaaaugaaaauguuaacucagaagagcuugaagucuucagaaacgacaucaaaaaaaaauuaaauaaaauaaacagucuuaaauauuccuuugaaaaaaacaaagcaaauuaucaaaaaauaaaugaaaacaacauagaaaaagucgaaggaaaauccaagagaaauaucauauaugacuacuaccgagagagcgcaaaaagggacgccuaugugaguaacgugaaagaagcuuucgacaaacuauauaaagaagaagacauagcaaaacugguacuugaaaucgaaaacuugacaaaauuagaaaaauacaaaauacgugaguucuaccaugagauaauaggccgcaaaaacgauaaagaaaacuucgcaaagauaauauacgaggaaauccaaaacguaaauaacaugaaagaacugauagaaaagguaccugauaugagugaacuaaagaaaucacaaguuuucuauaaauacuaucucgacaaagaagagcuaaacgacaaaaauauaaaguacgcauucugucacuuugucgaaaucgaaaugagccaauuacuaaaaaacuacgucuauaaaagacuaagcaacauuucaaacgacaaaaucaaacgaauauuugaauaucaaaacuuaaaaaaacuaaucgaaaauaaguuacuaaauaaacuggacacguauguucgcaauugcggaaaauacaauuauuaucuacaagacggugaaauagcaacaucggacuuuaucgcacggaauagacaaaaugaagcguuucucaggaacauaaucggaguaucaucaguugccuauuucagccuucgcaacauucuagaaaccgaaaacgaaaacgacauaacaggaagaaugagaggaaaaacaguaaaaaauaacaaaggagaagaaaaguauguaucaggcgaggucgacaaaaucuacaaugaaaauaaaaaaaaugaagugaaagaaaaccuuaaaauguuuuauucauacgacuucaacauggauaacaaaaaugaaauagaagacuucuucgcaaauaucgacgaagcaaucucaagcauccgacacggaauaguacacuucaaucuagaauuagaaggcaaagacaucuucgcauucaaaaauauugccccguccgaaauuaguaaaaaaauguuucaaaacgaaauuaacgaaaaaaaauuaaaacuaaaaauauucagacaacuaaauucagccaacguauucagauacuuggaaaaauacaagauauugaacuaccucaaaagaacaagguucgaauucguaaacaaaaacauaccauucguaccgagcuuuacaaaacuauacucgcgaauagaugaccucaaaaacagucucggcauauacuggaaaacaccaaaaacaaacgacgauaauaaaacuaaggagauaaucgaugcucaaauuuacuugcuuaagaauauauacuacggggaauucuuaaauuauuucaugucaaacaacggaaauuucuucgaaaucucaaaagagauaauagaguuaaauaagaacgacaaacgaaauuuaaaaacaggauucuauaagcuccaaaaauucgaagauauacaagaaaagauuccuaaagaauacuuagccaauauacaaagccuauacaugauaaacgcuggaaaccaagaugaagaagaaaaagacacauauauagacuucauacagaagaucuucuuaaaaggauuuaugacauaccuggcaaacaauggcagacucagucuaauauacauaggaucagacgaagaaaccaacacauccuuagcugaaaagaaacaagaauucgacaaauuccucaaaaaauacgaacaaaacaacaauauaaaaauacccuacgaaauaaacgaauuuuuacgggaaauaaaacuaggaaacauauuaaaauacacagaaagauuaaauauguucuacuugauacucaaacuacuaaaccauaaagaauuaacgaaucuaaaaggaucauuggaaaaauaccaaagugcaaacaaagaagaagcauuuagcgaccaacuugaacugauaaaucuauuaaaccuggacaacaauagaguaacugaggauuuugaauuagaagcugaugaaauuggcaaauuucuagacuucaacggcaacaaaguuaaagauaauaaggaacuaaaaaaauuugacacaaacaaaaucuacuucgauggagaaaacaucauaaaacauagggccuucuauaauauaaagaaauacggaaugcuaaacuuacuggaaaagaucgccgacaaagccggcuauaaaauaucgaucgaagaauuaaaaaaauacucaaauaaaaaaaaugaaauagaaaaaaaucacaaaaugcaagaaaauuuacaccgcaaauaugcgagaccccgaaaagacgaaaaauuuacagacgaagacuacgaaaguuacaaacaagcaauagaaaacauagaagaauacacucacuuaaaaaacaaaguagaauucaacgaacucaaccugcuucaaggccuauuacuacgaauacuccacagacuaguaggguacacauccauaugggaaagagacuuacgauuccgauuaaaaggcgaauuccccgaaaaucaauacauugaagaaaucuucaacuuugaaaauaaaaaaaacguaaaauauaaaggaggacaaauuguagaaaaauacauaaaauuuuauaaagaacuacaccaaaaugacgaaguaaaaauaaauaaauacucaagcgcaaauauuaaaguccucaaacaagaaaaaaaagaccuuuacauaagaaacuacauugcacauuuuaacuauaucccacaugcagaaauaucccuuuuagaaguacucgaaaaucuaagaaaacugcuuagcuacgacagagcuuugaaaaaugcaguaaugaagucaguaguagacauacuaaaagaauauggauuuguagcaacauucaaaaucggagcagacaaaaaaauaggcauacaaacccuagaaucugaaaaaauagugcaccucaagaaucucaaaaaaaagaaacuaaugaccgauagaaacagcgaagaacuauguaaauuaguuaagauaauguucgaauacaagauggaggagaaaaaaucugaaaacuaa

SEQ ID NO: 11851 - RNA, 3480 nt, Artificial Sequence
  Cas13a variant__Leptotrichia buccalis__WP_015770004.1__Cas13a(K1082A)
augaaagugacaaaagucggaggcauuagccacaagaaauacaccagcgaaggaagauuaguaaaaucagaaagcgaagagaacagaaccgaugaaaggcucucagcacucuuaaacaugagacuagacauguacauaaagaaccccuccucaaccgagacaaaagaaaaucaaaaacguauuggcaaacuaaaaaaauuuuuuagcaauaaaaugguauaccuaaaagacaacacacuaucauuaaaaaaugguaaaaaagagaauauagacagggaguauucagaaacagauauucuggagagcgauguacgcgauaaaaaaaacuuugccguauugaaaaaaauuuaccuaaaugaaaacguaaacagcgaagaacuagaaguuuuucgaaacgacaucaaaaaaaaacuuaacaaaauaaauucuuuaaaauacuccuuugaaaaaaacaaagcuaauuaucagaaaauaaacgaaaacaauauagaaaaaguggaagguaaaaguaaacgaaauauaauauacgauuacuacagagaaucagcaaaaagagacgcauauguaagcaaugucaaagaagcauucgauaaauuguacaaagaagaagauauagcaaaacugguacuugaaauagaaaaucuaaccaaacuagaaaaauacaaaauucgugaauucuaucaugaaauaauaggaagaaaaaaugacaaagagaauuuugcaaaaauaaucuaugaagagauccaaaacgucaauaacaugaaagaauuaauagaaaaaguucccgacaugucagaguuaaaaaagucucaaguuuucuacaaauauuacuuagauaaagaagaacuaaacgauaaaaacauaaaauacgccuucugccacuucgucgaaauugaaaugagccaacuauuaaaaaacuacguguacaaacggcucucaaacauuuccaacgacaaaauaaaaagaaucuucgaauaccaaaaccuaaaaaaacugauagagaacaaacuccuaaacaagcuagacacauauguaagaaacugcggaaaauacaacuacuauuugcaagacggugaaauugcaacuucagacuucauagcaagaaaccgucaaaacgaagcauuccuaaggaacauaauuggaguaucuaguguggccuacuuuucacuacgcaauauauuagaaacugaaaacgagaaugauaucacgggaagaaugagagggaaaacggucaaaaacaacaaaggagaagaaaaauauguaucuggagaggucgauaaaaucuacaacgaaaacaaaaaaaacgagguaaaagagaaucuaaaaauguuuuacaguuacgauuuuaauauggacaauaaaaaugaaauugaagacuuuuuugcuaauauagacgaagcaauaucuucuauacgucacgguauaguacacuucaacuuagaacuggaaggcaaagacauauucgcauuuaagaacauugccccaagcgaaaucaguaaaaaaauguuucaaaacgaaauaaacgaaaaaaaauuaaaguuaaaaauauucagacaacucaacucagccaacguauuucguuauuuagagaaauacaaaauacucaauuaccuaaaaagaacucgauuugaauuugugaacaaaaacauaccauucguaccaaguuuuacuaaauuauacucaagaauagaugaccuaaaaaauucacucggaauauacuggaaaacgccaaaaacaaacgaugacaacaaaacaaaagaaaucauagaugcacaaaucuaccugcuaaaaaacauauauuauggcgaauuccucaauuacuucauguccaacaauggcaacuuuuuugaaaucagcaaagaaauaauagagcuaaauaaaaaugacaaaagaaaccuaaaaacugguuucuacaaacuucaaaaauucgaagacauacaagaaaaaauccccaaggaauaccuugccaauauacaaucguuauauaugaucaacgcuggcaaucaagaugaagaagaaaaagauacauacauagacuucauacaaaaaauauucuuaaaaggauucaugacauaucuagcaaauaacggaagauuaagccugauauacauaggaagcgacgaagaaaccaauaccucccucgcagaaaaaaaacaagaauuugauaaguuucuaaaaaaauaugagcaaaacaauaacauuaaaaucccuuaugaaauaaacgaauuucuacgugaaaucaaacuaggcaacauccuaaaauauacagaaagauuaaacauguucuaucugauccuuaaauugcuaaaucacaaagaacuuacaaaccuaaaagguucacuagaaaaauaccaaagcgccaacaaagaagaagcauucucugaccaguuagaacucauuaaccuucuaaaccuagauaacaauaggguaacagaagacuuugaacuagaggcagacgaaauaggaaaauuccucgauuuuaacgguaauaaaguuaaagacaacaaagaauuaaaaaaauucgauacaaacaaaaucuacuucgacggagaaaauauaauaaaacaucgagcauucuauaacaucaaaaaauacggaaugcuuaacuuacucgaaaaaaucgcagacaaagcuggguauaaaauuucgaucgaagaacuaaaaaaauacagcaacaaaaaaaacgaaauagaaaaaaaucauaaaaugcaagaaaacuuacauagaaaauacgcccgaccaagaaaagacgaaaaauuuaccgacgaagauuacgagaguuauaaacaagcaauagaaaacauagaagaauauacccauuuaaaaaauaaggucgaauucaacgaauuaaaccuccuacaaggacucuuacugagaauucuucacagacuaguaggcuauacaucaauaugggaaagagaucuacgcuuuagauuaaaaggagaauucccagaaaaccaauacauagaagaaauuuucaacuucgaaaacaaaaaaaacguaaaauauaaaggaggacagaucgucgaaaaauacaucaaauucuacaaagaacuccaccaaaacgacgaaguaaaaauaaauaaauauucaucagccaacauaaagguacucaaacaagaaaaaaaagacuuauauauacgaaauuacauagcucacuuuaacuauaucccucacgcagaaauaucauuacuggaagugcuagaaaauuuacgaaaacuauugaguuacgacagaaaacuagcgaacgcaguaaugaaaucggucgucgacauacugaaggaauacggauucgucgcuacauucaaaaucggcgcugacaaaaaaauaggaauccaaacccuggaauccgaaaaaauaguccaccucaaaaaucugaaaaaaaaaaaacuaaugacagauagaaacagcgaagaauuauguaaacuaguaaagauaauguucgaauauaaaauggaagaaaagaaauccgagaacuag

SEQ ID NO: 11852 - RNA, 3480 nt, Artificial Sequence
  Cas13a variant__Leptotrichia buccalis__WP_015770004.1__Cas13a(K1087A)
augaaggucacaaaaguaggugguaucucacacaaaaaauacacaucagaaggaagacucguaaaaucugaaucagaagaaaaucgaacagacgaacgacuuagcgcacuauuaaacaugagacuugauauguacaucaaaaacccaucaaguacggaaacaaaagaaaaccaaaaacgaauaggcaaacuuaaaaaauucuucuccaacaaaaugguauaccucaaagauaacacauuaagcuugaaaaauggaaaaaaagaaaacauagaccgagaauacagcgaaacagacauccuagaaagcgacguuagagacaaaaaaaauuucgcaguauuaaaaaaaauauaccucaacgaaaauguaaacucagaagaauuagaaguuuucagaaacgacauuaaaaaaaaacuuaacaaaauaaacucauuaaaguacagcuucgaaaaaaacaaagcgaacuaccaaaaaauaaacgaaaacaauauagaaaaaguugaagguaaaaguaaaagaaacauaaucuaugauuauuacagagaaucagcaaaaagagaugcuuacguuucaaacguaaaagaagcguuugauaaacucuacaaagaagaagacauagccaaauuaguucucgaaauagaaaaccucacaaagcuugagaaauacaaaauaagagaauucuaucacgagauaauaggucguaaaaacgauaaagaaaauuucgcuaaaauaaucuacgaagaaauccaaaaugugaacaacaugaaagaauuaauagaaaaaguuccugacaugagugagcuuaaaaaaagucaaguauucuacaaauauuauuuagacaaagaagaauuaaacgacaaaaacauaaaauacgccuucugucauuucgucgagaucgaaaugagccaauuacuaaaaaauuaugucuauaagcgcuuaucuaacauauccaacgacaaaauaaaaagaauauucgaauaccaaaacuugaaaaaacuaauagagaacaaauuacuuaacaaacuagacaccuacguccgaaauugcggcaaguacaacuacuaccugcaggacggcgagaucgcaacaagcgauuucauagcacgaaacagacaaaacgaagccuucuugagaaacauaaucgggguauccagcguagcauacuuuagucuuagaaacauauuagaaacagaaaacgaaaaugacaucacgggaagaaugagagguaaaaccguuaaaaacaacaaaggggaagaaaaauauguaaguggagaaguggacaaaaucuacaaugaaaacaagaagaaugaaguaaaagagaaucuaaaaauguuuuauagcuaugauuuuaacauggacaacaaaaacgagauagaggacuuuuucgcgaacauagacgaagccauuucaucaauaagacacgggauaguccauuucaauuuagaacuagaaggaaaggacaucuuugcauucaaaaacaucgcccccagcgaaauaucuaaaaaaauguuccaaaacgaaauaaacgaaaaaaaacugaaacuaaaaauauuccgacagcuaaacagcgcaaacguauuuagauaccuggaaaaauacaaaauacucaauuaucugaaaagaacaagauucgaauucguaaauaaaaacauaccauucguaccuuccuucaccaagcuauauagcagaauugacgaccuuaaaaauagucucgggauuuauuggaagacacccaaaacuaacgacgauaacaaaacaaaagaaauaaucgacgcacaaaucuaucuacuaaaaaacaucuauuacggcgaauuccugaauuauuuuauguccaacaaugguaauuuuuucgagauaucaaaagaaauuaucgaacuaaacaaaaacgauaaaaggaaucuaaaaaccggcuuuuauaaauuacaaaaauuugaagacauccaagaaaaaauuccaaaagaauauuuagcaaauauacagucccuguacaugaucaacgcgggaaaucaagaugaagaggaaaaagacaccuauauagacuucauacaaaaaauauuccucaagggauuuaugacguaccuggcgaauaacggcagauuaucucuaauuuacauaggaagugacgaagaaaccaauaccagucuagcagaaaaaaaacaggaauucgauaaauuccuaaaaaaauacgaacaaaauaacaacauuaaaauaccauacgaaaucaacgaauucuuaagagaaaucaagcuaggcaauauacuaaaauacacagaacguuuaaacauguucuaccuaauacuaaaacuccuaaaucacaaggagcuaaccaaucucaaaggaucacuagaaaaauaucaauccgccaacaaagaagaggcauucucugaucaacucgaauuaaucaauuuacuaaacuuagacaacaacagagucacagaggauuucgaacuagaagcagaugaaauaggaaaauuccuggacuuuaacgggaacaagguaaaagauaacaaggaauuaaaaaaauucgacacaaauaaaauauacuucgacggagaaaacauuauaaaacauagagcauucuauaauauaaaaaaauacggaauguuaaaucuucuugaaaaaaucgcagacaaagccggauacaaaauuagcaucgaagaacucaaaaaauauagcaacaaaaaaaacgaaaucgaaaaaaaccacaaaaugcaagaaaaccuucacagaaaauacgccagaccaagaaaagacgagaaauuuacugaugaagacuaugagucauacaaacaagcaauagaaaacauagaagaauauacacaccucaaaaauaaaguugaguuuaaugaacuuaaucuccuacaaggauuacucuuacggauacuacaccgucuagucggcuacaccucaauaugggaacgagaccuacgguuccgacuaaaaggagaauuuccagaaaaccaguacaucgaggaaauuuuuaauuuugaaaacaaaaaaaacgucaaauauaaaggaggacaaauugucgaaaaguauaucaaguucuauaaagaacuacaucaaaacgacgaagucaaaauaaacaaauacaguagcgccaacauuaaaguccuaaaacaagaaaaaaaagacuuauacauaagaaacuacauagcucacuucaauuacauaccgcacgcagagauuucacuacuggaaguauuagaaaauuuaagaaaauuacuguccuacgacaggaaacugaaaaacgcaguaauggcaagcguaguagauauacuaaaagaauauggauucguagccaccuucaaaaucggugcagacaaaaaaauuggaauccaaaccuuggaaagcgaaaaaauaguacaccugaaaaaccuaaaaaaaaaaaagcuaaugacagauagaaauucagaagaacuuugcaaacucguuaaaaucauguucgaguauaaaauggaggaaaaaaaaucggagaacuaa

SEQ ID NO: 11853 - RNA, 4170 nt, Artificial Sequence
  Cas13a variant__Leptotrichia shahii__WP_018451595.1__Cas13a
augggaaaucucuucggccacaaaagaugguaugagguaagagacaaaaaagauuucaaaauuaaaagaaaaguaaaagucaaaagaaauuaugacggaaacaaauacaucuuaaauauaaaugaaaauaacaauaaagaaaaaauagacaacaacaaguuuaucagaaaauacauuaacuacaaaaaaaacgauaacauucuaaaagaauucacuaggaaauuccaugcagguaacaucuuauuuaaacuaaaagggaaagaaggaauaauaagaaucgaaaacaacgaugacuuccuggaaaccgaagaaguaguauuauacauagaagcuuacgguaaaucggaaaaacugaaagcacuagguauuaccaagaaaaaaaucaucgaugaagccauucgacaagggaucacuaaggacgacaaaaaaauagaaauuaaaagacaagaaaaugaagaagaaauugaaauugauauacgagacgaauacaccaauaaaacacucaacgacugcucaaucauucuaagaaucaucgaaaacgacgaacucgaaacaaagaaauccauauaugagauuuuuaaaaacauaaacaugucacuguauaaaaucauagaaaaaauuaucgaaaacgaaaccgaaaagguauucgaaaacagauacuacgaagagcaccuaagagaaaaacuccuaaaggaugacaaaaucgacguaauuuuaacaaauuuuauggagauaagagaaaaaauaaaaucuaaccuagaaauauuaggguuuguaaaauuuuaucuuaacguaggcggagauaaaaaaaaaucaaaaaacaaaaagaugcuugucgaaaagauauuaaauaucaauguagaucuaacuguugaagauaucgcagauuucgucauaaaagaacucgaauucuggaauauaacgaaaagaauagagaaagucaaaaagguaaauaacgaauuccucgaaaaacgacguaauaggacauauauaaaaucauacguccuacucgacaaacaugaaaaauucaaaauagaaagagagaacaaaaaagacaaaauaguaaaauucuucguagaaaacauuaaaaacaacucaauaaaagaaaaaaucgaaaagauauuagccgaauucaaaaucgacgaacuaauuaaaaaacuagaaaaagagcuaaaaaaagguaacugugacacagagauauuugggauuuuuaaaaaacacuauaaaguaaacuuugauucaaaaaaauucuccaagaaaucugaugaagaaaaagaacuauauaaaauaauauauagauaccuaaaaggcagaauagagaaaaucuuaguaaacgagcagaaaguuagauuaaaaaaaauggaaaaaaucgaaauugaaaaaauccuaaacgaaucuauacuaucagaaaaaauauuaaaaagggugaaacaguacacacucgaacacauuauguaccuaggaaaauuacggcacaacgacauagacaugaccacaguuaauacagacgacuucucacgucugcacgcaaaagaagaacuggaccuagaacuaauaacauucuuugcaucaaccaauauggaacuuaauaaaauauucuccagagaaaacauaaacaacgaugagaauauagacuuuuucgguggcgauagagaaaaaaacuacguuuuggauaaaaaaauuuuaaacagcaaaauaaaaauuauaagagaccuagauuuuauagacaacaaaaauaacauuacaaacaacuucaucagaaaauuuacaaaaauaggcacaaacgaaagaaauagaauucuacacgcaauaagcaaagaacgcgaccuacaaggaacucaagacgauuauaauaaaguaauuaacauaauacaaaaucucaaaauuucagacgaagaaguaaguaaagcacuaaaccuggauguagucuucaaagacaagaagaauauaauuacaaaaauaaacgacauuaaaauauccgaagaaaacaauaacgacaucaaauauuuaccaagcuucucaaagguacuaccagaaauucuaaaccuauacaggaacaaccccaaaaacgaacccuuugauacaauagaaacugaaaaaauaguauuaaacgcgcuaauauauguaaauaaagaacuguacaagaaacuaauccuagaggaugaccucgaagaaaacgaaagcaaaaauaucuuucuccaagaauuaaaaaaaacacugggaaauauagacgagauagacgaaaauauaauagaaaacuauuauaagaaugcacagauaagugccagcaaaggaaacaacaaagccauaaaaaaauaucaaaaaaaaguuauugaauguuacauuggauaucuaaggaaaaacuacgaagaacuauucgacuuuagcgacuuuaaaaugaacauccaagagauaaagaagcaaauaaaagacauaaaugacaauaaaacauacgagcgaaucacagugaaaacaucagacaagacaauagugauaaaugacgacuucgaguauauaauuagcaucuucgcgcuacuaaauuccaaugcuguaauaaauaaaauacgcaaucgauucuucgcaacgaguguauggcuaaacacaagcgaauaucaaaacauaauugacauacuagacgaaauaaugcagcuaaacacauuaagaaacgaauguauaacagaaaauuggaaccuaaaccuugaagaauucauacaaaaaaugaaagaaaucgaaaaagauuuugaugacuuuaaaauacaaacaaaaaaagaaauauucaauaacuacuacgaagacaucaaaaacaauauacucacagaauucaaagacgacauaaauggcugugauguacuggaaaaaaaacuagagaaaauaguaauauucgacgaugaaacuaaauucgaaauagacaagaaaaguaacauuuuacaagacgaacaaagaaaauuaaguaacauaaauaaaaaagaccuaaaaaaaaaaguugaccaauacauaaaagacaaggaccaggaaaucaaaagcaagauacuauguagaaucauauucaauucggacuuccuaaaaaaauauaaaaaagaaaucgacaaccuaauagaagauauggaaagugaaaaugaaaacaaauuccaagaaauauacuaucccaaagaaagaaaaaacgaacucuacauauauaaaaaaaaccuguuccuaaacauaggaaaccccaacuucgacaaaauauacggucuaauuuccaacgacauaaaaauggcggacgccaaauuucuauuuaauauagacggcaaaaauauacggaagaauaagauaagcgaaaucgaugcaauacuaaaaaaccuaaaugauaaacuuaauggauauucuaaagaguauaaagaaaaauauauaaaaaaacucaaagagaaugacgauuuuuuugcaaagaauauccaaaacaaaaacuacaaaagcuucgaaaaagacuauaaucggguaucagaauacaagaaaauccgcgaccuaguugaguuuaauuacuugaauaagauugaauccuaccuaaucgacauaaauuggaaauuagcaauccagauggcacgauucgaaagagacaugcauuacauaguaaacgguuuaagggaacugggaauaauaaaauuaagcggcuauaacacugggauaucaagagcuuacccaaaacgaaaugguagugauggauuuuacacaaccacagcauauuacaaauucuucgaugaagaaagcuacaaaaaauucgaaaagauaugcuauggauucggaauagaucucagcgaaaacucagaaauaaacaaaccagaaaacgaaucaauccgaaacuacauaagccacuucuacaucguacguaacccauuugcggauuauagcaucgccgaacagauagacaggguaucaaaccuacuaagcuauuccacucguuacaauaacucaaccuacgcaagcguauucgaaguauucaaaaaagacgucaacuuagauuacgacgaauuaaaaaaaaaauucaaacuuauaggaaacaacgacauccuggaacgacugaugaaaccaaaaaaaguaucagucuuagaacucgaaucuuauaacagcgacuauauuaaaaaucuaauaauugaacuucuaacuaaaauagaaaauacaaacgacacuuuguag

SEQ ID NO: 11854 - RNA, 4170 nt, Artificial Sequence
  Cas13a variant__Leptotrichia shahii__WP_018451595.1__Cas13a
auggggaaucuuuucggacauaaacgaugguaugaaguacgcgacaaaaaagacuucaaaauuaaacgaaaaguuaaagucaagcggaacuaugacggaaacaaauauauacuaaauauaaaugagaacaacaacaaagaaaagauagacaauaacaaauucauacgaaaauacauaaacuacaaaaaaaaugacaacauacuaaaagaauuuacucgaaaauuucaugcaggaaauauauuguucaaauuaaaaggaaaagaagguauuauuagaaucgagaauaaugacgauuuucuagaaacugaagaagucgucuuguacauagaagcguacggaaaauccgaaaaacucaaagcuuuaggaauaaccaaaaaaaaaaucauugacgaagcaauuagacagggaaucacaaaggaugauaaaaaaauagaaauaaaaagacaagaaaaugaagaggaaauagaaaucgacauucgagacgaauauacaaacaaaacauugaacgacugcucaauuauacuacgaauaauugaaaaugacgaauuagaaacuaagaaaagcauauaugaaauauuuaaaaacaucaacaugucgcuguacaaaaucaucgaaaaaauaauagaaaacgaaacagaaaaagucuucgaaaaucgauauuacgaagaacaucuccgagaaaaauugcuaaaagacgacaaaauagacguaauacuaaccaauuuuauggaaauacgagaaaaaauaaaaucaaaccuagaaauucuuggauuuguaaaauuuuaccuaaacguuggcggagacaaaaaaaaauccaaaaacaaaaaaaugcucguugaaaaaauacucaacauuaauguagaucuaacaguugaagacauagcagacuucgugaucaaagaauuagaauuuuggaacauaacgaaaagaauagaaaaaguuaaaaaaguaaacaaugaauuucuagaaaaaagaagaaacagaaccuauauaaaauccuacgucuuauuagacaagcacgaaaaauucaaaauugaacgagaaaacaaaaaagauaaaauaguuaaauucuucguagaaaauauaaaaaauaauucaaucaaagaaaaaauagaaaaaauacuagcagaauucaaaaucgacgagcucaucaagaaacucgaaaaagaauuaaaaaaaggaaacugcgacacggaaauauuuggcaucuucaaaaaacauuauaaaguaaacuucgacucaaaaaaauuuagcaaaaaaagcgacgaagaaaaagaacuauauaaaaucaucuacagauaccuaaaaggacgaauagaaaaaauacuagucaaugagcaaaaaguacgauuaaagaaaauggaaaaaauagaaaucgaaaaaauccuaaacgaauccauacuaagcgaaaaaauauuaaaaagagucaaacaauacacacucgaacauauaauguauuuagggaaguuacgacacaaugauauagacaugacuacaguaaacacggaugacuucucccgucuccaugcuaaggaagaacuagaucuagaacuaauuacauucuucgccuccacaaacauggagcuaaauaaaauauuuucaagagaaaauauuaacaacgacgaaaacauagacuuuuucggcggcgaucgagaaaaaaacuacguacuggauaaaaaaauuuugaacucaaaaauaaaaauaaucagagaucucgacuuuaucgauaacaaaaacaacaucaccaacaacuucauacguaaguucaccaaaauagguacaaacgaaagaaacagaauauuacaugcaauaaguaaagagcgcgaucuacagggaacacaagacgauuauaauaaagucauaaauaucauccaaaacuugaaaauaucagaugaagaggucucaaaggcacuaaaccuagacguaguauucaaagacaaaaaaaacauaaucaccaaaaucaacgacauaaaaauaucagaagaaaauaacaacgacauaaaguaucuuccaucauucagcaaaguacucccugaaauauuaaaccuauacaggaacaacccuaaaaacgaaccauucgacaccaucgaaacagagaaaauaguauugaaugcccuuaucuacgucaacaaggaauuauacaaaaaacucauacuugaagacgauuuagaagaaaacgaguccaaaaacauauuccuacaagagcucaaaaagacguuaggcaauauagaugaaauagaugaaaacauuauagaaaauuauuacaagaaugcgcaaauaucagcaucaaaaggcaacaauaaagccauaaaaaaauaucaaaaaaaagucaucgaaugcuauauaggguaccuacgaaaaaacuaugaagaacuauucgacuucagugacuucaaaaugaauauccaagaaauaaaaaaacaaauaaaggauauaaacgacaacaaaacuuacgagagaaucaccguuaaaacauccgacaaaacgauaguaauuaaugaugauuucgaauacauaauaagcauuuucgccuuacucaacagcaacgcagugauaaauaaaauacgaaacagauucuuugcaacauccgucuggcuaaacacaucagaauaucaaaauaucauagacauacuggacgaaauaaugcaauuaaauacacuaagaaacgaguguaucacagaaaacuggaaccuaaauuuagaagaauuuauacaaaaaaugaaagaaauagaaaaggauuuugaugacuuuaagauacaaacaaaaaaagaaauuuucaauaacuauuaugaagacauaaaaaacaacauccuaacggaauuuaaggacgauaucaacggaugugacguucuugagaaaaaacuagaaaaaauaguaaucuucgaugacgaaaccaaauucgaaaucgauaaaaaaucaaacauacuacaggaugaacaaagaaagcucucaaacaucaacaaaaaagaccucaaaaaaaaaguagaccaauauauaaaagauaaagaucaagaaaucaaauccaagauacuaugcagaauaauauucaauucagacuuuuuaaaaaaauauaaaaaagagauagacaaccuaauagaggacauggaaagugaaaacgaaaauaaauuucaagaaauauacuauccuaaagaacgaaaaaacgaguuauacauuuauaagaaaaacuuauuccugaacauaggaaauccuaacuucgacaaaaucuauggccuaauaagcaacgacaucaaaauggcagaugcaaaauuuuuauucaacaucgaugggaaaaacauuagaaaaaacaagauaucugaaauagacgcaauccuuaagaaucuaaacgacaaacucaacggauauaguaaagaauacaaagaaaaguauauaaaaaaguuaaaagaaaaugacgauuucuuugcaaaaaacauacaaaauaaaaacuacaagucguuugaaaaagacuacaaccgcguaagugaguacaaaaaaauaagagaucuuguagaauuuaacuaucuaaacaaaauagaauccuaccucauagacauaaauuggaaacucgccauacaaauggcacgauuugaacgagacaugcauuacaucguaaauggauuaagagaauuagggauaauaaaauuauccggcuacaacacagggaucucaagagcauauccgaaaagaaauggauccgacggauucuauaccacaacagcauacuauaaauucuuugacgaagaaaguuacaaaaaauucgaaaaaaucugcuacggauucgguauagacuugagcgagaacuccgagauuaacaaaccagaaaaugaaucaauacguaauuacauaucccacuucuacauagugaggaaccccuucgcagacuauagcaucgcagaacaaaucgacagaguuaguaaucuuuugucauauagcacaagauacaacaauucaacauacgcaucaguauucgaaguauucaaaaaagacgucaaucuagauuacgaugaacuaaagaaaaaauucaaacucauaggcaauaacgacauacuagaaagacugaugaaaccaaaaaaggucucuguacuugaacuugaaucauacaauagugauuacauaaagaaccuaauaaucgagcuccuaacaaaaaucgaaaacacaaacgacacacuauaa

SEQ ID NO: 11855 - RNA, 4305 nt, Artificial Sequence
  Cas13a variant__Leptotrichia shahii__WP_018451595.1__Cas13a(long)
augggaaaccuuuucggacauaaacgaugguacgaaguccgggauaaaaaagauuuuaaaauaaagagaaaaguaaaaguuaagcgcaacuacgacggaaacaaauacauacucaauaucaacgaaaacaacaauaaggagaaaauagacaacaauaaauucauccgcaaauauauuaacuacaaaaaaaaugacaacaucuuaaaagaauucacaagaaaauuucacgcaggcaacauauuauucaaacuaaaaggcaaagaaggaauaauacguauagaaaacaaugaugacuuccuugagaccgaagaagucguauuauauauagaagccuacggaaaaucagaaaaacucaaagcccugggaauaaccaaaaaaaaaauaaucgacgaagcaauaagacaaggcauaacaaaagacgacaaaaaaaucgaaauaaaaagacaagaaaaugaagaagagauagaaaucgacauacgagacgaauacacaaauaagacccucaacgacugcucgauuauacuaagaaucauagaaaaugaugaauuagaaacaaaaaaaucuauauacgaaaucuucaagaacauuaauaugucacuguacaaaaucauagagaaaauaauagaaaacgaaaccgaaaaaguauucgaaaaucgauauuaugaggaacauuuacgugaaaaauuguuaaaggacgacaagauagacguuauauuaacaaacuuuauggaaauccgugaaaaaauaaaauccaacuuagaaauauuaggauucguaaaauucuaccugaacguuggaggugauaaaaaaaaaucuaaaaauaaaaaaaugcuaguagaaaaaauauugaauauaaauguggauuuaacuguagaagacaucgcugacuucguaauaaaggaacuagaauucuggaacaucacgaaacgaauagaaaaaguaaaaaaaguuaauaaugaauucuuagaaaaacgaagaaauaggacauacauaaagucauauguacuccuagauaagcaugaaaaauucaagaucgaaagggaaaauaaaaaagauaagauaguuaaauucuuuguagaaaacauuaaaaauaacagcauaaaagaaaaaauagagaaaauacucgcggaauuuaaaauagaugaacugauaaaaaaacuggaaaaagaguuaaaaaaaggaaacugugauacagagauauuugggauauuuaaaaaacacuacaaaguaaauuuugauucaaaaaaauuuagcaagaaaucugaugaagaaaaagaacuuuauaaaauuauauacagauacuugaaaggaagaaucgaaaaaauccuagucaaugaacaaaaaguacgacuaaaaaaaauggaaaaaauagagauagagaaaauucucaaugaaagcauucuaagcgaaaaaaucuuaaaaagaguaaaacaauacacacuggaacauaucauguaccuggguaaauuaagacauaacgacauugacaugacaaccgucaacacagacgacuuuuccagauuacacgcaaaagaagaauuagaccuagaauuaaucacauucuucgcaucgacuaauauggaacucaauaagauauucagccgagaaaauaucaacaaugaugaaaacauagauuucuucggcggagauagggaaaaaaacuauguacucgacaaaaaaauauuaaauucuaaaaucaaaauaauuagagauuuagacuucauagauaacaagaauaauauaacaaauaacuucauaaggaaguucacgaaaauaggaacaaacgaaaggaacagaauacuacacgcaauaaguaaagaacgagaccuacagggaacacaagaugauuacaauaaaguuauaaacauaauacaaaaucucaaaaucucagaugaagaaguuaguaaagccuuaaaccuugacgucguguucaaagacaaaaaaaacaucaucacgaaaauaaaugacauaaaaaucucugaagaaaacaacaaugauauaaaauaucuaccgaguuucucuaaaguacuaccugaaauauugaaccuauaccgcaacaacccaaaaaacgaaccuuucgacacuauugaaacagaaaaaauaguacucaacgcgcuuauauauguaaauaaagaacuauacaaaaaauuaauacuggaggaugaccuagaggaaaacgaaucaaaaaacauauuucuucaagaacuaaaaaaaaccuuaggcaacauagaugaaauagaugaaaauaucauagagaacuauuacaagaacgcccaaauauccgcaucaaaaggcaauaauaaagccauaaaaaaauaucaaaaaaaagugaucgaauguuacaucggauaccugcgcaaaaacuaugaagaacuuuuugacuucuccgauuuuaaaaugaauauacaagagauaaaaaaacaaauaaaagauauaaaugacaacaaaacauacgaacgaaucacagucaaaacaagcgacaaaacaauagucauuaacgaugacuuugaguacauaauuucaauuuucgcacuacuaaacagcaaugccguaaucaauaaaauacgaaaccgauucuuugcaacaucaguauggcucaacacuucagaguaucagaauauaauagauauauuagacgaaaucaugcaauugaacacacuaagaaacgaaugcauaaccgagaauuggaaucucaaucuagaggaauucauacaaaagaugaaagaaauagaaaaagauuucgacgacuucaaaauacaaacaaagaaggaaauauuuaauaacuacuacgaagauauaaaaaauaacauacugacagaauuuaaggacgacaucaaugguugcgacguauuagaaaaaaaacuagaaaaaauugucauauuugaugaugaaacaaaauucgaaaucgacaaaaaaucuaacaucuuacaagacgagcaaagaaaauuaucaaauauaaacaaaaaagaccuaaaaaaaaaaguagaucaauacaucaaagauaaagaucaagaaaucaaaucgaaaauccuauguagaauuaucuucaacucagacuucuuaaaaaaauauaaaaaggaaauagacaaccuaauagaggacauggaaucagaaaaugaaaacaaguuccaagaaauauacuacccgaaagaaagaaaaaacgaacucuauaucuauaaaaagaaccuauuccucaacauuggaaauccgaacuucgacaaaauauacggacuaaucucaaaugauaucaaaauggcugaugcgaaauuccucuucaauauagacgggaaaaacauuagaaaaaacaaaauaucagagaucgaugcaauacuaaaaaauuugaacgacaaacucaacggauauucaaaagaauacaaggaaaaauacauaaaaaaauugaaagaaaaugaugacuucuuugcaaagaauauacaaaacaaaaauuacaaaagcuuugagaaagauuacaaccgagucagcgaauauaaaaagauacgagacuugguagaauuuaauuaccuaaauaagauugagucauauuuaaucgacauaaauuggaaacuagcaauccaaauggcccgauucgaacgagacaugcacuacauaguaaauggcuuaagagaacucggaauuauaaaauuaaguggcuauaauaccgguaucaguagagcauaccccaaaagaaauggcucggacggauuuuacacgaccacagccuauuacaaauucuucgacgaagaaucuuacaaaaaauucgaaaaaauaugcuacggguuuggaauagaucucagcgaaaauucggagauuaauaaaccagaaaacgagucaauacgaaauuacaucagucacuuuuacauaguaagaaaucccuucgcggauuacucaauagcagaacaaauagaccguguuucaaaccuccucagcuauucuacacgguacaacaacucaacauacgcaagcgucuucgaagucuucaaaaaagacguuaaccucgacuacgacgaacuaaaaaaaaaguucaaauuaauaggcaacaacgauauucuagagagauuaaugaaaccaaagaaaguaagcgucuuagaacuagaaucauauaacagugauuacauaaaaaauuuaauaauagaacuacuaaccaagaucgagaauacuaaugacacacuaaagcguccagccgcgaccaagaaggcaggucaagcuaaaaaaaaaaaaggaagcuacccuuaugacguaccggacuacgcauacccuuaugacguaccagacuacgcuuacccauacgacguaccagacuacgcuuag

SEQ ID NO: 11856 - RNA, 4158 nt, Artificial Sequence
  Cas13a variant__Leptotrichia sp. oral__WP_021744063.1__Cas13a
augggaaaucuauuuggacacaaaaggugguaugaaguacgcgacaaaaaagacuucaaaauaaagcguaaaguaaagguaaaacgaaauuacgacggcaacaaauacauacuaaacaucaaugaaaacaauaacaaagaaaagauagacaauaacaaauucauaggugaauucgucaacuacaaaaaaaacaauaacguauuaaaagaauucaaaagaaaauuccaugcagggaacauacucuucaagcuuaaaggaaaagaagaaauaauaagaauagaaaauaaugacgauuuccuagaaacagaagaaguaguacuauauauagaagucuauggaaaaagcgaaaaacuaaaagcacuagaaauaacuaaaaagaagauaauagacgaagcaaucagacaaggaaucacaaaagaugauaagaaaauugaaauuaaaagacaagaaaaugaagaagagauagagauagacauacgcgacgaauauacaaacaaaacauuaaacgauugcucaaucauccuaaggaucauagaaaaugaugaacuugagacaaagaaaucaauauacgaaauauuuaagaacaucaacaugagucucuacaaaauaaucgaaaaaaucauagagaaugaaacugagaaaguauucgaaaaucgauauuacgaagaacauuugcgagaaaaacuacuaaaagacaacaaaaucgacguuauacucacaaacuucauggaaauuagagaaaaaaucaaaagcaaccuggaaauaaugggauuugugaaauuuuaccuaaacguaucaggugauaaaaaaaaaagcgagaacaaaaaaauguucguagaaaaaauacucaauacaaacguagaucucacaguagaagacaucguugacuuuaucguuaaagaacuaaaauucuggaauauaacaaaaagaauagaaaaaguaaaaaaauucaacaacgaauucuuagaaaacagaagaaacagaacauacauaaaaagcuacguacuucuagacaaacaugaaaaauuuaaaauagaaagagaaaacaaaaaagacaaaauaguuaaauuuuucguagagaacauaaaaaacaacucaauuaaagaaaaaaucgaaaaaauucuagcggaguuuaaaauaaacgaacuaauaaaaaaacucgaaaaagagcugaaaaaaggcaacugcgacacagaaauauucgguauauucaaaaaacacuauaaaguaaacuuugacuccaagaaauucucuaauaaaagcgaugaagaaaaagaacuauauaagauuaucuauagguaucuaaaaggaagaauugaaaaaauauuagucaaugaacaaaaaguacgacuaaagaaaauggaaaaaauagaaaucgagaaaauacuuaaugaaagcauacugagcgaaaaaauacugaagagagucaaacaauacacucuagaacacauaauguaccugggcaaacugagacacaacgacauaguuaagaugacuguaaacacagacgauuucucacgcuugcacgcgaaggaagaacuagaucuagaguuaauuacguuuuucgccagcacaaauauggaguuaaacaaaauauucaacggcaaagaaaaaguaacagacuucuuuggcuucaacuuaaauggacagaaaaucacucuaaaagaaaaagugccuucuuuuaaacuaaacauauuaaaaaaacuuaacuucaucaauaaugaaaacaacaucgacgaaaaacucagucacuuuuauagcuuccaaaaagaaggcuacuuacuuagaaauaaaauacuccauaacucuuaugguaacauacaagaaacaaaaaaccuaaaaggugaauaugaaaauguagaaaaguuaauaaaagagcucaagguuagcgaugaggaaauuagcaaaucgcuaaguuuagacguaauauucgaagguaaagucgacauaauaaacaaaaucaauaguuuaaagaucggggaauacaaagacaaaaaauaccuaccgucauucucgaaaaucgugcuagaaauaacacgcaaguuuagagaaaucaacaaagauaagcuauucgacaucgaaucagagaaaauuauacuaaacgcuguaaaauaugugaacaaaaucuuguacgagaagauuacuuccaacgaagaaaaugaguuucuaaaaacacucccagacaaacucguaaaaaaaucaaacaacaaaaaggaaaacaaaaacuuacuuucaaucgaagaauacuacaaaaacgcucaaguuagcucaucaaaaggagacaaaaaagcaauaaaaaaauaucaaaacaaaguaacaaaugcauaucuagaguaucuagaaaacacauucacugaaaucauagauuucagcaaauuuaaucuaaacuaugaugagauaaaaacaaaaaucgaagaaagaaaagauaacaaaucuaaaauaauuauagacagcaucucgacgaauauaaacaucacaaacgacauugaauacaucauaucaauuuuugcccuguuaaauucaaauacauacauaaacaaaauuagaaacagauucuuugcaacaaguguuuggcuagaaaaacaaaacggaaccaaggaauacgacuacgaaaacaucaucucaauacuggacgaaguacuccuaauaaaucuauuaagagagaacaacaucacugacauucuagaccucaaaaacgccauaaucgaugcgaaaauaguagaaaacgacgaaaccuacauaaaaaacuacauauucgaaucaaaugaagaaaaacugaaaaaacgauuauuuugcgaggaacuaguagacaaagaagacauccgaaaaauuuucgaagacgaaaacuuuaaauucaaaagcuucaucaaaaaaaaugagauaggaaauuucaaaaucaauuucggcauuuuaagcaaccuggagugcaacuccgaagucgaagcuaaaaaaauaaucgggaagaauuccaaaaaacuagaaagcuuuauacaaaacauuaucgaugaauauaaaagcaauauccgaacccuuuucaguagcgaauuccucgaaaaauacaaagaagaaauugacaaccucguagaggauacugaaagcgaaaauaaaaacaaauucgaaaaaauauacuaccccaaagaacacaaaaacgaauuauauauauacaaaaaaaaucuauuccucaacauagguaacccaaauuuugacaagauauaugggcuuauaaguaaagauaucaaaaauguagacacaaagauauuauuugaugaugacauaaaaaaaaacaaaauaucagaaaucgacgccauacucaaaaauuuaaaugacaaacuaaacggauauucgaacgacuacaaagcaaaguauguaaauaaacuuaaagaaaacgacgacuuuuuugcaaaaaauauccaaaaugaaaacuacaguagcuucggugaauucgaaaaagacuauaacaaaguuagcgaauacaaaaaaauucgagaccuaguggaauucaacuaccuaaacaagauagaaagcuaucuuauugacauaaacuggaaacuagcaauacaaauggcaagauucgagagagacaugcauuacauuguuaacggacuacgagaauuaggcauaaucaaacuaagcggauacaacacaggaaucagccgagcauauccuaaacgaaacggauccgauggauucuauacaacaacggcauauuacaaauucuucgaugaagaaaguuauaaaaaauucgaaaaaauauguuauggauuugguauagaucugucugaaaacucagaaauaaacaaaccagaaaacgaaucaauccguaacuauaucucucacuucuacauaguacguaauccauucgcagauuacucuaucgccgaacaaauagacaggguauccaauuuauuaagcuacagcacacgauauaacaacucuacguaugcaucaguuuuugaagucuuuaaaaaagauguaaaccucgauuacgacgaauuaaaaaaaaaauuucgacuaauaggaaacaacgacauacuggaaagauuaaugaaacccaaaaaaguaagcguacuugagcuagaaucauacaacucagacuacaucaaaaaucuaauaauugaacuacuaacaaaaauugaaaauacaaacgacacccuauaa

SEQ ID NO: 11857 - RNA, 3459 nt, Artificial Sequence
  Cas13a variant__Leptotrichia wadei__WP_021746774.1__Cas13a
augaaaguaaccaaaguagaugguaucucccacaagaaauauauagaagaagguaaauuaguaaaauccaccucagaggaaaauagaacaagugaacgccugagcgaauuacucaguauaagacuagacauauauaucaaaaauccagacaaugccagugaagaagaaaacagaauccgccgagaaaaucucaagaaauucuuuucaaauaaaguacuacaccuaaaagauucaguacuauaccugaaaaaucgcaaagagaaaaacgcaguacaagacaaaaacuauagcgaagaagauaucuccgaauaugaucuuaaaaauaaaaacucuuuuucgguacuaaagaaaauacuauuaaacgaagacgucaacucagaagaacuagagaucuuuagaaaagauguugaagccaaacuuaauaaaauaaauagcuuaaaauauagcuuugaagaaaauaaagcaaacuaccagaaaaucaacgaaaacaacguagaaaaaguuggagguaaaucaaaacguaauauaauauacgacuauuacagagaaagugccaaaagaaacgacuacauaaacaacguacaagaagccuuugacaaacuauacaagaaagaagacauagaaaaacuauuuuucuuaauagaaaauucaaagaaacacgaaaaauacaaaaucagagaauacuaccauaaaauaaucggcaggaaaaaugacaaagaaaacuuugccaaaauuaucuacgaagaaauucaaaacguaaacaauauaaaagaacuuauugaaaagauaccggacaugucagaacucaagaaaucacaaguauucuacaaauacuaccuugauaaagaagaacuaaacgacaaaaacaucaaauacgcguucugccacuuugucgaaaucgaaaugagucaacugcuuaaaaauuacguguauaaacgccuaucaaacaucucuaaugacaaaauaaaacggauauucgaauaccaaaauuuaaagaaacuaauagaaaacaaacuacucaacaaacucgacaccuauguaaggaacugcgggaaauauaacuacuaccuucaaguaggagaaauagccacuucagacuucaucgcuaggaacagacaaaacgaagcauuccuacgaaauauaauuggagucaguucaguagcauacuucucucuaagaaauauacuagaaacagaaaaugaaaauggaauaacaggacgaaugagaggaaaaaccgucaaaaacaacaaaggagaagaaaaauauguaucaggagaaguagacaaaauauauaacgaaaauaaacaaaaugaaguaaaagaaaaccucaaaauguucuacaguuacgacuucaacauggauaacaaaaacgaaaucgaagacuucuuugcaaacauagacgaagcaauaucaucaauuaggcacggaauagugcacuucaacuuagaauuggaaggaaaagacauauucgcauuuaaaaauauagccccaagcgaaauaagcaagaaaauguuccaaaacgaaauaaaugaaaagaaacuaaaacugaaaauauuuaaacaauuaaacuccgcaaacgucuucaauuauuaugaaaaagauguaaucauaaaauaccucaaaaauacaaaauucaauuucguaaauaaaaauauacccuucguaccuucguuuacaaaacuauacaauaaaauagaagaucuccggaauacauuaaaauucuuuuggagugugcccaaagauaaagaagaaaaagacgcacaaaucuaucuacucaaaaacauuuacuacggugaguuccuaaauaaauuugucaaaaacagcaaaguauucuucaaaauaacuaaugaaguaauaaaaauaaauaaacaacgcaaccagaaaacuggacacuacaaauaccaaaaauuugaaaacauagaaaagacaguaccaguagaauaccuagcuauaauacaaucacgagaaaugaucaacaaccaagacaaagaagagaaaaauacauacauagauuuuauucaacaaauauuccucaaagguuuuaucgacuaccucaauaaaaacaaccuaaaauauauagaaaguaauaacaacaaugacaacaaugauauuuucuccaaaauaaaaauuaagaaagacaacaaagaaaaauaugacaaaauacuuaaaaacuacgaaaaacacaacagaaacaaagagauaccacacgaaauuaacgaauuuguucgagaaauaaaauuaggcaaaauccucaaauauacggaaaaucucaacauguuuuaccuuauauugaaacuacucaaccauaaagaauuaacaaaucucaaagguucacuagaaaaauaccaaucagcaaauaaagaagaaacauucuccgacgaauuagagcuaauaaaccugcuuaaucuggacaauaauagaguaacagaagacuucgaauuagaagcgaaugaaauaggaaaauuccuugacuucaacgaaaauaaaauaaaagaccgcaaagaauuaaagaaauucgauaccaacaaaauauauuucgacggcgaaaacauuauaaaacaucgugcauucuauaacaucaagaaauacggaauguuaaacuuauuagagaaaaucgcagacaaagcaaaauacaaaauuagucucaaagaauuaaaagaauauucaaauaagaaaaacgagaucgagaaaaauuauaccaugcaacaaaacuugcaccguaaauacgcaagacccaagaaagacgaaaaauucaaugacgaagauuacaaagaauacgaaaaagccauaggaaacauucaaaaauacacacaucucaaaaacaaaguagaauuuaacgaacuaaaccuauuacaaggccuucuacuaaaaauccuccaucgauugguaggcuacacaaguaucugggaacgagacuuaagauucagacuuaaaggagaauuuccagaaaaucacuacaucgaagaaauauucaacuuugacaacuccaaaaaugucaaauacaaauccggucaaauaguugaaaaauacaucaacuucuauaaagaauuauauaaagauaacgucgagaaaagaucuauuuacagcgauaagaaagugaagaaacuuaaacaggagaagaaagaccuauauauccgaaauuauauagcacacuuuaauuauauaccacaugcagaaaucucacuacuggaaguucuagagaaccuccguaaguuacugucauacgacagaaaacucaaaaacgcaauaaugaaaucaaucguggauauuuugaaggaauacggguucguagcaaccuuuaaaaucggagccgacaagaaaaucgaaauacaaaccuuagagagcgagaaaauaguccaccucaaaaauuuaaagaagaagaaacuaaugacagaccgaaacucagaagaacucugcgagcuuguaaaagucauguucgaauauaaagcgcuagaauaa

SEQ ID NO: 11858 - RNA, 3459 nt, Artificial Sequence
  Cas13a variant__Leptotrichia wadei__WP_021746774.1__Cas13a(G403D)
augaagguuaccaagguugacggaaucucccacaaaaaauauaucgaagaagguaaauuaguaaaaagcacguccgaagagaaucggacauccgaacgucugucagaacuccuaucaaucagauuagacauuuauaucaaaaacccagacaaugcaagugaagaagaaaaccgcauccgacgagaaaaccuaaaaaaauuuuucuccaacaaaguacuacaucuaaaagauucaguacuuuacuuaaaaaauagaaaagaaaaaaacgcaguccaagauaaaaacuacucggaagaagacaucucggaauacgaucuaaaaaacaaaaacuccuuuagcgugcuaaaaaaaauacuacucaacgaagaugucaacucagaggaacucgaaauauucagaaaagacguggaagcaaaguuaaacaaaaucaacucacucaaauacucauucgaagaaaacaaagcaaacuaucaaaaaauaaacgaaaauaacgucgagaagguaggaggaaaaucaaaacgaaacauuauauacgauuauuacagagagucagcaaaaagaaacgacuacauaaauaacguccaagaagccuucgacaaauuguacaaaaaagaagacauagagaaauuauucuuucugauagagaacuccaaaaaacacgagaaauauaaaaucagggaauauuaccauaaaauaauugguagaaaaaacgacaaagaaaacuuugcaaaaauaaucuacgaagaaauacaaaacgucaacaacauaaaagaacugauagaaaaaauaccugacaugucagagcuaaaaaaaucacaaguauuuuacaaauacuacuuagacaaagaagaacuaaaugauaaaaacauaaaauacgcauucugucauuuuguugagauagaaaugagccaacuuuuaaaaaacuauguuuacaaaagacucucaaacaucucaaacgacaaaauuaaaaggauuuucgaauaucaaaauuuaaaaaaauuaaucgaaaacaaauuauuaaacaaauuagacacauauguuagaaacuguggcaaauacaauuacuacuuacagguaggagaaauugcaacaagugacuuuauagcaagaaacagacaaaacgaagcauucuuaagaaauauaaucggcguaagcuccgucgcuuauuucucccuaagaaacauacucgaaacagaaaacgaaaacgauaucacgggacgaaugagaggcaaaaccguuaaaaacaacaaaggagaagaaaaguacgucagcggagaaguggacaaaaucuauaaugaaaacaaacaaaaugaaguuaaagaaaauuuaaaaauguucuacucauacgauuucaacauggauaacaaaaacgaaauagaagacuuuuucgccaauauagaugaagcaaucaguucuauaaggcacggaauaguccacuucaacuuagaacuagaaggaaaagacauauuugccuucaagaacauagccccaucugaaauaaguaaaaaaauguuccaaaaugaaauaaacgaaaaaaaauuaaaacuaaaaaucuuuaaacaacuaaacagcgcaaauguguuuaacuacuacgaaaaagacguaauaauaaaauauuugaagaacacaaaauucaauuuuguuaacaaaaacaucccauuugugccuucauucaccaagcucuacaacaaaauugaagacuuaaggaacacgcuaaaguuuuucuggucaguuccaaaagauaaagaggaaaaagacgcacaaauauaccuacuaaaaaacauauacuacggagaguuccuaaacaaguucguuaaaaacucaaaaguuuucuuuaaaauaacaaacgaagugauaaaaauaaauaaacaaagaaaucaaaaaacaggucauuacaaauaccagaaauucgaaaacauagaaaaaaccguaccuguugaauaccuugcaaucauucaaaguagagaaaugauaaacaaccaagauaaagaagaaaaaaacacauacauugauuucauacagcaaauauuuuuaaaaggcuucauagacuacuuaaacaaaaacaaccucaaauacaucgaaagcaacaauaacaacgacaauaacgauauauuuagcaaaaucaaaauaaaaaaagacaacaaagaaaaauacgacaaaauauuaaaaaauuacgaaaagcauaacagaaacaaagaaauaccccaugaaauaaacgaauucgugcgagaaaucaaauuagguaaaauacucaaguacacugaaaaucuaaacauguucuaccuaauucuaaaacuucuaaaucacaaagaacuaaccaaucuaaaagguagcuuagaaaaauaucaaucggccaauaaagaagaaacauucagcgacgaacuagaacuaauaaaucuacuaaaucuagauaacaaccgaguaacagaagauuucgaacucgaagcgaacgaaaucgggaaauuccuagacuucaaugaaaauaaaauuaaagaccgaaaagaacuuaaaaaauucgacacaaacaaaauauacuucgacggagagaacaucaucaaacacagggcguuuuauaacaucaaaaaguacgguauguuaaaccuacuugaaaaaauagccgacaaagcaaaauacaaaauaagucuuaaagaacucaaagaauacuccaacaaaaaaaacgaaauagaaaaaaauuauaccaugcaacaaaaccuacaccgaaaauaugcucgcccgaaaaaagaugaaaaauucaaugacgaagauuacaaagaauaugaaaaagcaaucgguaauauccaaaaauauacacaccuaaaaaacaaaguagaauuuaacgaacucaacuuacuacagggacuuuugcuuaagauacuacaccgacuugugggguacacuaguauaugggagagagaccuaagauuucgacuaaaaggugaauucccggaaaaccacuacauugaagaaaucuucaauuucgauaauagcaaaaacguaaaguacaaaucuggccagauaguugaaaaauacaucaacuuuuacaaagaacucuacaaagacaauguagaaaagcguucuauauacucugacaaaaaaguaaaaaaacuaaaacaagaaaaaaaagaucuauacaucagaaauuacauagcacauuucaacuacaucccacaugccgaaaucucguuacuagaaguacuagaaaaucuaagaaaacuacuguccuacgaccgaaaauuaaagaaugcuauaaugaaaaguauaguugacauacuaaaagaguauggguucgucgccaccuuuaaaauaggagcagauaaaaaaauagagauccaaacauuagaaagugaaaaaauaguacauuuaaaaaacuuaaaaaagaaaaaacucaugacagacagaaacucagaagaauuaugcgaacucgugaagguuauguucgaauauaaagcucucgaauaa

SEQ ID NO: 11859 - RNA, 3909 nt, Artificial Sequence
  Cas13a variant__Leptotrichia wadei__WP_021746774.1__6xHis-Tag/Twin-Strep/SUMO_Cas13a(G403D)
augggaucaagccaucaucaucaucaucauucaucuggcuuagugccacgagguagucacauggcuucauggagccacccucaguucgaaaaaggagggggaucaggaggaggaagcgguggaagcgccuggucacauccucaauuugaaaaaauguccgacucagaaguaaaccaagaggcaaagccagaaguaaaaccggaggucaaacccgaaacgcauauaaaucuaaaaguaucagauggaaguagugaaauauucuuuaaaaucaaaaaaacgacaccccuccgaagauuaauggaagcuuuugccaaacgacaaggaaaggaaauggacaguuuaagauuucuuuacgauggaauaagaauacaagccgaccagaccccugaagaccuagauauggaagacaacgauauaauagaagcacaccgcgaacaaauagggggaagcaugaagguaacgaaaguagacgggaucagccacaaaaaauacauagaagaaggcaaacuaguaaaaaguacaagcgaggaaaaucgcaccucugagagacuaagcgaacuauuaucaauucgacuagacauauacauaaaaaauccggauaaugcuagugaagaagaaaaucgcauccgaagagaaaacuugaaaaaauucuuuucaaauaagguacuacaucugaaagacuccguauuauauuuaaaaaaccgaaaagaaaagaaugcaguacaagauaaaaacuacuccgaagaagauauaucagaauacgaccuaaagaacaagaacagcuuuaguguucucaaaaaaaucuuauuaaacgaagacguuaacucagaagaauuagaaauauuccggaaagacguugaagcaaaacuuaacaaaaucaauucacuuaaauacucauucgaagaaaacaaagccaacuaucaaaaaauaaacgaaaauaacguagaaaaaguaggcggaaagucaaaaaggaacauuauauacgauuacuauagagaaagcgccaaaagaaaugacuauauaaauaauguccaagaagccuucgacaaauuauacaaaaaagaggauaucgaaaaacuuuuuuucuuaaucgaaaacucgaaaaaacacgagaaauauaaaauccgagaauauuaccauaaaauaaucggccgaaaaaaugauaaggagaauuuugcuaaaauaauauaugaagaaauucagaauguaaauaauauaaaagaacuaaucgaaaaaauaccagacauguccgaauuaaaaaaaucucaaguauuuuacaaauacuaccucgauaaagaagaacuaaaugauaaaaauauaaaguaugcuuucugccauuucguagaaauagagaugucucaauuacuuaaaaauuacguauacaaacgacuuucgaacauaucaaacgauaagauaaagcguauauuugaauaucagaaccuaaaaaaacuaauugaaaauaaacuccucaauaaacucgauacauacguacgaaacugcggaaaauacaacuacuaccuucaaguaggugagauagcaacaagugacuucauagcaagaaauagacaaaacgaagcauuccugcguaacaucauaggaguaagcagcgucgcauacuucagucugcgaaacauacuagaaaccgaaaaugaaaaugacauuacagguagaaugcgcggaaaaacugucaaaaauaacaaaggcgaggaaaaauacguaagcggcgaaguagauaaaauauacaacgaaaacaagcagaacgaaguaaaagaaaaccuaaaaauguucuacucuuacgacuucaauauggacaacaaaaacgaaauagaagacuucuucgccaauauagacgaagcaauaucaucaauacgacauggaaucguacacuucaaucuagaacuagaagggaaagacauauuugcauuuaaaaacauagccccaucagaaauaucaaaaaagauguuccaaaacgagauuaaugaaaaaaaauuaaaacuuaaaauauucaaacaacucaacagcgcuaacguguucaacuacuaugaaaaagacguaaucauuaaauacuuaaagaacacaaaguucaacuuuguaaacaaaaacauacccuucgucccaucauucacaaaacuauacaauaagaucgaagaucuaagaaauacacuaaaguucuucuggucaguacccaaagauaaagaagaaaaagaugcacaaauauaccuauuaaaaaacaucuauuacggagaauuccucaacaaauucgucaaaaauucaaaaguauucuucaaaauaacaaacgaaguaauaaaaaucaacaaacagagaaaccaaaaaaccggacacuauaaauaccaaaaauucgaaaacaucgaaaaaacagugccaguugaauaccuagcaauaauucaaucaagagaaaugauaaacaaccaagauaaagaagagaaaaauacuuacaucgacuucauucaacaaauauuccucaagggcuuuauagacuacuuaaacaagaauaacuuaaaauacaucgaaagcaacaauaacaacgacaauaacgacauauuuucgaaaaucaagauaaaaaaagacaauaaagaaaaauacgauaaaauacuuaaaaacuacgaaaagcauaauagaaacaaagagaucccacacgaaauaaaugaauuuguaagagaaauaaaacuagggaagauacuaaaauacacagaaaaccucaauauguucuaccuaauacuaaaacuguuaaaccauaaagaacuuacaaaucuaaaaggaagccuagaaaaauaucaaucagcaaacaaagaagaaaccuucuccgacgaacuagaacuaauaaaccuacucaaucucgauaacaacaggguaacugaagauuuugaacuagaagcaaacgaaauagggaaauuucuagauuuuaaugaaaacaaaauaaaagaccguaaagaacuaaaaaaauucgauacgaauaaaauuuacuucgauggcgaaaacauaauuaaacacagagcauucuauaacauaaagaaauacgguauguuaaaucuuuuagaaaaaauagcagauaaagcaaaauauaaaauaagccuaaaagaacuaaaagaauacaguaacaaaaaaaacgagauugaaaaaaacuacacaaugcaacagaaccuacaccguaaauacgcccgaccgaaaaaagacgaaaaauucaacgaugaagacuacaaagaauacgagaaagcaauaggcaacauacaaaaauacacgcaucuuaaaaauaaaguagaguucaacgaauugaacuuacuacaaggcuuacuauuaaaaauccuccacagauugguaggauauacaagcauaugggaacgagaucuccgauucaggcuaaaaggcgaauucccagaaaaucauuauauugaagaaauauucaauuucgauaauaguaaaaacgugaaguauaaaucaggucaaauaguagaaaaauauaucaacuucuauaaagaacuauacaaagauaauguagaaaaaagguccauauacucagacaaaaaaguaaaaaaacuaaaacaagaaaaaaaagacuuguacauucgaaacuauauagcacacuucaacuauauaccacacgcagaaauaucguuacuugaaguauuagagaauuuaaggaagcucuuauccuaugacagaaaauugaaaaacgcaauaaugaagucaauaguugacauacucaaggaauacggcuuuguagcaacauuuaaaauaggagcugacaaaaaaauugaaauacaaacacuggaauccgaaaaaauaguacaucucaaaaaucuaaagaaaaaaaagcuaaugacagaucguaacucagaagaacuaugugaacuaguaaaaguaauguucgaauauaaagcccuugaguag

SEQ ID NO: 11860 - RNA, 3459 nt, Artificial Sequence
  Cas13a variant__Leptotrichia wadei__WP_021746774.1__Cas13a(R474A,R1046A)
augaaaguaacaaagguggaugggaucucacacaaaaaauauaucgaagaagguaaacuaguuaaauccaccucugaagaaaaccgaaccucugaacgacucagcgaacucuuaagcauacgauuagauauauauauaaaaaacccagacaacgcaucggaagaagaaaacagaauaagacgcgaaaaccuaaaaaaauucuuuucaaacaaaguacuccaccuaaaagauucuguauuauaucuuaagaauagaaaggaaaaaaaugcaguacaagacaaaaacuacucagaagaagacauuucagaauaugaccugaaaaacaaaaacaguuucaguguuuuaaaaaagaucuuacugaaugaagauguaaauucagaagaauuagaaauauuucgaaaagacguugaagcaaaacuaaacaaaauaaauaguuuaaaauacuccuucgaagaaaacaaagccaacuaccaaaaaauaaacgaaaacaauguagaaaaggucggaggaaaaucuaaaagaaauauaauauacgacuauuauagagagagcgccaaacgaaaugacuauauaaauaacguacaagaagcauucgacaaauuauacaaaaaggaagauaucgagaaacuuuucuuccugauagagaacucuaaaaaacaugaaaaguauaaaauacgggaauauuaucauaaaauaauagggagaaaaaacgacaaagaaaacuucgcaaaaaucauauacgaagaaauccaaaacguuaacaacauaaaagaacucauagagaaaauaccagacaugagcgaacuaaaaaaaucccaggucuucuacaaauacuaccucgacaaagaagaauuaaaugacaaaaacauaaaauacgcauucugccauuucguagaaauagaaaugucucaacuauuaaaaaacuauguauacaagcgacuuuccaacauaucaaacgacaaaauaaaacgcaucuucgaauaccaaaaucucaagaaacuuauagaaaacaaacuacuaaauaaauuggacacauauguaagaaacugcggaaaauacaauuacuaccuccaaguaggagaaauagcgaccucggacuucauugcgcgaaacagacaaaacgaagcauuuuugagaaauauuaucgggguuucauccguagcuuauuuuagcuuacgaaacauccuagaaacugaaaacgaaaauggaauaacaggccguaugcgaggaaagacagucaaaaacaacaaaggagaagaaaaguauguaucaggagaaguagacaaaauauacaaugaaaauaaacaaaaugaaguaaaagaaaaccuaaaaauguuuuacucauacgauuuuaauauggacaacaaaaacgaaaucgaagacuucuucgcaaacaucgacgaagccaucagcuccauagcgcacgguauaguccauuuuaaccucgaacuggaaggaaaagauauauuugcauuuaaaaauaucgcaccuucugaaauuucaaaaaaaauguuucagaacgaaauaaaugaaaaaaaacuaaaacuuaaaauauuuaaacaacuaaacagugcaaaugucuuuaacuauuacgaaaaagacgucauaauaaaauaccuaaaaaacacaaaauucaacuucgucaauaaaaacaucccauucguuccaagcuucacuaaacuauauaacaaaauugaagaucucagaaacacccucaaauucuuuuggucaguacccaaagauaaagaagaaaaagaugcacaaauauaccuacuaaaaaacauauacuacggggaauuccuaaacaaauuugucaaaaauaguaaaguauuuuuuaaaauaacaaaugaaguaaucaaaauaaacaaacaacggaaccaaaaaacgggucauuauaaauaccaaaaauucgaaaacauagaaaaaacaguccccguagaauaucucgcaauaauccaauccagagaaaugauuaacaaccaagacaaagaagagaaaaauaccuauauagacuucauccaacaaaucuuccuaaaagguuucaucgauuaccucaacaagaacaaccuuaaauacauugaaagcaauaacaacaacgacaacaacgacauauucagcaaaaucaaaauaaaaaaagacaacaaagaaaaauacgacaaaauuuuaaaaaacuacgagaagcacaacagaaauaaagaaaucccacaugagauaaacgaguucguuagagaaauaaaacuaggaaaaauacuuaaauacaccgaaaaccuuaauauguucuaucuaauacucaagcugcuaaaucacaaagaacuaacaaaccucaaaggauccuuagaaaaauaucaaucagcuaacaaagaggaaaccuucucagaugagcuagaacuaauuaacuuauuaaaucuagauaacaacagaguaacagaggacuuugaacuagaagccaaugaaauagggaaauuuuuagauuucaacgaaaauaagauaaaagauagaaaagaauuaaaaaaauucgauacaaacaaaauuuacuuugacggggaaaacauuaucaaacacagagcauucuacaacauaaaaaaauacggcaugcuaaaucuacuagaaaaaauagcagacaaagcaaaauauaagauaagccucaaagagcuaaaagaauacucaaacaaaaaaaacgaaauugaaaagaacuacacaaugcaacaaaaccuacauagaaaauacgcccgaccaaaaaaagacgagaaguucaacgacgaagacuacaaggaauaugaaaaagcaauagggaacauacaaaaauacacacaccuuaaaaauaaaguggaauuuaacgaauuaaaccuacuacaaggacuauuacugaaaauccuacauagacuaguaggauacaccagcauaugggaacgagaucuacguuucagacucaaaggcgaauucccagaaaaucauuauauagaagaaaucuucaacuuugauaauucaaaaaacguaaaauacaagucaggacaaauaguagaaaaauauauaaauuuuuacaaagaacuauacaaagauaacguugagaaacgcagcauauacucagauaaaaaaguaaaaaaacuuaaacaagaaaaaaaggaccuguacauagcaaacuauauagcacacuucaacuacauuccucaugcugaaaucagcuugcucgaaguccuggaaaaccuaagaaaauuacuaaguuacgacagaaaacuaaaaaacgcaauaaugaaauccauaguagauauacuaaaagaauacggauucguagcaaccuucaaaauuggagcggacaaaaaaauagagauucaaacccucgaaagcgaaaaaauuguacaccuaaaaaacuuaaaaaaaaaaaaacugaugacagacagaaacagugaagaacuaugugaacuaguaaaagucauguuugaauauaaagcauuagaauaa

SEQ ID NO: 11861 - RNA, 5073 nt, Artificial Sequence
  Cas13a variant__Leptotrichia wadei__WP_021746774.1__XY_Cas13a(R474A,R1046A)_EGFP_ZF-CCR5T_KRAB -A _NLS
augggaggggaagggcuuagggccucuccuagaagacgaccacuauuacccuuacaaccgaggggaugcccucgaggugauggaugucuuagaggaggaaggggacgagccggguuugguuuuuggagaguaaccggaggaagccgagcaucugccaaccauguucacgccuucuuuuucuuccuucaauuacuagggaacgucuuagugauuguauuaagucaucacuucgggaaagaauuuggaacugcaggacccggggcaacaaugaaaguaacaaaaguugacggaauaucacauaagaaauauaucgaagaaggcaaauugguaaaaucgacaagugaagaaaaccgaacaucagaacgacuaucagaauuacuaagcaucagacuagacauauacaucaaaaacccggauaacgcaagcgaagaagaaaacaggauaaggagagaaaaucuaaagaaauucuuuuccaauaaaguccugcauuuaaaagacucgguacuauauuugaaaaauagaaaagagaaaaacgcaguacaagacaaaaauuacuccgaagaagacauaucugaauacgaccuaaagaauaaaaauucuuucucagugcuaaagaaaauacuacuaaaugaagauguaaauagugaagaauuagaaauauuccgcaaagacgucgaagccaaacuaaacaaaauaaacucauuaaaauacaguuucgaagaaaauaaagcaaacuaucagaaaaucaacgaaaauaauguugaaaaaguaggagggaaaaguaaaagaaauauaauauaugauuauuauagagaaucagcaaaacgaaacgacuauauaaacaauguccaagaggcuuuugacaaacuauauaagaaagaggacauagagaaacuauucuuucucaucgaaaauaguaagaaacacgaaaaauacaaaauaagggaauauuaucacaaaaucauuggcaggaaaaaugauaaagagaacuuugccaaaauaauauaugaagagauacaaaacguaaauaacauaaaagaacugauagagaaaauccccgauaugucagaauuaaagaaaagucaaguauuuuauaaauacuaccuagauaaagaagaacuaaaugacaaaaauaucaaauacgccuucugccauuucguggaaauagaaaugucccaacuacucaaaaacuacguauacaaaagguuaaguaacauaucaaaugauaaaauaaaaaggauauuugaauaucaaaaucuaaagaaacugaucgaaaacaaauugcuaaacaaacuagauacauauguccgaaauugcggaaaauacaacuauuaccuacaagugggcgaaauagcaacuucggacuucauagcaagaaauagacaaaaugaagcauucuugagaaauauaauaggaguuucuaguguagcguacuuuucacuaaggaauauucuugaaaccgaaaaugaaaacggaauaacuggacguaugcgagggaaaacagucaaaaacaacaaaggagaagaaaaauauguuagcggagaagucgacaaaauuuacaacgaaaauaaacagaaugaagucaaagaaaacuugaaaauguuuuauucauacgacuuuaauauggacaacaaaaaugaaauugaagacuuuuucgccaauauagaugaagccauauccaguaucgcccacgggauaguacacuuuaauuuagaacuagaaggcaaagacaucuuugcauucaaaaauaucgcuccuagugaaauuucuaagaaaauguuccaaaacgaaauaaacgaaaagaaacuaaaacuaaaaaucuucaaacaacuuaauucagcaaacgucuucaacuacuacgaaaaagacguuauaauaaaauaucucaaaaauacgaaauucaacuucguuaauaaaaauauaccauuuguaccaucguucacaaaauuguauaacaaaauagaagacuuaagaaauacccuaaaauuuuucuggucaguaccuaaagauaaagaagaaaaagacgcacaaauauacuuacucaaaaauauauacuacggagaauuucuaaacaaauucguuaaaaauucuaaaguauucuuuaaaauaacaaaugaaguaauaaaaaucaauaaacaacguaaccagaaaacuggucacuacaaauaccaaaaauucgaaaauauagagaaaacaguacccguggaauaucuagcgaucauacaaagccgagaaaugauaaauaaccaagauaaagaagagaaaaacaccuacauagacuucauacagcaaaucuuccuaaaagguuucauagacuaccugaauaaaaauaauuuaaaauauauagaaucgaacaauaacaacgauaauaacgauauauucucgaaaauaaaaaucaaaaaggacaacaaagaaaaauacgacaaaauauugaaaaacuacgaaaaacauaacagaaacaaggaaauaccacaugaaaucaaugaguucguccgggaaaucaaacuaggaaaaauccuaaaauacacagaaaaucucaacauguucuacuuaauauuaaaacuccucaaucauaaagaacuaacaaauuuaaagggaagccuagaaaaauaccaaucggcaaacaaggaggaaacuuuuucagacgaacuagaacuuauaaacuuguuaaaucuagauaacaacagaguaacugaagauuucgagcuagaagccaacgaaaucggaaaauuccuggauuuuaacgaaaacaaaauaaaagacagaaaagagcugaagaaauuugacacgaacaaaauuuacuucgauggagaaaauauaaucaaacacagagcuuuuuacaauaucaagaaauacgguaugcuaaaucuucucgagaaaaucgcugauaaagcuaaauacaaaauuucucuaaaagaacuaaaagaauacucgaacaaaaagaaugaaauugagaaaaacuauacuaugcaacaaaaucuacaccguaaauaugcucgaccaaagaaagacgaaaaauuuaacgacgaagauuacaaagaauacgaaaaagccauaggaaauauacagaaauacacacaucugaaaaauaaaguagaguucaaugaacucaacuuacuacaagguuuacugcugaaaauccuacauagauugguaggauacaccucaauaugggaaagagaucuccgauucagacuaaaaggagaguucccagaaaaccauuacauagaagaaauuuuuaauuucgauaauuccaaaaaugucaaguauaaaucaggucagauugucgaaaaauauauaaacuucuauaaagaacuauauaaagauaacguugaaaaacgaucaauauauagugauaagaaaguuaagaaauuaaaacaagaaaagaaagaucuuuacauagcaaauuacaucgcacauuuuaacuauauaccgcaugcagaaauaaguuuacuggaaguacuagaaaacuuaagaaagcuccuuagcuacgauagaaaacucaaaaaugcuauaaugaaaucaauaguagacauucuaaaagaauauggauuuguagcaacauuuaaaauaggagcagacaagaaaauagaaauacaaacucucgaaucagaaaagauaguccaucucaaaaaccucaaaaagaagaaacuaaugacagaccgaaacuccgaagaacuaugugaacugguuaaagucauguucgaauauaaagcauuggaaggaggaggagggucuggcggaggaggaucuggaggaggaggcucgguuaguaaaggugaagaacuauucacgggcguagucccuauacuggucgaacuagacggagacguaaauggucacaaauucucaguuucaggagaaggggaaggagacgccacuuacggaaaacucacucuaaaauucauaugcacaaccggaaaauuacccgugccauggccaacucuuguaacaacauuaacauaugguguucaaugcuucuccagguacccagaccacaugaaacaacacgacuucuuuaaaucagcaaugccagaaggauauguacaagaaagaacaauauucuuuaaagaugaugggaacuauaaaacaagagcggaagucaaauucgaaggcgacacucuuguaaauaggauugaacuaaaaggcauugacuuuaaagaagacggcaauauacugggacauaaacuggaauacaauuacaauucccacaacguguacauaauggcagauaaacagaaaaauggaaucaaaguaaauuuuaaaauccgacauaacauagaagauggaagcguacaauuggcugaucauuaucaacaaaacaccccaauaggcgacggaccgguacuuuuaccagauaaucauuaucucaguacacaaagcgcacucagcaaagauccaaacgagaaaagagaccacaugguucuacuagaauuugugacagcagccggaauuaccuuaggaauggacgaacucuacucaagaggggcaggagcuggagccggagcaggagccggaucacgauuucaaugcagaauaugcaugagaaauuuuagugaucgauccaauuuaagccgacauauuagaacgcacaccggcgaaaaaccauucgcaugugauauaugcggccguaaauucgcaaucucuucaaacuuaaacucccauacaaaaauacauacagggucacaaaaacccuuccaaugccgaauaugcaugagaaacuuuucacgcucggauaauuuagcucgacacauccgcacccauacaggcgaaaaaccauucgcaugcgauauauguggacgcaaauucgcaacaagcgguaaccucacaagacacacaaagauucaucuacguggcucgcaacucagcauaguagacgcaccagaacaacgagagggagccucccaaguaucugucaguguaacauuugaagauguagcggugcuauucacgagagaugaauggaagaaauuagaccuaagccaaagaucauuauauagggaaguaaugcuagagaauuacucaaacuuagcuagcauggcgggaagucccaagaagaaaagaaagguuuaa

SEQ ID NO: 11862 - RNA, 3549 nt, Artificial Sequence
  Cas13a variant__Leptotrichia wadei__ERK53440.1__Cas13a
auguauaugaagauaacaaaaauugacggaguaagccauuacaaaaagcaagauaaaggaauacuaaaaaaaaaauggaaagaucuagacgaaagaaaacaaagagaaaaaauagaagcccgauacaacaaacaaaucgaaucaaaaaucuauaaagaauucuuccgccuaaaaaacaaaaaaagaauagaaaaagaagaggaccaaaacauaaaaucauuauauuucuucaucaaagaacuauaccugaacgaaaaaaaugaagaaugggagcucaaaaauauaaaccucgaaauccucgacgacaaagaaagaguaauuaaagguuacaaauucaaagaggauguauacuucuuuaaagaaggauacaaagaauacuaccuuagaauacuauucaauaaucuaauugagaaaguacaaaacgaaaacagggaaaaaguaaggaaaaacaaagaauuccucgaucuaaaggaaauauucaaaaaauacaaaaaccguaagaucgaccuacuccuaaaaagcaucaauaauaauaaaaucaaucuugaauauaaaaaggaaaauguaaacgaagaaauauacggcaucaacccaacaaacgacagagaaaugacauucuacgaauuacucaaagaaauaauagaaaaaaaagacgaacagaaaucaauauuggaggaaaaacuugauaauuucgacaucacuaacuuucucgaaaacauagaaaaaauauucaaugaagaaacggagauaaauauaauaaaaggcaaaguacuaaacgaacucagagaguauauuaaagaaaaagaagaaaacaacagcgacaacaaauugaaacagauauauaacuuagaacuaaaaaaauauaucgaaaauaacuucucauacaaaaaacaaaaaaguaagaguaaaaacggaaaaaacgacuaccuauaccugaacuuccucaaaaaaaucauguuuauagaagaaguagaugaaaagaaagaaauaaauaaagaaaaauucaaaaacaaaaucaacucaaacuuuaaaaaccuauuuguacagcacaucuuggauuacggcaaacuuuuauauuacaaagagaacgaugaauacauaaaaaacaccggacagcucgaaaccaaggaccucgaauacauuaaaacgaaagagacccuaauaagaaaaauggccguuuuaguaaguuucgccgccaacucauacuacaaccuguuuggacgugucucgggagauauucuaggaaccgaagugguaaaaucaaguaaaacaaacguaauuaaagugggcucacacauauuuaaggaaaaaaugcugaacuauuucuucgacuucgaaaucuucgacgcaaacaaaaucguagaaauauuagaaucaauauccuauucaauauacaacguacgcaacggaguaggacacuuuaacaaacuaauacucggaaaauacaaaaaaaaagauaucaauacgaauaaaagaauagaagaagacuugaauaauaacgaagaaauaaaaggcuauuucauaaaaaaaagaggagaaauagagcgaaaagucaaagaaaaguuucuaagcaacaaucuccaauacuauuauucuaaagaaaaaauagaaaacuacuuugaagucuaugaguuugaaauacuaaaacgaaaaauaccuuuugcuccaaacuucaaaagaaucauaaaaaagggagaagacuuauucaacaacaagaacaacaagaaauacgaauacuuuaaaaacuucgacaaaaacagcgccgaagaaaagaaagaauuccugaaaacuagaaauuuucuacuaaaagagcuauauuacaacaacuucuacaaagaauuucuaagcaaaaaagaagaauuugaaaaaauuguccucgaggugaaagaagaaaaaaagucuagagggaacaucaauaacaaaaagagcggcgugucauuucagucaaucgacgacuacgacacaaaaauaaacaucucagacuacaucgcaaguauacacaaaaaggagauggaacgaguggaaaaauacaacgaggaaaaacaaaaagacaccgccaaauauauucgagauuuuguagaagaaauauucuuaaccggauuuaucaacuacuuagaaaaagacaaaagacuacauuuccucaaagaagaauucucuauacuaugcaauaauaacaauaacgucguugauuucaacauaaacauuaaugaagaaaaaauaaaagaauuucucaaagaaaaugacucaaaaacacuaaaccucuaucucuucuuuaacaugauugauuccaaaagaauuagcgaauucagaaaugaacuaguaaaguauaaacaauuuacaaagaagcgacuagaugaagaaaaggaauuucuaggaauaaaaauagaacuauacgaaacacuaauagaauucguaauacuaacaagagagaaauuagauaccaaaaaaagcgaagaaauagaugcauggcuagucgacaaauuauacguuaaagacucaaacgaauacaaagaauaugaagaaauacuaaaacuuuucguagacgaaaagauccuaucgaguaaagaagcaccauacuacgcaacugacaacaaaacaccgauauuauuaagcaauuuugaaaagacacggaaauacggaacacaaagcuuucuaagugaaauacaaaguaauuacaaauacucuaaagucgaaaaggaaaauaucgaagacuauaauaagaaagaggaaaucgaacaaaaaaaaaaaucaaauauagagaaacuacaagacuuaaaaguagaauugcacaaaaaaugggagcaaaacaaaauaacagaaaaagaaauagagaaauacaacaacacaaccagaaagauaaacgaauauaacuacuuaaaaaacaaagaagaauuacaaaauguguaucugcuacaugaaaugcugagugacuuacuagcaagaaacguagcuuucuucaacaaaugggaaagggauuucaaauucauaguaauagcuaucaaacaauuccuacgagagaaugacaaagaaaaagucaacgaauuccucaacccacccgacaacaguaagggaaaaaaaguauauuuuucugucucaaaauacaaaaauacuguagaaaacauagacggcauccauaaaaauuucaugaacuuaauauucuuaaauaauaaauucaugaacagaaaaauagauaaaaugaacugcgccauauggguguacuucagaaacuacauagcucacuucuuacaucuccauacaaaaaacgaaaaaauaagucuaauaagccaaaugaaucuacucauaaaacuauucagcuaugacaaaaaaguccaaaaccacaucuuaaagagcacaaaaacacuacucgaaaaauacaauauccaaauaaacuucgaaauaucaaacgacaaaaacgaaguauucaaauauaagaucaaaaaucgauuauauucaaagaaaggaaaaauguuaggcaaaaacaacaaauuugaaauacuagaaaaugaauuccuugaaaauguaaaagccaugcucgaauauucggaauaa

SEQ ID NO: 11863 - RNA, 4158 nt, Artificial Sequence
  Cas13a variant__Clostridium aminophilum__WP_031473346.1__Cas13a
augaaauucucuaaaguagaucauacacgaucagcuguuggcauucagaaagccacagacagcguacacggaauguuauacaccgaccccaaaaagcaagaaguaaaugacuuagauaagagauuugaccaacuaaacguuaaggcaaaaagauuauacaacguuuucaaucaaagcaaagcagaagaagacgaugaugaaaagagguuuggaaaagucguuaagaaauuaaauagagaacuuaaagacuuacuauuucaccgagaaguuucuagauauaacagcauagguaacgcaaaauacaacuacuaugguaucaaaagcaacccagaagaaaucguaagcaaucuugguaugguagaaaguuuaaaaggagaacgcgauccacaaaaagugauaucuaaacuacuacuauauuacuugcgaaaagguuuaaaaccuggaacugacggcuuacggaugauacuagaagcaucaugcggccuaaggaaguugucaggagaugaaaaagaauuaaagguauuucuucaaacgcuugacgaagacuuugaaaagaaaacauuuaagaaaaacuuaauaagaucaauagaaaaucaaaauauggcgguacaaccaucaaacgaaggcgacccgauaauugguauaacacagggaagguuuaacucacagaaaaacgaagaaaagagcgcuauagaaagaaugaugucuauguacgccgaccuaaacgaagaucaucgagaagauguacuuagaaaacugagaagauuaaacguucuguacuuuaacguagacacagagaaaaccgaagaaccaacuuuaccuggcgaaguagacacaaacccaguauucgaaguuuggcacgaucacgaaaaaggcaaagaaaaugauagacaauucgcaacguucgcaaaaauauuaaccgaagaccgagaaaccagaaagaaagagaaacuagcugugaaagaagcacuaaacgaucuaaaaagugcaauaagggaccauaacauaauggcauaucgaugcuccauaaaaguaacagaacaggacaaagauggucuuuucuuugaagaucaaagaauaaauagauuuuggauccaucauauagaaagcgccguugaaagaauacucgcauccauaaacccugaaaaacucuauaaacuccgaauagguuaccuaggagagaaaguauggaaagaucuucuaaacuacuugucaauaaaauauauagcuguaggaaaagcaguauuccauuuugcgauggaagaccucggaaagacaggacaggacaucgaacuagguaaacuaagcaauagcguuaguggaggacuaacuagcuucgacuaugaacaaauaagggcagaugagacccuccaacgacaauuaucaguagaaguugccuucgcggcuaauaaucucuuccgcgcuguggucgggcaaacgggcaagaaaauugaacaaucaaaguccgaagaaaacgaggaagacuuuuuauuauggaaagccgaaaagauagcagaaagcauuaagaaagaaggcgagggaaauacacuuaaaaguauacugcaauucuuugguggagccaguucaugggaucuaaaucauuuuugugcugcuuauggaaacgaaucauccgcauuaggguaugaaacaaaauucgcagacgaccuucgaaaagccauauacucacuacguaaugaaacuuuccauuuuacaacacuaaacaaaggguccuuugacuggaaugcaaaauugauaggagauauguuuucccaugaagcagccacaggaauugcagucgaacgaacucgguuuuauucuaauaaucucccaauguuuuauagggaaucagaucucaaaagaauaauggaucaccuuuacaacacauaccaucccagagcgucacaagugccgagcuuuaauucagucuuuguaaggaaaaacuucagacuuuuccuaucaaauacccuaaauacuaacacuucauuugauacagaaguauaucaaaaaugggaaucuggugucuauuacuuauuuaaagaaauauacuacaacucauuccuaccaucuggugaugcccaccaccuauucuuugagggauuacgacgaauaagaaaagaagcagauaaucuaccuaucgucggcaaagaagcaaagaaaagaaacgcaguacaagacuuugguagaagaugcgacgaacuaaagaacuuaucacuaagugcuauaugccagaugauaaugacugaguacaaugaacaaaacaaugguaaucgaaaagucaaaaguacaagagaagauaaaagaaaaccugacauauuucagcauuacaaaauguuauuacucagaaccuuacaagaagcauuugcaauauauauaagaagggaagaguucaaauucauauucgaccuacccaaaacauuauauguaaugaaaccagucgaagaauuucuaccaaauuggaaaagcggaauguucgauucucuaguagaacgggucaagcaaucaccggaccuacaaaggugguauguauuauguaaguucuuaaaugggcggcuacucaaucaauuaagcggaguuauaagaaguuacauccaauucgcuggagacauacaaagacgagcuaaggcaaaccauaacagacuauauauggauaauacacaaagaguugaauacuauagcaacguacuugaaguaguagacuucugcaucaaaggaacaaguagauuuaguaauguguuuucugauuacuuccgagaugaagaugcauaugcagacuauuuagacaauuacuugcaauuuaaagaugagaaaaucgcugaaguuuccucuuuugcagcguugaaaacauuuuguaaugaagaagaagucaaagcgggaauauacauggauggggaaaaucccguaaugcaacguaacauuguaauggcaaaauuauucgggccagacgaaguucucaaaaacguugucccaaaaguuacacgagaagaaauagaagaauacuaccaauuagaaaaacaaauagcgccuuacagacagaacggauacuguaaaagugaagaagaccagaagaaguuauuaagauuccaaagaaucaaaaaucgaguagaauuucagacaauaacagaguucucagaaauaauuaacgaauuacuaggacaacuuauaucguggaguuuccuacgcgaacgagauuuacucuacuuucaacuaggcuuucacuacuugugucuucauaaugauacggaaaagccagcagaauacaaggaaauuucuagagaagacggcacuguaauuagaaaugcaauacuacaucaaguagcagcaauguauguugguggauuaccagucuauaccuuagcggacaagaaacuagcagcauuugaaaaaggugaagccgacuguaaauuaagcauaaguaaagauaccgcaggcgccgguaagaaaauaaaagacuucuuccgcuauagcaaauauguauuaauaaaagacagaauguuaacagaccaaaaccaaaaauacacuaucuaccucgcuggauuggaacuauucgaaaauacugacgaacacgacaauaucacugacguaagaaaauauguagaucacuuuaaauauuaugcaacauccgacgaaaacgcaaugucaauacuagauuuauauucagaaauacaugacagauucuuuacauaugacaugaaauaccagaaaaaugucgccaauauguuagaaaauauauuacugcgacacuuuguacuaauacgaccagaguucuuuacaggaaguaaaaaggucggagaaggaaagaaaauaacuugcaaagcaagagcacaaauagaaaucgccgaaaauggaaugcgauccgaagacuuuacuuacaaauuaucagacggaaagaaaaacauaucuacaugcaugauagcagcaagggaucaaaaauacuuaaacacaguggcaagguuauuauacuacccccacgaagcgaagaaaucaauuguugauacacgagaaaagaaaaauaauaagaaaacaaacagaggagacggcacauuuaauaaacaaaaggggacugccagaaaagaaaaagacaauggaccaagggaauuuaacgauaccgguuuuucaaacacuccauuugcaggguuugaucccuucagaaacaguuga

SEQ ID NO: 11864 - RNA, 4035 nt, Artificial Sequence
  Cas13a variant__Eubacterium rectale__CVRQ01000008.1__Cas13a
auguuacgcagagauaaagaaguaaagaaacucuauaauguuuucaaucaaauccaagucggaacaaaaccuaagaaauggaauaaugacgaaaaacucaguccugaagaaaaugaaagacgagcucaacagaaaaacauuaaaaugaaaaauuacaaauggagggaagcaugcaguaaauaugucgaaaguucacaacguaucauaaaugacguaauauuuuauucguaucguaaagcgaaaaauaaacuucgauacaugaggaaaaacgaagauauacuuaagaaaaugcaagaagcagaaaaacucaguaaauuuuccggcggaaaauuagaagauuuugucgcauauacauuaagaaaaucgcuuguaguaucaaaauacgacacacaagaguucgacagccucgcagcgauggucguauucuuagaauguauagggaaaaauaauauaucagaccaugaaagagaaauaguaugcaaacuauuagaauuaaucagaaaagacuuuucaaaauuagauccaaauguaaaaggaucacaaggagccaauauaguucguucaguaagaaaccaaaauaugauaguucaaccucaaggugauagauuuuuguucccccaaguauacgcaaaagaaaacgaaaccguaacaaacaaaaaugucgaaaaagaaggcuuaaacgaguuccuauuaaacuaugccaacuuagacgacgagaaaagagcagaaucguuaaggaaacuucggaggauacuugaugucuacuucagugccccgaaccacuaugaaaaagacauggacauaacauugagcgauaauauagaaaaagaaaaauuuaauguaugggaaaaacaugaaugugguaaaaaggaaacaggacuauuuguagacauacccgacguauuaauggaagcagaagcugaaaauauaaagcuagaugccguagucgagaaaagagaaaggaaaguauuaaacgaccguguuagaaaacaaaacauaauuuguuacagguacacgagagcuguaguagaaaaauacaauucaaaugaaccacucuucuucgaaaacaaugccauaaaccaauacuggauccaucacauagaaaaugcugucgaacguauauugaaaaacugcaaagcaggcaagcuauucaaacuacguaaagguuauuuagcagaaaaaguauggaaagaugcaauaaacuuaauaucuauuaaauauauagcguugggaaaagcuguguacaauuucgcauuagacgacauauggaaagauaagaaaaauaaagaacuaggaauaguagaugaaagaauaagaaauggcauaaccaguuuugacuaugaaaugauaaaagcacacgaaaaucugcagcgagaacuugcaguggacauagcauuuaguguaaacaacuuagccagagccguaugcgauaugucuaaccucggcaacaaagaauccgauuuucuccuauggaaaagaaaugauauagcagacaaauuaaagaauaaagaugauauggcaucagugucagccguccuacaauucuuuggaggaaaauccucaugggauauaaacauauuuaaagaugcauauaaaggcaaaaagaaauauaauuaugaaguacgauuuaucgacgacuuaagaaaggcaauauacugcgcaagaaaugaaaacuuucacuuuaaaacugcacucguaaacgaugaaaaguggaauaccgaacuuuuuggaaaaauauucgaacgggaaacagaguucugucucaaugucgaaaaagacagauucuauagcaauaaccucuauauguuuuaucaggucagcgaauugagaaauaugcucgaccacuuauacagccgcagcguuagcagagccgcccaaguaccaagcuauaacucuguaauaguaagaacagcauuuccagaauauauaacuaaugucuuaggcuaucagaagccaagcuacgacgcugauacauuagggaaaugguauucggcgugcuauuacuuacuuaaagaaaucuacuauaacaguuuccuccaaagugaucgcgcgcuccaacuauucgaaaaaucaguuaaaacgcuaaguugggacgacaagaaacaacagcgagcaguugauaacuucaaagaucacuuuucugauauaaaaucagcauguacgagccuugcucaaguaugucaaauuuacaugacagaauacaaccaacaaaacaaccaaauuaagaaaguucgcagcagcaacgacaguaucuuugaucaacccguauaccaacacuacaaaguauuacuaaagaaagccauugcaaacgccuucgcagacuaucucaaaaauaauaaagacuuauuugguuucauuggcaaacccuucaaagcgaacgaaauaagggaaauagauaaagaacaauucuuaccugacuggacgucaagaaaauacgaggcuuuaugcauagaagugaguggaucacaagaauuacagaaaugguauauuguagggaaauucuuaaacgcuaggagccuaaauuuaaugguuggcucaaugagaucauacauacaauacguaacagacauaaaacguagagcugcaaguauagggaaugaauuacacgucucuguacacgacguagaaaagguugaaaaauggguacaaguaauagaaguauguucauuacucgcaagucgaacaaguaaccaauuugaagacuacuucaaugacaaagaugauuacgcaagauaucuaaaaucauacguagauuuuucgaacguagacaugcccucagaauauucagcucuagucgacuuuucuaacgaagaacaaagcgaccuauauguagacccgaaaaacccaaaaguaaauagaaauauaguccacucuaaauuguuugcggcggaucacauccuucgcgauauuguagaaccaguaucaaaagauaauaucgaagaguucuauucacaaaaggcagaaauagcauauuguaaaauaaaaggaaaagaaauaacagccgaagaacaaaaagcgguacuaaaauaccagaaacucaaaaauagaguagaacuacgagauauuguugaauauggugaaaucauaaacgaacuuuuaggacaacuaauuaacugguccuuuaugagagaaagagauuuauuauauuuccaacuuggcuuucauuacgacuguuuaaggaaugauucaaagaaacccgaaggguauaaaaauauaaaaguagacgaaaacucuauuaaagaugcaauccuuuaccaaauaaucggcauguacguuaauggcguaacaguguacgcaccagaaaaagacggagacaaacuaaaagaacaauguguuaaaggaggcguaggaguaaagguaagugcauuccaucgcuacaguaaguaucuaggacucaacgagaaaacacuauacaaugcaggucuagaaauauuugaaguuguagccgaacacgaagauaucauaaauuugagaaauggaauagaucauuuuaaauacuaccuaggagauuaucguucaaugcucagcauauauagcgaaguuuuugaccguuucuucacguacgacauaaaauaccagaaaaauguauuaaaucucuuacaaaauauucuauuacgacauaauguaauaguagaaccaauauuagaaagcgguuucaagacuauuggcgaacaaacaaaaccuggagcaaaauuaucaauaagaucaauaaaaagugauacauuucaauauaaaguaaaaggaggaacacuaauaaccgaugcaaaagacgaacgauaucuugaaacuaucagaaaaauacuauauuacgcagaaaacgaagaagacaaucucaagaaaaguguagucguaaccaacgcagacaaauacgagaaaaacaaagaaucagaugaccaaaauaaacaaaaagaaaagaaaaauaaagauaauaaaggaaagaaaaacgaagaaacgaaauccgaugcugagaaaaauaauaaugaaagacuaagcuauaacccauucgcaaacuugaacuucaaacuaaguaacuaa

SEQ ID NO: 11865 - RNA, 3858 nt, Artificial Sequence
  Cas13a variant__Herbinix hemicellulosilytica__CRZ35554.1__Cas13a
augaaauuaaccagacgcagaaucagugguaauucuguggaucagaaaauaacagcggcauuuuacagagacaugucccaaggacuucucuauuacgauagcgaagacaacgauuguacagauaaaguaaucgaaaguauggauuuugaacguuccuggcggggaagaauccuuaaaaacggcgaagacgacaagaacccauucuauauguucguuaaaggacucgugggcagcaaugacaaaauaguaugugaaccuauagacguugauucagacccagauaaucucgauauacuaauuaacaaaaaccuaacaggauuuggcagaaacuuaaaagcgccagacucaaacgacacacuugaaaaccuaauccguaaaauccaggcugguauuccagaagaagaaguccuacccgaacugaaaaagauaaaagaaaugauacaaaaagauaucguaaaucgaaaagaacaacucuuaaaaucuauuaaaaauaacagaauaccauuuaguuuagaaggaucaaagcuaguacccagcacgaagaaaaugaaauggcuauuuaaauuaauagauguuccaaauaaaacauuuaacgagaaaaugcuagaaaaauauugggaaauauaugacuacgacaaacuaaaagcaaacauaacaaaccgauuagacaaaacugacaagaaagcccgaaguauaagccgagccguaagcgaagaauuaagggaauaucacaaaaaucuacguacuaacuacaaccguuucguaaguggagauagaccagcggcuggauuagacaacggagggucagcaaaauauaauccggauaaagaagaguucuuauuauuucuaaaagaaguagaacaauacuucaagaaauacuuccccguaaaaagcaaacacucuaacaaaucuaaagauaagagcuuaguagacaaauacaaaaacuacugcucauacaaaguaguaaagaaagaagugaauagauccauaauaaaucaacucguagcagggcuaauucaacaaggaaaacuacuauacuacuuuuauuauaacgauacauggcaagaagacuuccuaaauuccuauggguugucauacauccaaguagaagaagcauucaagaaaagcguaaugacuucucuaucauggggcauaaacagacuaacaucauucuucauugacgauucaaauacgguaaaauuugaugacauaacuacaaagaaagcaaaagaagcgauagaaucaaauuacuuuaauaaacuucgaacuuguucgcgaaugcaagaccacuuuaaagaaaaacuagccuucuucuaucccguauacguaaaagacaagaaagaucgaccugaugacgauauugaaaaccuaauaguucuggucaaaaaugcaaucgaauccguaucguaucuacgaaauaggacauuccauuuuaaagaaucgucccuucuagaacuauuaaaagaacuagacgacaaaaauucgggacaaaauaaaauugacuacucaguagcagcagaguucaucaaacgggacauugaaaaucucuaugauguauuucgagaacaaauucgaagucuugguauagcagaauauuauaaagcagauaugauaucugauuguuuuaaaaccuguggauuagaguucgcauuauauagccccaaaaauucgcuaaugccagcguuuaaaaacguauauaaaagaggagcaaaucucaauaaagcauacauacgagacaaaggaccaaaagaaaccggagaccaaggucaaaacucauauaaagcgcuugaagaauaucgagaauuaacaugguacaucgaaguuaaaaauaaugaccagagcuauaacgcauacaaaaacuuacuacaacuaaucuacuaucacgcuuuucuaccugaaguacgagaaaaugaagcacuaaucacagauuucauaaacagaacaaaagaauggaaccgaaaagaaacagaagagagacuaaacaccaaaaauaacaagaaacacaaaaacuucgaugaaaaugaugauaucacuguaaauaccuauagguaugaaaguauacccgauuaccaaggagaaucauuagaugacuacuuaaaaguuuuacaacgaaaacaaauggcccgagccaaagaaguaaaugaaaaagaagaagguaauaacaacuacauccaauucauuagagauguaguaguaugggcauucggagccuaucucgaaaacaaacucaaaaacuacaaaaacgagcuacaaccaccccucucgaaagagaacaucggauuaaaugacacauuaaaagaauuauucccagaagagaaaguaaaaagucccuucaauauaaaaugcagauucucaaucuccacuuucaucgauaacaaaggaaaaaguaccgacaauaccagugcggaggccguaaaaacugacggaaaagaagacgaaaaagacaagaaaaauaucaaacgaaaagaucucuuaugcuuuuauuuauuucuacgacuucuagaugaaaacgaaauaugcaaauuacaacaccaauucauaaaauauagaugcaguuugaaagaaagaagauucccggggaaccguacaaaacuagaaaaagaaacagaauuacucgcagagcucgaggaauuaauggaacucgucagauuuacaaugccaaguauaccugaaauaucagccaaagcagaaucaggauaugacaccaugaucaagaaauacuucaaagauuuuauugaaaagaaaguuuuuaaaaauccuaaaacuucaaauuuauacuaucauucagacagcaaaacaccaguuacaagaaaauacauggcauugcuaaugagaucugcaccauuacaccuauauaaagacauauucaaaggauacuacuuaauaaccaagaaagaaugucuagaguacauaaaacucagcaacauaauaaaagacuaucaaaacaguuuaaacgaauuacaugaacaacucgaacgcauaaaauuaaaaucagaaaaacaaaacgggaaagacucacuauaccuugacaagaaagacuucuauaaagucaaagaauacguugaaaaucuagaacaaguagcacgauauaaacauuuacaacacaaaaucaacuucgaaucacuauaucgaauauuuaggauacauguggauauagcagccaggaugguaggauacacacaagacugggaaagagauaugcacuuuuuguuuaaagcacucguauauaacggaguauuagaagaacgaagguucgaagcgauauucaacaacaaugacgacaauaacgacgggcgcauagucaagaaaauacaaaauaauuuaaacaacaaaaaccgagaguuaguaucaaugcugugcuggaacaagaaauugaacaaaaacgaauuuggugcgauuaucuggaaacgaaauccaaucgcacauuuaaaucacuucacucaaacagaacaaaacucaaaaucuucacuggaaucacucaucaauucucuacgaauacuauuggcauaugacagaaaaagacaaaacgcagugacaaaaaccauaaacgaucuucuauuaaaugacuaucacauaagaauaaaaugggaaggaaggguagacgaaggacaaaucuacuucaauaucaaagaaaaagaggauauugaaaaugaaccaauaauucaccuaaaacaucuacauaagaaagacugcuacaucuauaaaaacucuuacauguucgauaaacaaaaagaauggaucuguaacgguaucaaagaagaagucuaugacaaaucaauacuaaaauguaucgguaaccuauuuaaauuugacuacgaagauaaaaacaaaucaucugccaacccuaaacauaccuga

SEQ ID NO: 11866 - RNA, 4314 nt, Artificial Sequence
  Cas13a variant__Lachnospiraceae bacterium__WP_022785443.1__Cas13a
augaaaauaucaaaaguacgagaagaaaaccggggggcgaaacuaacuguuaacgcuaaaaccgcgguaguaagcgaaaaucguagucaagaaggaaucuuauauaacgauccauccagauacggaaaaagccgaaaaaacgacgaagacagagaccgauacauagaaucaaggcuaaaaagcucaggaaaauuauacagaauauucaacgaagacaagaacaaacgagaaacugaugaauugcaaugguucuugagugaaauaguaaaaaaaaucaauagacguaauggucugguuuuaucagauaugcuuucaguagacgacagagcauucgaaaaagcauuugagaaauacgcagaauuaucauauaccaacaggcgaaacaaagucuccggaagucccgcauucgaaacaugcggaguagacgcagcaacggccgagagguugaaagguaucaucucugaaacgaacuuuaucaaccggauaaagaauaauaucgacaacaaaguaucagaagacauuaucgacagaauaauugcaaaauaccucaagaaaucccuaugccgugagagaguuaaaaggggacuaaagaaacuccuaaugaaugccuuugaucuaccauacagugauccagacauugacguacagcgcgauuuuauagauuacguuuuggaagacuuuuaucacgugagggcaaaaucccaaguaaguagaucuauaaaaaacaugaauaugccagugcaaccagaaggagaugggaaauuugcgauaacagugaguaaagguggaacagaaucuggaaauaaaaggucagcagagaaagaagcuuucaagaaauuccuuucagauuaugcuucauuagacgaacguguacgugaugacauguuaaggagaaugagacgacugguagucuuauauuuuuacggaucagaugauucgaaauugagugacguuaaugaaaaauucgacguaugggaagaucacgcagcuagaagaguugacaaucgagaauuuauaaagcuaccauuagaaaacaaauuagcaaaugguaaaaccgauaaagaugcagaacgaauacgaaaaaacacagugaaagaauuauaucguaaucaaaauauuggauguuacagacaagccguaaaagcaguugaggaggauaauaauggaagauauuuugacgauaaaaugcuuaacauguucuuuauacaucgaaucgaauacggcguagaaaaaauauacgcaaauuuaaaacaggucacagaauucaaagcuaggacgggauauuuaagcgaaaaaauauggaaagaccuaaucaacuacauuucgauaaaauacauagcaauggguaaagccguauauaacuacgcaauggacgaacuaaaugcaucagacaaaaaagaaauagagcucggaaaaaucagcgaagaauaccuaagugguauuucgucauucgacuacgaguugauaaaagcugaagagaugcuccaacgagaaacugccguauacgucgcauuugccgcacgacaucuaucgucacaaacaguagaacuagacuccgaaaacucagacuuccuacuacuaaaaccaaaaggcacaauggauaaaaacgacaaaaauaaauuagcaucaaauaauauucuaaauuuccuaaaagacaaagaaaccuuaagagacacgauacuucaauacuucggaggucauagcuuauggacugauuuuccauuugauaaauaucuugcagguggaaaagaugacguugauuuucucacagaucucaaagacgucaucuacucgaugagaaacgacuccuuucauuacgcaacagaaaaccacaacaacggaaaauggaauaaagaacucauaagugcaauguucgagcacgaaacugaaaggaugacaguaguuaugaaagauaaauucuacuccaauaacuugcccauguucuauaaaaacgacgaucuaaaaaaauuacugauagaucucuacaaagacaacguagaaagagccagccaagugccaucauuuaauaagguauucgugcgaaaaaacuucccggcacuagugagagauaaagacaaccuagguauagagcuagaucuaaaagcugacgccgauaaaggagaaaacgagcuaaaauuuuacaacgcucuauacuacauguuuaaagagauauauuacaaugccuuuuuaaaugauaaaaauguaagggaacgauuuauaacaaaagcuacaaaaguagccgacaauuaugacaggaauaaagaaagaaaucuaaaggaccgaaucaaaucagcagguucggacgaaaaaaaaaaauuacgggaacaacuacaaaacuacauagccgaaaacgauuucggccaaagaauaaaaaauauaguacaaguaaaccccgauuacacguuagcacaaauaugucaacucaucaugacagaauauaaccaacaaaauaacggguguaugcagaaaaagucugcagcaagaaaagacaucaacaaagacucauaccaacauuauaaaaugcuuuuacuaguuaauuuacguaaggcguuucuugaauuuauaaaagaaaacuaugcauuuguucuaaaaccauacaaacaugaccuaugcgauaaagcagacuucgugcccgacuuugcuaaauacguaaagccauacgccggcuuaauuucacgaguggcaggcucgucugaacuccaaaagugguauauaguaucacgcuuuuuaucgccagcacaagcgaaucauaugcuaggauuucuccacuccuacaaacaguacgucugggacaucuauagaagagcauccgaaacggguacagaaauaaaucauucaauagccgaggauaagauagcuggcguagauauaacagacguugacgccgugauugauuuaucaguaaaacuuugcggaacaauaagcucagaaauuucugacuacuucaaggacgacgagguauaugcagaauauauaagcaguuacuuggacuucgaauaugauggagguaacuauaaagauagcuugaacagauuuugcaauucagacgccgucaacgaucaaaaaguagcguuauauuaugauggagaacacccgaaacuaaacaggaacauaauccuaucaaaauuauauggagaaagaagauuccuagaaaaaaucaccgauagagugaguagaagcgacauaguagaauacuacaaauuaaaaaaagaaaccucacaguaucaaacaaaagguauauuugauagcgaagacgaacaaaaaaauauaaaaaaauuucaagaaaugaaaaacaucguagaauuuagggacuuaauggauuacagcgaaaucgcagaugaacuacaaggccaauuaauaaacuggauauaccuaagagaacgagaucuaaugaauuuccaacuuggauaccacuaugcgugccuaaacaacgauucaaacaaacaagcaacuuaugucacacuagacuaccaaggaaaaaaaaacagaaaaauuaacggagcaauccuauaucaaauaugcgcaauguacauaaacggacugccgcuauacuacguagacaaagauucaucagaauggaccguaucagauggaaaagaaucgacaggcgcaaaaauuggagaauucuacagauacgccaaaucauuugaaaauaccucagacugcuaugccaguggacuagaaauauucgaaaacauuucggaacaugauaacauaacagaauuacguaauuauauagaacauuucagauauuacucaaguuucgacagaagcuuccuaggaauauacucagaggucuuugaccguuucuucacauacgaccucaaauacagaaaaaaugugccaacuauucuauauaacauacuacuacaacacuuuguaaaugugagauucgaguuugucucaggcaaaaagaugauaggaauagacaaaaaagacagaaagauagcaaaagaaaaagaaugugcacguauaacaauaagagaaaaaaauggcguauauagugaacaauucacauacaaacuaaaaaacggaacaguuuacguagaugcacgcgacaaaagauaucuacaguccauaauuagacuguuauuuuacccagaaaaaguuaauauggaugaaaugauagaagucaaggaaaagaaaaaaccauccgauaauaacacuggaaagggauacagcaaaagagauagacaacaagaucgaaaagaauacgauaaauauaaggaaaaaaaaaaaaaagaaggaaacuuucuaucgggaauggguggcaauaucaauugggaugaaauaaacgcacaacucaagaacuaa

SEQ ID NO: 11867 - RNA, 3156 nt, Artificial Sequence
  Cas13a variant__Listeria newyorkensis__WP_036091002.1__Cas13a
augaaaauaaccaaaaugagaguugacggaaggacaauuguaauggaaaggacuuccaaagaaggacaacugggauacgaagggauagauggaaauaaaaccacugaaauuauauucgauaaaaaaaaagaaucauucuauaaaaguauacugaauaaaacaguaaggaaaccagaugaaaaagaaaaaaauagaagaaaacaagccauaaacaaagcgauaaacaaagaaaucacagaacugaugcuagccguacuacaucaagagguaccaagccaaaaacuacauaaccuaaaaucucuaaauaccgaauccuuaaccaaauuauucaaaccgaaguuucaaaacaugauuucauacccacccucaaagggagcagaacaugugcaauucugucucacagauauagccguaccggcuauccgugaucuagacgagaucaaaccugacuggggcauauucuucgaaaaacucaaacccuacacagacugggcugaaucauauauacauuacaaacaaacgacuauucaaaaauccauugagcaaaauaagauacaaucuccagacucaccacgcaaacucguauuacaaaaauauguaacugcauuucuaaacggagagccuuuaggcuuagaccuaguagcuaaaaaguacaaacuagcugaucuagccgaaucguuuaaacuaguagaccucaaugaagacaaaucagcaaauuacaaaauuaaagcauguuugcaacaacaccaaagaaacauacucgaugagcuaaaagaggauccagaacuuaaccaauacggcauagaagucaaaaaauacauucaacgauacuucccaaucaaaagagcacccaauagaucaaaacacgcacgugccgacuuucuaaaaaaagaacuaauugaaucuacaguagaacaacaauucaaaaacgcagucuaccacuacguacuagaacaagguaaaauggaagcauaugaacuaaccgaccccaaaacaaaagacuuacaagacauaagaucaggcgaagcauuuucauuuaaauucauuaaugcaugugcuuuugcaagcaacaauuuaaaaaugaucuuaaacccugaaugcgagaaagauauacucggcaaaggaaauuucaaaaaaaaucuacccaacucuacaaccagaagugacguaguaaaaaaaaugauaccuuucuuuucagaugaacuacagaacguaaacuucgacgaagccauaugggcuauucgcggauccauacaacaaauuagaaaugagguauaucauugcaaaaaacacuccuggaaaagcauucuaaaaauaaaaggauuugaauucgaaccgaauaacaugaaauacgcggacagcgauaugcaaaaacuuauggauaaagauauagcaaaaaucccagaauuuauugaggaaaaacugaaaaguuccggagucguucgauucuauagacaugaugagcuacagucaauaugggaaaugaagcaaggauucucacuauuaacaacgaacgcaccauucguccccucauuuaaaagaguauaugcaaagggccacgacuaccaaaccaguaaaaacagauauuauaaccuugaucuaacaacuuucgacauucuagaauacggagaagaagacuuucgagcacgguauuuccuaacaaaacuaguauacuaccaacaauuuaugcccugguucaccgccgauaauaacgccuuucgcgacgcagcaaacuuuguuuugcgauuaaacaaaaaccgacaacaagacgcaaaagcauuuaucaacauaagagaaguugaagaaggagaaaugccacgagacuacaugggguacguacaaggacaaauagccauucaugaagacucuauagaagauacaccaaaucauuucgaaaaauucaucucacaaguauucauaaaaggcuucgaucgacacaugagaucagcaaacuuaaaauuuauuaaaaacccgagaaaccaaggguuagagcaaagugaaaucgaagagaugagcuuugacauaaaaguagaaccaagcuuccuaaaaaacaaagaugacuacauagcauuuuggauauucugcaaaaugcuagaugcacgacaucuaagugaacuuagaaaugaaaugaucaaauaugacggacacuuaacgggagaacaagaaauaaucggauuagcacuucucggaguagacaguagagagaacgacuggaagcaauucuuuucaagcgaaagagaauacgaaaaaauuaugaaaggauacgucguugaagaacuauaccaacgagagccauaucgacaauccgacgggaaaacaccuauacuauuucgagguguugaacaagcacgaaaauacgguaccgaaacaguaauacaaagacuauucgacgcaaacccagaauuuaaagucucaaaauguaaccuagcagaaugggagcgacaaaaagaaacaauagaagaaaccaucaaacgaaggaaagaacuacauaacgaaugggcuaaaaauccaaaaaaaccucaaaacaacgcauuuuucaaagaauauaaagaaugcugugacgccauagacgcauauaacuggcauaaaaauaaaacuaccuuagcuuacguaaacgaacuacaccaucuauugaucgaaauucuaggucgauacguuggguacgucgcaauagcagaccgagacuuccagugcauggcuaaucaauauuucaaacauagcggcauaaccgaacgaguagaauacuggggcgacaaccgacuaaaaagcauuaaaaaacuagacacauuccuuaaaaaagaaggacucuuuguaucagaaaaaaacgcacgaaaucauauagcacaccuuaauuaucucucccuaaaaagugaauguacauuacuauaccuaagugaaagacuuagagaaauauuuaaauacgacagaaaacuaaaaaacgcagucucuaaaaguuuaauagauauccuugauagacauggaaugucagucguauucgcaaaucucaaggaaaacaaacaccgauuaguaauaaaaucuuuagaaccaaagaaauuaagacaccuaggaggaaaaaaaauagacggaggauauauagaaacaaaccaggucuccgaggaauacuguggcauuguaaaaagacuucuagaaauguaa

SEQ ID NO: 11868 - RNA, 3363 nt, Artificial Sequence
  Cas13a variant__Listeria seeligeri__WP_012985477.1__Cas13a
auguggaucagcauaaaaacccugauccaccaucuaggaguacuauucuucugugauuauauguacaauagaagagaaaaaaaaauaaucgaggucaaaaccaugagaauuacaaagguagagguagaccgaaaaaaaguucuuauaucaagagacaaaaacggaggaaaacuagucuaugaaaaugagaugcaagauaacacagaacaaauuaugcaccacaagaaauccucauuuuauaaauccguuguaaauaaaacaauaugccgcccugaacaaaaacaaaugaaaaaacucguacauggucuacuccaggaaaacucacaagaaaaaaucaaggucagcgauguaaccaaacucaacauaucaaacuuuuugaaccaccgcuuuaaaaaaucacuauauuauuucccagaaaauucuccugacaaaucagaagaauacagaaucgaaauaaaccucucucaauuacucgaagacucccucaaaaaacaacaaggcacauucauaugcugggaaucauucagcaaagauauggagcuauacauaaacugggcagaaaauuacauaagcuccaaaacaaagcucauaaaaaagucgaucagaaauaacagaauucaauccacagaaucaagaucaggacaguuaauggacagauacaugaaggauauacuuaauaaaaacaaaccguucgacauucaaucugucuccgagaaauaccaacuagaaaaauuaaccucagcucuaaaagcuaccuucaaagaagcaaaaaaaaaugacaaagaaauuaacuauaaacuuaagaguacccuccagaaucacgaaagacaaaucauagaagaauuaaaagaaaacucugaacuaaaccaauucaacauagaaauacgcaaacacuuagaaacauacuucccuauaaaaaaaaccaauagaaagguuggcgacauacgaaaccuagaaauaggagaaauccaaaaaauuguaaaucaccgucucaaaaacaaaauaguacaacguauucuacaagaaggaaaauuagccucuuacgagauugaaagcacaguuaacagcaacucacuccaaaaaauuaaaauagaagaggcauuugcgcuaaaauucauaaacgccugccuauucgccucaaauaaccuccgaaacaugguauaccccguauguaaaaaagauauucucaugauuggagaguucaagaacucauuuaaagaaauaaaacauaaaaaauucauuagacaauggucucaauuuuuuucccaagaaaucaccguagacgacauagaacuugccucauggggucuaagaggagccauagcuccaauaagaaaugaaauaauccacuuaaaaaaacacucauggaaaaaauucuucaauaacccaacauuuaaaguaaaaaaaagcaaaauuaucaacggaaaaacuaaggacguaacauccgaguuuuuauacaaagaaacacuauucaaagacuacuuuuacagugaacuagacucaguaccagaacuaauaaucaacaaaauggaaagcuccaagauacucgauuacuacucauccgaccaacucaaucaaguuuucacaauaccaaacuuugaacucucacuauuaaccucagcaguuccauucgcaccaucauucaaaagaguauacuugaaaggauuugacuaccaaaaccaagacgaagcccaaccagauuauaaccucaaacucaacauauauaaugaaaaagcuuuuaacuccgaagcauuucaagcacaguacucacuauuuaaaaugguauauuaucaaguauuccuaccccaauuuacuacaaauaaugaccuauuuaaaucuucuguagauuuuauacuaacauuaaacaaggaacguaaaggcuacgcaaaagcuuuucaagauauccgcaagaugaauaaagacgaaaaacccucagaauauauguccuacauacaaucccagcuaaugcucuaccaaaaaaaacaagaagaaaaagaaaaaauuaaccacuuugaaaaauucaucaaccaaguauucaucaagggcuucaacuccuucaucgaaaaaaaccgccuaacauacauuugucacccaacgaaaaacacuguaccagagaacgacaacauagaaauuccuuuucacacugauauggaugacagcaauauugccuucuggcuaaugugcaaacuucucgaugcaaaacaauugucugaauuaagaaaugaaaugaucaaguucuccuguagucuacaauccacggaagaaauaucaacuuuuaccaaagccagagaaguaauaggccuugcacuacuaaacggagaaaaaggcugcaacgacuggaaagaacuguucgacgacaaagaagccuggaaaaaaaacaugagcuuauacguuucagaagaacuauuacaaaguuuaccauacacucaagaagauggacaaaccccaguaauuaacagaucaauugacuuaguaaaaaaauacggaacggaaacaaucuuagaaaaauuauuuagcaguucggaugacuacaaagucagcgcaaaagacauagcaaagcuacaugaauacgacguuacagaaaaaaucgcccaacaagaaagucuacacaaacaauggauugaaaaaccaggacuagcaagagacagugccuggacaaaaaaguaccaaaauguaauaaaugacauaagcaacuaucaaugggcaaaaacuaaaguagaacucacccaaguaagacacuuacaucaauuaacaaucgaucuccugagccgacucgccggauauaugagcauagccgaccgagacuuccaauuuagcuccaacuauauccuagaacgagaaaauagcgaauacagagucacaucauggauacuauuauccgaaaauaagaacaaaaauaaauacaacgacuacgaacuauacaacuuaaagaacgcaucaauuaaaguaucaucaaaaaacgauccacaauugaaaguagaccuaaaacaacucaggcuaacauuagaauauuuagaacucuucgacaacagacuaaaagaaaaaagaaacaauaucucacacuuuaauuaccugaauggccaacuaggaaacucuauacuagaauuauuugacgaugcaagggacguuuuaucauacgauagaaaacucaaaaaugcaguaucaaagucacuuaaagagauacuuucaucucacgggauggaaguaacauuuaaaccacuguaccaaacaaaccaccacuuaaaaauagacaaacuccaaccaaaaaaaauucaucauuuaggcgaaaaaucaacagucuccucaaaccaggugaguaacgaauacugucaacuaguacguaccuuauuaacgaugaaauaa

SEQ ID NO: 11869 - RNA, 3465 nt, Artificial Sequence
  Cas13a variant__Paludibacter propionicigenes__WP_013443710.1__Cas13a
augcgggucagcaagguaaaaguaaaagacggaggcaaagauaaaaugguccucguucaucguaaaaccaccggggcucaacuaguauacucaggccaaccugugucaaacgagacaucaaacauucuaccugaaaaaaaacgccaaagcuuugacuuaucaaccuuaaacaaaacaauaauaaaauucgacacagccaaaaaacaaaaauuaaacguagaccaauacaaaauuguugaaaaaauuuuuaaauauccaaaacaagaacuaccgaaacaaaucaaagcagaagaaauauuaccauuccucaaucacaaauuucaagagccuguaaaauacuggaaaaacggaaaagaagaaucuuuuaauuuaacccugcucauaguagaagcaguucaagcccaagacaaacgaaaacuacaaccauacuaugauuggaaaacuugguauauucaaaccaaauccgaccuccucaaaaaaucaauagaaaauaacagaauagacuuaacugaaaaccuuaguaaaagaaaaaaggcgcuacuggcaugggaaacugaauuuacagcauccggauccaucgaucuuacucauuaucacaaaguuuacaugaccgauguauuaugcaaaaugcuucaagacgugaaaccccugacagacgauaaaggaaaaaucaacacaaaugcauaccaccgaggccuaaaaaaagcauuacaaaaccaccaaccagcaauauucggaaccagagaaguuccaaaugaagccaacagagcagauaaccaacuaucaauauaccaccuagaagucguaaaauaccuagaacacuacuucccaauuaagacuaguaaaagacgaaacacagccgacgacauugcacacuaccucaaggcccaaacccugaaaaccacaauagaaaaacaacucguaaacgcaauacgcgccaacauaauccaacaagggaaaacaaaccaucacgaacuuaaagcagacacaacaucuaacgaccucauacgaaucaaaacaaacgaagcauuuguccuaaaccucacugguacaugugcauuugcagccaacaacauaagaaacaugguagacaaugaacaaacaaaugacauauuagguaaaggagauuucauaaaaagccuuuuaaaagacaauacaaacucacagcuuuacaguuucuucuuuggugaaggauuaucgacaaauaaagcagaaaaagaaacacaguuaugggguauaagaggugcuguccaacaaauacgcaacaauguaaaucacuauaaaaaagacgcacucaaaacaguuuucaauauaucaaacuucgaaaaucccaccaucacugaucccaaacaacaaacgaacuacgcagacacgauauacaaagcaagauucauaaacgaauuagaaaaaauaccagaggcauucgcucaacaacuaaaaacagguggugcaguaucauauuacacaauugaaaaccuaaaaucacuguuaacgacauuccaguucucucucugucggucaaccaucccauucgcuccuggauucaaaaagguauucaacggcggcaucaauuaccaaaacgcaaaacaagaugaaucuuucuaugaacuaaugcucgaacaauacuuaagaaaggaaaacuucgcugaagaauccuacaacgcuagauacuuuaugcucaagcuaaucuacaacaacuuauuccuccccggcuucacaaccgaucgaaaagcguucgccgauucuguuggguuuguacaaaugcaaaauaaaaaacaggccgaaaaggucaauccaagaaaaaaagaggccuacgccuucgaagccgucagaccgaugacagcagcagauuccauagccgacuacauggcauacguccaauccgaacuuaugcaagaacaaaauaaaaaagaagaaaaagucgccgaggaaacacgcauaaauuuugaaaaauucguuuuacaaguauucauuaaaggcuucgacucauucuuaagagcaaaagaauucgauuucguacaaaugccacaaccacaguuaacagcaacagcaaguaaccaacaaaaagcagacaaacuuaaucaauuggaagcaucgauaacagcagacuguaaacuuacaccacaguacgcaaaagcagacgaugccacccacauagcauuuuacguauucugcaaauuacuagaugccgcacaccuaaguaacuuacgaaaugaauuaauuaaauuucgcgaaucuguaaacgaauucaaauuucaccaucuauuagaaauaauugaaauaugccuacuauccgcugacgucgucccgacagacuaucgagaucuauacaguuccgaagcugacugucuugccagauuaagacccuuuauugaacaaggcgcagacaucacuaauuggucagaccuuuuuguccaaagcgacaaacacagcccuguuauacacgcuaauaucgaguuaagcguaaaauacggaaccaccaaauuacuagaacaaauaauaaacaaggauacccaauucaaaacuacagaagcaaacuuuacagccuggaacacagcucaaaaaucuauagaacagcucaucaaacaacgggaagaucaucacgaacaauggguuaaagcaaaaaacgcugacgauaaagaaaaacaagaacgcaaacgagaaaaaucaaacuucgcucaaaaauuuauagaaaaacacggagacgauuacuuagacaucugcgauuacauaaauacuuacaacuggcuagacaacaaaaugcauuucgugcacuuaaaucguuuacacggacucacaauagaacuccucggccgaauggcaggauuuguagcauuauucgaccgagauuuucaauucuuugacgaacaacaaauagccgacgaauuuaaacuucacggcuucguuaaccuccacagcauagauaaaaaacuaaaugaaguuccaaccaaaaaaauaaaagaaauauaugacauacgaaacaaaauaauccaaauuaacggaaacaaaauuaacgaaucaguacgcgccaauuuaauacaauucauaucaucaaaaagaaacuacuauaauaaugcauuccuacacguauccaaugacgaaauaaaagaaaaacaaauguaugacauucgaaaccacaucgcacacuucaacuacuuaacaaaggacgccgcagauuuuucccuaauagaccuuauuaacgaacugcgagaacuauuacacuaugaccgcaagcuaaaaaacgcaguuucgaaagcuuucauagaccucuucgacaaacauggaaugauacuaaaacuuaaacuaaaugcggaccauaaacuaaaagucgaaagucuugaacccaagaaaauuuaucaccucggauccagugccaaagauaaaccagaauaucaauauugcaccaaccaaguaaugauggcauacugcaacaugugucgaucauuacuugaaaugaaaaaauaa

SEQ ID NO: 11870 - RNA, 3858 nt, Artificial Sequence
  Cas13a variant__Rhodobacter capsulatus__ETD76934.1__Cas13a
augcagauaggaaaaguacaaggacgaaccauaucugaguuuggagauccugcuggugguuuaaaaagaaaaauuucaacagacgguaaaaaucggaaagaauuaccugcacaccuaagcagcgauccaaaagcauuaauuggacaauggauuuccggaauagauaaaauauauagaaaacccgauagucgaaaaucggauggcaaagccauacauucaccuacacccaguaaaaugcaauuugacgcacgggacgacuuaggcgaggcuuuuuggaagcuaguuucagaagcagggcuagcacaagauagugauuacgaucaguuuaaaagaagauugcauccauauggugacaaauuucagccagcagauaguggcgcgaaauugaaauucgaagcugauccuccagaaccacaggcuuuucacgguaggugguauggugcaauguccaaacgagguaacgaugcgaaagaauuagcugcugcacucuacgaacauuuacauguagacgagaaaagaauugauggucaacccaaaagaaacccaaaaacagacaaauucgcuccuggccuuguaguagcgcgagcauuagggauugaaucaucggucuuaccacgaggaauggcaagacuggcgcguaauuggggagaagaagaaauacaaacauauuuuguaguagacguagccgcaucaguaaaagaaguagcaaaagccgccguaucagcagcacaagcauucgauccucccagacaggugagcgguaggucuuuaucuccaaaagucggauucgcauuagcagaacauuuggaaaggguuacagguaguaaaagauguucauuugacccugccgcaggucccagcguacuugcccuacaugaugaaguaaagaaaacauacaaaaggcuuugcgcaagagggaaaaacgcagcacgggcauucccugcagauaaaacagaauuacuagcacugaugagacauacacaugaaaacagaguaagaaaucaaaugguucgcauggguagagugucugaauaccgaggccaacaagccggugaccuagcacaaucacacuauuggaccucugcaggucaaacugaaauaaaagaaucugaaaucuuugugagacuuuggguaggagcauuugcauuagcagguagaaguaugaaagcguggauagacccaaugggaaaaauaguaaacacugagaaaaacgaucgagacuuaacugcagcaguaaacaucagacaaguaauaaguaauaaagaaaugguugcugaagcgauggcuaggcgggggauauauuuuggagaaacacccgaguuggaucgauuaggagcagaagguaacgaaggcuucguauuugcucuacugcgauacuuaagggguugcagaaaucaaacuuuccauuuaggagcaagggcgggcuuucuuaaagagauaagaaaagaacuggagaaaacuagaugggggaaagcaaaagaagcagaacacguaguauuaacagauaaaacaguugcagccauaagagcaauaauugacaaugacgcuaaagcccuaggcgcaaggcuucucgcugauuuaaguggagcguuugucgcacacuaugcaagcaaagaacauuucuccacuuuauacucagaaauagucaaagcaguaaaagaugcaccagagguaucaucaggacuuccaaggcuaaaacuauuacuaaaacgugcugauggagugagaggcuacgugcacggauuaagggauacuagaaaacaugcauucgcaacaaaauuacccccuccaccagcaccaagagaacuagaugauccugccacgaaagccagauacauagcguuacuuagauuauaugauggcccuuucagagcauacgcaagcggaauuacuggcacagcuuuagcugguccagcagcacgagcgaaagaagccgcaacggcgcuagcucaaucggugaauguaacaaaagccuacucagacguuauggaaggaagaucaaguagauuacgaccgccaaaugacggugaaacacugagagaauauuuaucagcauugacaggcgaaacugccacagaauuucguguccaaauaggauaugaaagcgauucagagaaugcgaggaagcaagcugaauuuauugaaaauuauagacgugauaugcuugcauucauguuugaagauuauauaagagcaaaaggguuugauuggauacuaaagauugagcccggcgcuacagcuaugacucgagcgccagucuuaccugaaccaauagauaccagaggacaauacgaacacuggcaagcugcauuauauuuggugaugcacuuugucccugccuccgacgucucaaauuuacuccaucaacuacgcaaaugggaagccuugcaaggaaaauaugagcuaguacaagacggagaugcgacugaucaagcugaugcacgacgcgaagcucuugauuugguaaaaagguuccgugauguacugguauuauuucuaaaaacaggagaagcuagauuugaaggacgagcugcuccuuucgaucuaaagccuuuuagagcucuauucgccaauccugcaacauucgaccgguuguucauggcuaccccaacuacugcacgaccagcagaagaugauccagaaggagauggagcaagugagccagaauugagaguugcgagaacuuuaagagguuuaagacaaauagcaagauacaaccauauggcaguauugucggaucuuuucgcaaaacauaagguccgggaugaagaaguagcaagguuagcggagaucgaagaugaaacacaagaaaaaucacaaauaguagcggcacaagaauuaagaacagauuuacaugacaaaguuaugaaaugucacccgaaaacaauaucacccgaggaaaggcagaguuaugcagcagcuauuaaaacgaucgaagaacauagauuuuuaguuggcaggguuuauuuaggagaucauuuaagauuacacagacuaaugauggauguaauaggcagacucauugauuaugccggggccuaugaacgugauacugguacauuuuuaauaaacgcgucuaaacaauugggagcuggugcagacugggcaguaacuaucgcaggagcagcuaauacggaugcucgcacucaaacaagaaaagaccucgcgcauuucaauguuuuagauagagcagaugguacaccugauuuaacugcucuagucaauagagcacgagaaaugauggcauaugauaggaaaaggaaaaacgcagugccgagauccauauuagauauguuagcacgacuggguuuaacacuuaaauggcaaaugaaagaucauuuguuacaagacgcgacaauuacgcaggcggccauaaaacaccuagacaaaguacguuuaacaguuggaggaccagcagcuguuacugaagccagguuuucacaagacuaucuacaaaugguggcggcgguauuuaaugguuccguccaaaauccuaaaccgagaagaagagacgauggagaugcauggcauaaacccccaaaaccugcaacagcacaaagucaacccgaucaaaaaccgcccaauaaagcuccaucagcuggauccagauuaccgcccccacaaguuggagaaguuuaugaagguguaguaguaaaaguuauagauacaggaagucuagguuuucuagcuguagaaggaguagcagggaauauaggacuacauauuagccgauuacgaagaauuagggaagacgcaauaauuguugggcgacguuauagauucagaguagaaauauauguaccaccaaaaagcaauacgucaaagcuaaacgcagcagaucuaguuagaaucgacuaa

SEQ ID NO: 11871 - RNA, 1578 nt, Artificial Sequence
  Cas13a variant__Corynebacterium ulcerans__WP_038617242.1__Cas13
augccaaaauacugcuuaacagcaagguuuccauuaggaguuuaucuaggacauacaggagacgcaaacagagacgcauauccagaccccgcaagacuccaugcagcacuaaugaacgcagcagcucaagguguucaugcagaagaagacccuaaugaacaucaauuaagaccaucacaacaaaguuuacaagcauuacaaugguuagaagcacauccaccaacaggauuagcaaugccagaacaacaauggcuuaguccagauacaucaagaaugauguauagaaauguaggcucaguaaaaauugauaaaacaggaguaacaagagcaacagaaaacagagccguaucagacggaguaucaguaaacggagcauauggauauaucugggaugaaaugccagucgacauugcagaagcaauuacagcuuuacuaccagauguagccugccuuggugaagcaucaucauuaguuguucuagaacaacaagaaauagaagccacgcuaacuuuagacccacaagcuacugcuuucagcacagaacgaguacagguaagaauagcauuaccaggacgaacacaacaucuucgagaaguauuucacgcacgcuauggaaaaaaaccacccucaaaaaaagcagacaaauucuuaaaagacgacccuauucacgacccaccaauaccuaaagaccauuuaggaacagcaagauacuuaagaguaaaugccgcagauaaagaaugugucacacccuggacaaaagucauucuacuugaaguucaugguaaacaauuaggcgcaaaagaacaaguuagagcagcaguagccuuacacagagcccuaaucgcaagaauaagaacugacguauccccaguaauaacaggcagauaugccgcaggugcucaacguccagcaaacaaucuagcaauacaauauauuccucaucgucauuuagaagccuuaggauuaaaaacaagcgcuuucgcauuauuagucccucaagaugcagauaguacuguauacgaacaauuaaaucaagcuuuaacaggcccuuucccacuaagauccggcggcaaauuacuaugccaauuaaaauacaauggacacguauuuagaggagacgccuuuuggccagcaccacaaccaggaacaauuagaaugugggaaccauuaaacguauuuauacccgaaagccgaccacauaacaaacaacaaggaguuuuauggagauuagcagaugcaggacuuuuaagcguagcguuuguuuggagagauaacuucccaacaaaagaaacaggcccagcaagauauguagaauuaagagacgcagcuuauaaugcugacguacgaauauuucacgaccauccaguauccaggaacacucgaagauucguacauagaacaaauagaucauuaacaauacaaccauggagaggucuaguucaccuaggaucacuacaacaagauagggcaaucauagcauuaggacaaucuagacaccuaggaggagguuuauugauaccaguagauauuccaagaagugaauucgaaacaaugacuagugaaaugacccaugcauaa

SEQ ID NO: 11872 - RNA, 3675 nt, Artificial Sequence
  Cas13b variant__Bergeyella zoohelcum__WP_002664492.1__Cas13b
auggaaaauaaaacaucgcucgggaacaacauauauuacaauccuuucaaaccacaagauaaaucauacuuugcaggguacuucaacgccgcaauggaaaacacggauucuguauuuagagaacucggaaaacgacuaaaagguaaagaauauacuucagaaaacuucuuugacgcaauauuuaaagaaaauauaagccuaguagaauaugaaagauacgugaaacuacuuuccgacuacuuuccaauggcacgacuacucgauaagaaagaaguccccauaaaagaacggaaagagaacuucaagaagaacuucaaaggaauaauaaaagcuguacgcgaucuacgaaacuucuauacucacaaagaacacggagaaguugaaaucaccgacgaaauauucggcguacuagacgaaaugcuaaaaucaacaguacucaccgugaaaaagaagaaaguaaaaacagauaaaacuaaagaaauucuaaagaaaucaauagaaaaacaacuggacauauuaugccaaaagaaacuugaauaccuuagagacacagcaagaaaaaucgaagagaaacgaagaaaucaaagagaacgaggagaaaaagaacucguagcuccauucaaauauagugacaaaagggacgaccucauagcugccauauacaacgacgcguuugauguauacauagacaaaaagaaagauucccuuaaagaaagcaguaaagcaaaauauaauaccaaaucagauccccaacaagaagaaggagaucuaaaaauucccauaucgaaaaacggcgucguauuccuucuaucacuauucuuaacgaagcaagaaauacaugcauucaaaucuaaaauagcuggauuuaaagccaccguaaucgacgaagccaccgucagugaggcaacgguaagccacggcaaaaauaguauuugcuucauggcaacccaugaaauuuucucucauuuagccuauaagaaacucaaaaggaaagugaggacugccgaaauaaacuauggagaagcggaaaacgcggaacaauuaucuguauaugccaaagaaacauuaaugaugcaaaugcuagaugaauuaucaaaaguaccggaugucguguaucaaaaucuaagugaagacguccagaaaaccuuuauagaagacuggaacgaauaccucaaagaaaacaacggcgacguuggcacaauggaggaagaacaagugauacaccccguaauccgcaaaagauacgaagacaaauucaacuauuucgcuauaagauuucuagaugaguucgcgcaauuuccaacauuaagauuucaaguucauuuaggaaauuaccuccaugacucaaggccaaaagaaaacuuaauaagugaucgcagaauaaaagaaaagauaacuguauuuggcagacuuucagaauuagaacacaagaaagcacucuucaucaaaaacacugaaacaaaugaagauagagaacauuacugggaaauauuucccaacccaaauuacgauuucccuaaagaaaacauaucagucaacgacaaagacuuccccauagcaggcaguauacuagauagagagaagcaaccaguagcuggaaaaauaggaauaaagguaaaauuacuuaaucaacaauauguaucagagguugacaaagcaguaaaagcccaucaauuaaagcaaagaaaagcaaguaaaccuucaauacaaaacauaauagaagaaauaguuccaauaaaugaaagcaauccaaaagaagccauaguauucggaggucaacccaccgccuauuuauccaugaacgacauccauucgauauuauacgaguucuuugacaaaugggaaaagaagaaagaaaaacuagaaaagaaaggcgaaaaagaauuaaggaaagaaaucgguaaagaauuagaaaagaaaaucguaggcaaaauacaagcacaaauacaacagauuauagacaaagacacaaacgcaaaaauccuaaaaccuuaccaagauggcaacucuacugcaaucgacaaagaaaaauugauaaaagaucuuaaacaagaacaaaacauccuacaaaaacugaaagaugaacaaacgguaagggaaaaagaauauaaugauuucaucgccuaucaagacaaaaaucgagagauaaauaaaguaagagauagaaaucacaaacaauacuuaaaagauaaucucaagagaaaauauccagaggcaccagcacgaaaagaaguauuauacuaccgcgaaaaaggcaagguugcagucuggcuagcaaacgauauaaaacguuuuaugcccacagauuuuaaaaaugaauggaaaggagagcaacauucacuacuccaaaaaucucuagcuuacuacgaacaguguaaagaagaacuuaaaaauuuguuaccugaaaaaguauuccaacaucucccauucaaauuagggggcuacuuucaacagaaauaccucuaccaauuuuauacaugcuaucuagacaaaagauuagaguauauaucuggccuaguacaacaagcugaaaacuucaaaucugaaaauaaaguauucaagaaaguagaaaacgagugcuuuaaauuucucaagaaacaaaauuacacucauaaagaacuugaugcaagaguucagaguauauuaggauacccaauauuucuagaaagaggauucauggaugaaaaacccacaauaauuaaaggcaaaacauucaaaggaaaugaagcauuauucgccgauugguuucguuacuacaaagaauaucaaaacuuccaaacauucuacgacacagagaacuaccccuuaguagaacucgaaaagaaacaagcugacagaaagagaaaaacaaaaauauaucaacagaaaaagaacgacguauucacauuauuaauggcaaaacacauuuucaaaucgguuuucaaacaagauagcaucgaucaauucagucuagaagaccucuaccaauccagagaagaacgauuaggaaaccaagagagggccagacaaaccggagagagaaacacaaacuacauauggaauaaaacuguggaccuaaaacuuugugacggaaaaauuacaguagaaaacgucaaacugaagaacguaggcgauuucauaaaauaugaauacgaccaaagaguccaagccuuucucaaauaugaagaaaauauagaauggcaagcauuuuuaaucaaagaauccaaagaagaagaaaacuaccccuacguaguagagagagaaauagaacaauaugaaaaaguaagaagagaagaacuguuaaaagaaguucacuuaauagaagaauauauacuagaaaaaguaaaagauaaagaaauauuaaagaaaggagacaaucaaaauuuuaaauacuauauccuuaacgggcugcuaaaacaacuaaagaaugaagacguagaaucauacaaagucuucaacuuaaacacagaacccgaagacgucaauauaaaucaauuaaaacaggaagcuacugacuuagaacaaaaagcauuuguucuaacauauaucagaaauaaauuugcacauaaucaacuaccaaagaaagaguucugggacuauugccaagaaaaauacggaaaaaucgaaaaagagaaaacauacgccgaauacuuugcugaaguguucaagaaagaaaaagaagcacuaauuaaauag

SEQ ID NO: 11873 - RNA, 3675 nt, Artificial Sequence
  Cas13b variant__Bergeyella zoohelcum__WP_002664492.1 modified__Cas13b(R116A,H121A,R1177A,H1182A)
auggaaaacaaaaccucucuaggaaauaacaucuacuacaaccccuuuaaaccacaagauaaaagcuacuuugcaggauacuucaacgcagcaauggaaaacaccgacucagucuuuagggaacuaggaaaaagacuaaaaggcaaagaauauacaucagaaaacuuuuucgacgcgauauucaaagaaaauaucagcuuaguugaauaugaaagauacgucaaacuauuaagcgauuauuucccaauggcuagauuauuagacaagaaagaaguccccauaaaagaacgaaaagaaaacuuuaagaaaaacuucaaaggaauaauaaaagcagugagagacuuagcuaacuucuauacugcaaaagaacacggagaaguagaaaucacggacgaaaucuucggaguccuagacgagauguuaaaauccacaguccucacagucaaaaagaagaaaguaaaaacugauaaaacaaaagaaauacuaaagaaaucaauagaaaaacaacucgacauacucugccaaaagaaacuagaauaccuaagggacacggcgcgaaaaauagaagagaaaagacggaaucagagagaacgaggagaaaaagaguuaguugcaccauuuaaauauucagacaaacgcgaugacuuaaucgccgcaauauacaacgacgcauuugacguuuauauagacaaaaagaaagacagccugaaagaauccaguaaagcaaaauauaacacaaaaucagauccacaacaagaggaaggagacuuaaaaauaccaauaagcaaaaacggcguaguauuucugcucagucuauuuuuaaccaaacaagaaauucacgcauucaaaucaaaaauugcaggauucaaagcaacaguaauugaugaagcuaccguaagugaagcuacaguaucacacggcaaaaacucaauauguuucauggcaacacacgaaauauuuucccaccucgcuuacaagaaacuaaaaagaaaagugaggacagcugagauuaacuauggcgaagcagagaacgcugaacaauugucaguguacgcaaaagaaacacuaaugaugcagaugcuugacgaacugucaaaaguaccugacguaguuuaccaaaacuuaagcgaagacguccagaaaacguuuauagaggacuggaacgaauaccuaaaagaaaacaacggagauguaggaacaauggaagaagaacaagugauacauccaguaauaagaaaaagguacgaagacaaauucaauuacuuugcgauaagauuccuagacgaauuugcacaauuucccaccuuaagauuucaaguacauuuaggaaauuacuuacaugauucgagaccaaaagagaacuugauauccgacagacguauaaaagagaaaaucacaguauucggccgacucucugaacuggaacacaagaaagcacuauucauuaaaaauacugaaacaaacgaagaucgcgaacauuacugggaaauauucccaaaccccaacuaugacuuccccaaagaaaacaucagcgucaacgacaaagauuucccgaucgcaggauccauacuagacagagaaaaacaaccuguggcagggaaaauuggaauaaaaguaaaauuauuaaaccaacaauacguaagugaaguagauaaagcagucaaagcacaucaacuaaaacaaagaaaagcuaguaaaccaucaauccaaaauauaaucgaagaaauaguuccuaucaacgaaucaaauccaaaagaagcaauaguauuugggggacaaccaacugccuacuuaaguaugaacgacauacacucaauacuauaugaguucuucgacaaaugggagaaaaagaaagaaaaacuggaaaagaaaggugaaaaagaauuaagaaaagaaauaggaaaagaacucgaaaagaaaaucgucggcaaaauucaagcccaaauccaacaaauaauagauaaagauacaaaugcuaaaauccuaaaaccuuaccaagauggaaacagcacagcaauagauaaagaaaaacuaaucaaagaccucaaacaagaacaaaauauacuucaaaaacugaaagacgaacaaacagucagggaaaaagaauauaacgacuuuauagcauaccaagacaaaaacagggaaauuaauaaaguuagggaccgaaaccacaaacaauauuuaaaagauaacuuaaaaagaaaauaucccgaagcaccagcaagaaaagaaguacuauacuacagagaaaaaggaaaaguagccguauggcuggcaaaugacauaaaaagauucaugccuacagauuuuaaaaaugaauggaagggagaacaacauaguuugcuacagaaaucauuagcauacuacgaacaaugcaaagaagaacuaaagaacuuauuacccgaaaaaguauuucaacaccuaccauuuaaacuaggaggauauuuccaacaaaaauaccuauaccaauucuauacuuguuauuuagacaaacgauuagaauauauuaguggucuaguucaacaagcugagaauuucaaaucagaaaauaagguauucaagaaaguggaaaacgaaugcuucaaauucuuaaagaaacaaaauuauacccacaaagaacuagacgcaagaguacaaucuauacucggauaucccaucuucuuagaaagaggauucauggacgaaaaacccaccauaauuaaaggaaaaaccuuuaaaggaaaugaggcacuauucgccgauugguuuagauauuacaaagaauaccaaaauuuucaaaccuuuuaugauacagagaacuacccacuuguagaacuagaaaagaaacaagcagauagaaaaagaaaaacaaaaauauaucaacaaaagaaaaaugacguauuuacauuauuaauggcaaaacacauauuuaaaucuguuuucaaacaagauucaaucgaucaauuuaguuuggaagacuuauaccaaagccgagaagaacgauuaggcaaccaagaaagagcuagacaaacaggagaacgaaauacaaacuacauuuggaauaaaacuguagacuuaaaauuaugugacgggaaaauaacgguugagaacguaaaacucaaaaacguuggugacuucauaaaauaugaauacgaucaaagaguccaagccuucuuaaaauacgaagaaaacauagaauggcaggccuuuuuaauaaaagaaucaaaagaagaggaaaacuacccuuacguuguggaacgagaaauagagcaauacgaaaaaguccgaagagaagaacugcuaaaagaaguccacuugauagaggaauacauauuagagaaaguaaaagacaaagaaauauuaaagaaaggagacaaccaaaauuucaaauauuacauacuaaauggacuauuaaaacaacugaaaaaugaagacguagaaucguacaaagucuucaaccuaaacaccgaaccggaagaugugaacauaaaucaauugaaacaagaggcuaccgaccuagaacagaaagcauucguucugacauacauagccaacaaauucgcagccaaccaauugccaaagaaagaguucugggacuacugccaagaaaaauacggaaaaaucgaaaaagagaaaacauacgcagaauauuuugcggaaguauucaagaaagaaaaagaagccuugauaaaauaa

SEQ ID NO: 11874 - RNA, 3384 nt, Artificial Sequence
  Cas13b variant__Prevotella buccae__WP_004343973.1__Cas13b
augcaaaaacaagauaaacuguucguugaucgaaaaaaaaaugcuauauucgcuuuccccaaauacaucacaauaauggaaaacaaagaaaaaccagaacccauuuauuaugagcuaacagacaaacauuucugggccgccuuuuuaaaucuugcaagacauaacguauacaccacaauaaaccacauaaauagacgacuugaaauagcagaauuaaaagacgauggauacaugaugggaaucaaaggaucuuggaaugaacaagccaaaaaauuagauaagaaaguccgcuuaagggauuuaauuaugaaacauuucccguuucuggaagcagcagccuaugaaaugacgaacuccaaaucaccuaacaauaaagaacaacgcgaaaaagagcaaagcgaagcauuaucgcuaaauaaucuaaaaaauguuuuauucauauuccucgaaaaacuacaaguacuaagaaacuauuacagccacuauaaauacucagaagaaaguccaaagcccaucuuugaaaccucauuacuuaaaaacauguauaaaguuuucgaugcaaaugucagacuaguaaaaagagauuacaugcaccaugaaaacauagacaugcaacgugauuucacacacuuaaaucgcaaaaaacaaguaggaagaacaaaaaacauuauagauucccccaacuuccauuaccacuucgcugauaaagaaggaaauaugacgauagcgggacuuuuauucuuuguauccuuauuucuggacaaaaaagacgccauauggaugcaaaaaaaauuaaaaggauucaaagauggccgaaaccuaagagaacaaaugacaaacgaagucuucugccgaucccgcauuucccuuccaaagcuuaaauuagaaaacguccaaacgaaagacuggaugcaacucgacaugcuaaacgaguuaguacgcuguccaaaaucccuguacgaaagauuacgagaaaaagacagagagagcuuuaaagucccguucgauauauucucagacgacuacaaugccgaagaagaacccuuuaaaaauacccuaguaaggcaucaagacagauucccauacuucguacucagauauuucgaccuaaaugaaauauuugaacaacuaagauuucaaauagaccuaggcacauaucauuucuccauauauaauaaacguauaggugacgaagaugaaguacgccaccuuacacaccaccuauauggcuucgcccgaauacaagauuuugcaccacaaaaccagccggaagaauggcguaaacuaguaaaagaucuagaucauuucgaaacuucacaagaaccauauauaaguaaaaccgccccacacuaccaccuugaaaacgaaaaaauaggcauaaaauucugcagugcucacaacaaccuuuuccccagccuucaaaccgacaaaaccuguaacggaagaucaaaauucaaccuaggaacacaauuuacagccgaagcauuccucucaguacacgaacuauuacccaugauguuuuacuacuuacuacuaacaaaagacuauucacgaaaagaauccgcugauaaaguagaaggaaucauaagaaaagaaauauccaauauauacgcaauauacgacgcauucgcaaacaacgaaauaaacucaauagcagacuuaacacgcagacuccaaaacacuaacauacuacaaggccaucuaccaaaacaaaugauauccauauuaaaaggaagacaaaaagacaugggaaaagaggccgaacgcaaaaucggcgaaaugaucgaugacacucaacguaggcuagaucuucucugcaaacaaacaaaucaaaaaauacgaauagguaaacgaaacgccggucuauuaaaaagcggaaagauagcagacuggcuagucaacgacaugaugcgauuccaacccguacaaaaagaucaaaacaacauaccaaucaacaacucaaaagcgaauucaacagaauaccgaaugcuacaacgagcucuagcauuauucggaucagaaaauuuccgccugaaagcauacuucaaccaaaugaaucucguagggaacgacaauccacauccauuccuagccgagacgcaaugggaacaucaaacuaacauacuuaguuucuaccgcaauuauuuagaagcaagaaaaaaauaccuaaaaggacucaaaccucaaaacuggaaacaauaccaacacuuccuaauuuuaaaaguacaaaaaacaaaccgaaacacauuaguaacaggauggaaaaacucuuuuaacuuaccacgaggcauauucacacaaccaauuagagaaugguucgaaaaacauaacaacucaaaaagaaucuacgaucaaauacuaucauucgacagaguuggguucguugcaaaagccauaccuuuauacuucgcagaagaauauaaagacaacguucaaccauucuaugauuauccauucaauaucggaaaucgccuaaaacccaagaaaagacaauuucuagacaaaaaagagcgaguggaacuauggcaaaaaaacaaagaauuauuuaaaaauuacccaucugaaaaaaaaaaaacugaucuagcauaccuagacuuccugagcuggaaaaaauuugaaagagaacuaaggcuaaucaaaaaccaagauauaguaacauggcuaauguucaaagaacucuuuaauauggcaacaguagaaggacuuaaaauaggagagauucaucuccgagauauagauaccaauacagcaaacgaagagaguaacaauaucuuaaaucgaauaaugccaaugaaguuaccagucaaaacguaugaaacagauaacaaaggaaacauccucaaagaaagaccauuagcuacuuuuuacauagaagaaacagaaacaaagguacuuaaacaagggaauuucaaagcucuaguaaaagacagaagauuaaauggacucuucaguuuugcagaaacgaccgaccuaaaccuagaagagcacccaauaucaaaauuaucaguugaucuagaacuaauaaaauaccaaacaacaagaauauccauauuugaaaugaccuuaggucuugaaaaaaaauuaauagacaaauacucuacucugccuacagacagcuuuagaaacaugcuggaacgcugguuacaauguaaggcaaaucgaccggaauuaaaaaacuauguuaacagcuuaauagcaguacguaaugcauuuucacauaaccaauacccaauguacgaugcaacccuauucgcggaaguaaagaaauuuacacucuucccaaguguagauacaaaaaaaaucgaacuaaacauagcaccacaacuacuugaaauuguugggaaagccauaaaagaaauagaaaaauccgaaaacaaaaauuaa

SEQ ID NO: 11875 - RNA, 3273 nt, Artificial Sequence
  Cas13b variant__Prevotella sp.__WP_044065294__Cas13b
augaacauccccgcacucguagaaaaccaaaaaaaauauuuuggaaccuacucuguaauggcgaugcugaaugcucaaaccguacuagaccauauccaaaaaguagcugacauagaaggagaacagaacgaaaacaaugagaaccuuugguuucaccccguaaugucacaucuauauaacgcgaaaaauggcuaugauaaacaacccgaaaaaacaauguucauuaucgaaagacuccaaucguauuucccauuucuaaaaauaauggcagaaaaccaaagagaauauucaaacggaaaauacaaacaaaauaggguagagguaaauuccaacgacauauuugaagugcuaaaacgagcauuuggcguauuaaaaauguacagagauuuaacaaaucauuacaaaaccuaugaagaaaaacuuaacgauggcugugaauucuugacuagcaccgaacagcccuugagcggaaugauaaacaauuacuacacaguagcacucagaaacaugaaugagagauauggauauaaaacagaagaccucgcuuuuauacaagacaaaagauuuaaauuugucaaagacgcauaugguaaaaagaaaagccaagucaacacaggauuuuuucuaagccuacaagauuacaauggagauacacaaaaaaaacuacacuuaagcggaguaggaauagcucucuuaauaugccucuuccuagauaaacaguauauaaauaucuuccuauccagauuaccaauauuuucuagcuacaacgcacagagugaagaacgacguauuauaauaaggucauucggaaucaacucaauuaaauuacccaaagacagaauucauucagagaaaucaaacaaaucaguugcaauggauauguuaaaugaaguaaagcgauguccagacgaacuauuuacuacacuauccgcagaaaaacaaucacgauuuagaauaaucucagacgaccacaaugaaguacucaugaaaagaaguagugauagauucguaccacuucuacuccaauacauagauuacggcaaacuauuugaucacauacgcuuccacgucaauaugggaaagcuacgauaccuauuaaaagccgacaaaacuugcauugacgggcagacuagaguacgaguaaucgaacaaccacuaaaugguuucggacgacuugaagaagcagaaaccaugagaaaacaagagaauggaacauuuggaaacucagguauaaggauaagagauuucgaaaacaugaaaagagacgacgcaaauccagcuaacuaucccuauauaguagauacuuauacacacuauauacuagaaaauaacaaaguagaaauguuuaucaacgacaaagaagauagugcccccuuacuacccgucauagaggaugacagauauguaguaaaaacaauaccuucauguagaaugagcacacuagagauaccugcaauggcuuuucauauguucuuauucgggucaaaaaaaacggaaaaacucaucguagauguacacaaucgauacaaacgccuguuccaagcaaugcaaaaggaagaaguuacugcugaaaauauagcaagcuucggcauagcagaaagugaccuaccacaaaaaauacuagaccuaauuucgggcaacgcucacggaaaagaugucgacgccuuuauacgauuaacuguugaugacauguuaacagacacagaacgaagaaucaaaagauuuaaagacgaucgaaaaucaauaagaucagcagacaacaaaaugggaaaaagaggcuuuaaacaaauaagcacaggaaaacuugcagacuuuuuagcaaaagacauaguucuauuucaaccaucuguaaaugacggagaaaauaagauaaccggacuaaacuauagaauuaugcaaucagcaauagccgucuaugacaguggcgacgauuacgaagcaaaacaacaauucaaauuaauguucgaaaaagcaagacuaauaggcaaagguaccacugagccacauccauuuuuauacaaagucuucgcuagaucaauacccgcaaacgccguagaauucuaugaacgcuaccuaauugagagaaaauuuuaccuaacagguuuauccaaugaaauuaaaaaagggaaucgaguagacguacccuucauacgccgagaccagaauaaauggaaaacaccagcaaugaaaacuuuaggaagaauauauucagaagaccuucccguagaauuaccaagacaaauguucgauaacgaaauuaagagucauuuaaaaucacuuccccaaauggaagguauagauuuuaauaaugccaauguaacauaccuaauagcagaauauaugaaaagaguacucgacgacgauuuccaaacauucuaccaauggaauagaaacuacagauacauggacauguuaaaaggggaauaugauagaaaaggcagccuucaacauugcuucacuaguguagaagaaagagaaggacuauggaaagaaagagccuccagaacagaaagguaucgaaaacaagcuucaaacaaaauaagaaguaauagacaaaugagaaaugcuagcagcgaagaaauagaaacaauacuagauaaaagacuuagcaacucaagaaacgaauaccaaaaaucggaaaaaguuauucgaagauacagaguacaagacgcacuacuuuuucuacucgccaaaaaaacacucacugaacucgcagauuuugacggcgaaagauucaaacuaaaagagauaaugcccgacgcggaaaaaggaauacucucagaaaucaugccuaugucauuuacuuucgaaaagggagggaaaaaauauacaauaacaagugaaggaaugaaacugaaaaacuauggcgauuuuuuuguccuagcaagcgauaaacgaauaggaaaucuacuagaauuaguaggguccgacauaguuucaaaagaagacauaauggaagaguucaauaaauaugaccaaugcaggccagaaauuucaucaauugucuucaaccuagaaaaaugggcauuugauaccuacccugaacuuucagcacgaguugaccgugaagaaaaaguugauuucaaauccauauuaaaaauauuguugaauaauaaaaauauaaacaaagagcaaagugacauacuaagaaaaauaagaaacgcguucgaucacaauaacuacccugacaaaggcguaguagaaauaaaagcucucccagaaauagccaugagcauaaaaaaagcuuucggagaguacgcaauaaugaaauaa

SEQ ID NO: 11876 - RNA, 4152 nt, Artificial Sequence
  Cas13b variant__Artificial____PspCas13b-GS-HsADAR2DD(E488Q,del984-1090)
augaauauccccgcucuuguagaaaaccaaaagaaauauuucggaacuuauagcguaauggcuauguuaaaugcucaaacaguccuagaucacauacaaaaaguagcugauauugaaggcgaacaaaaugaaaauaacgaaaaucugugguuucaucccgugaugucucacuuauauaaugcgaaaaacgguuaugacaaacaaccugagaaaacaauguucaucauagagagacuacaaagcuauuuuccauucuuaaaaauuauggcagaaaaucaaagagaauacuccaacggaaaauauaaacaaaacagggucgaaguaaauucaaacgacauauucgaaguauuaaaaagggccuuugguguauuaaaaauguaucgggaucuaacaaaugcauacaaaacauacgaagaaaaacuaaaugacgguugcgaguuuuugacaucaacggaacaaccauuaucuggaaugauaaauaacuacuauacuguggcccuuaggaauaugaacgaaagauacgguuauaaaacagaagaccuagcauuuauccaagacaaaagguucaaguuuguaaaagaugcuuacggcaagaagaaaagccaagugaauacgggauuuuucuugucucuacaagauuacaauggugauacacaaaagaaacuucaccuaucaggaguuggaauugcucucuuaauauguuuauuuuuagacaaacaauacauaaacauauuuuuauccagacuaccaauuuucucaaguuacaacgcgcaauccgaagaacgaagaauuauaauucgaucauuuggaauuaauucaauaaaauuacccaaagacagaauacauucagaaaaaucgaacaaauccguagccauggacaugcuaaacgaaguaaaacgaugcccagacgaauuauucacuacacuaagugcagaaaaacaaucuagauucagaauuaucagcgacgaccacaacgaaguauuaaugaaacgaagcucagacagauucguaccgcuucuuuuacaauauauagacuacggaaaauuauuugaccauauuagguuccauguuaacaugggcaaacuucgauacuuacuaaaagcugacaaaacauguauugauggacaaacuaggguaagaguuaucgaacaaccucuuaauggauuuggacgauuagaagaagcugaaacgaugagaaaacaagaaaacgguacauucggaaauucaggaauccgaaucagagauuucgaaaauaugaaaagagacgacgccaauccagcaaacuacccauauauagucgacacauacacacauuacauuuuagaaaacaacaaaguagaaauguucauaaaugacaaagaagauucggcuccacuguugccagucauugaagaugauagauacguaguaaaaacuauaccaucgugucgaauguccacacuagagauuccugcaauggcauuccacauguuuuuauuuggaaguaagaaaacugaaaaacugauaguagauguucacaaucgauacaaacgauuauuucaagcaaugcaaaaagaagaaguaaccgcagaaaauauugcgucauuuggcaucgccgaaucagaucuaccccagaaaauccuugauuuaaucaguggcaaugcucaugguaaagacguagaugccuucauacgauuaacuguagaugacaugcuaacggauacggagcgacgaauaaaacguuucaaagacgacaggaaaucuauaagaucugcagauaacaaaaugggcaaacgcggauuuaaacaaaucucaacaggaaaauuagcagacuuccuugccaaagacauuguacuauuucaaccaagcguuaacgacggggaaaacaaaauaacaggacuaaauuauagaaucaugcaaucagcaauagcgguauacgacucaggggaugauuaugaagcaaaacaacaauucaaacuuauguucgaaaaagcgagguuaaucggaaaagggacaacggaaccucauccauuccuguauaaaguauuugcaagaucgaucccagcaaacgccguagaauuuuacgaaagauaucuaauugaaagaaaauucuaccuaacuggguuauccaaugaaauaaagaaaggaaacagaguagauguaccauuuauucggagagaccaaaacaaauggaaaacaccagcaaugaagacauuaggcagaauauauuccgaagauuuaccaguagaacucccuaggcaaauguucgauaacgaaaucaaaucacauuuaaaaucacuuccccaaauggaagguauagacuucaacaaugcaaacgugacuuaucucauagcagaauacaugaaaagagugcuugaugacgacuuccaaacauucuaccaauggaacagaaauuacagauacauggauauguuaaaaggcgaauacgacagaaaagguagcuuacaacacugcuucacaagcguagaagaacgcgaagguuuauggaaagaaagagcaucacgaacggagcgauaccgaaagcaagcgaguaauaaaauaagaagcaauagacaaaugcgaaaugcaucaagcgaggaaauugaaacuauucuagacaaacgccuaucaaacagcagaaacgaauaccaaaaaucagaaaaaguaauacguagauauaggguacaagacgcucucuuauuuuuacuugcgaagaaaacauuaacagaacuagcagauuuugauggagaacgcuucaaacuaaaagaaaucaugccagacgccgaaaaaggcauccucucagaaauaaugcccaugucauucacauuugaaaaagguggaaagaaauacacaauaaccucagaaggaaugaaacugaaaaauuauggagacuuuuucguccuagcaucugacaaaagaauagggaaucuauuagagcuagucggcucagauauugugaguaaagaagauggaucacuacaacuaccaccccuggaaagacuaaccuugggaucacaacuacaucugccccaaguacuagcagacgcagucaguagauuaguccuaggaaaguucggagaccuuacugacaacuuuagcaguccucacgcaagaaggaaaguucuagccggaguaguaaugacgacgggcacugauguaaaagaugcuaaaguuauuaguguaagcacaggcacaaaauguauaaauggagaauauaugucugauagaggacucgcccuaaaugacugucacgcggagauaauuagcagaagaucucuacugagauuuuuauauacccaacuagaauuauauuuaaacaauaaagacgaccagaaaagaaguauauuccagaaaagugaacguggaggauuuagacucaaagaaaacguccaauuucacuuauauauuuccacauccccaugcggagacgcaaggaucuucagcccccaugaaccuauuuuagaagaaccagccgaccggcauccaaacagaaaagcaagaggacaauugcgaacaaaaauagaaucgggacaagguacuauaccuguaagaucaaacgcaucgauacaaacaugggacggaguccuacaaggagaaagacuauuaacaaugucuugcucugacaaaauagcacgauggaacgucguuggaauacaaggcagucuacuuucgauauuugucgaaccuauuuauuucuccucaauaauauuagguagucucuaccauggugaccaccuaaguagagcaauguaucaaagaauuagcaauauagaagaucuaccuccauuauauacacuaaacaaaccacuuuuaucaggcauauccaacgcagaagcaagacaacccggcaaagcacccaauuucuccguaaacuggacaguuggggacucagccauugaaguaauaaacgcuacuacugggaaagaugaauuaggacgggcaucaaggcuuugcaaacacgcacuauauugcagauggaugaggguucauggaaaagugccgucacaucuccuaagauccaagauuaccaaaccaaacguauaucaugagagcaaacucgccgcaaaagaauaccaagcagcuaaagcacgacuauucacagcuuuuaucaaagcaggacuaggagcuuggguagaaaagccaaccgaacaagaucaauucucacugaccuaa

SEQ ID NO: 11877 - RNA, 4152 nt, Artificial Sequence
  Cas13b variant__Artificial____PspCas13b-GS-HsADAR2DD(E488Q,T375G,del984- 1090)
augaauauucccgccuuaguggagaaccaaaagaaauauuuuggaacauauucaguaauggcaaugcugaaugcacaaacagucuuagaccacauacaaaaaguagcagauauagaaggagaacaaaacgaaaauaaugaaaauuuaugguuucacccugucaugucucauuuauacaacgcuaaaaauggauacgacaaacaaccagagaaaacaauguucauaauagaaagacuacaaucauacuucccauuucuaaaaauaauggcagaaaaucaacgagaauauuccaauggcaaauauaaacaaaacagaguugaaguaaacucaaaugauauauucgaaguccuuaaacgugcauuuggaguccuuaaaauguacagagaccuaacaaaugcauauaaaacauaugaagaaaaacuaaacgacggaugugaauuuuuaacgucaacagaacaaccucugucgggaaugauaaauaacuauuacaccguagcacuaagaaauaugaaugaaagguacggauauaaaacagaggaucuugcuuucauucaagauaaaagauucaaauucguuaaggacgcuuauggaaagaagaaaucucaagucaacacagguuucuuuuuaagccuacaggacuacaacggcgauacgcaaaagaaacuacaccucucggggguagguauagcgcucuuaauaugucuauuucuagauaaacaguacauaaauaucuuucuaucaagauuaccaaucuuuucaaguuacaacgcacagucagaagaacgaagaauuauuauucgaucuuuuggaauaaauagcauaaaacuaccaaaagacagaauacauagcgaaaaaucaaacaaauccguagcgauggauaugcugaacgagguaaaaagaugucccgacgaacucuucacaacccuuucagccgaaaaacagaguagauucagaauaauaucugaugaucacaacgagguuuuaaugaaacguaguagugacagauuugucccacuucucuuacaauacauagauuacggcaaauuauucgaccacauacgcuuucauguuaacauggguaaauugagguaccuuuuaaaagcugauaaaacauguauagauggucaaacuaggguaagaguaauugaacaaccuuuaaauggauucggaagauuagaagaagcugaaacuaugcgaaaacaagaaaaugguacauucggaaauagcgguaucagaauaagggauuuugaaaacaugaaaagagaugacgcaaauccagcaaacuauccguauauaguugauacuuauacucauuacauuuuagaaaacaauaagguagaaauguuuaucaacgacaaagaagauagcgcuccccuguuaccaguaaucgaagaugauagauacgucguaaaaacaauaccgucaugccguaugucaacauuagaaauuccugcuauggcuuuucauauguuccuauuugguucaaagaaaacagaaaaauuaauaguagacguacacaaccgcuauaaaagacuguuccaagcuaugcaaaaagaagaaguuaccgcagaaaauaucgcuucuuucggcauugcagaaucugaccuaccacagaaaauucucgaccuuauaucagggaaugcucauggcaaagacguagaugccuuuauaagauuaacaguagacgauaugcucacagacacagaaagaagaauaaaacguuucaaagacgauagaaaaucaauuagaagugccgauaauaagaugggcaaaagaggauucaaacaaauaaguacaggaaaauuagccgacuuucuugcaaaagacauaguucuauuccaaccuucuguaaaugauggagaaaacaaaauaacuggacuaaacuacagaauuaugcaaucagccauagcuguguaugacucuggcgaugacuaugaggcgaaacaacaauucaaacugauguuugaaaaagcccgccucauugggaaagggacgacagaaccacacccguuucuauauaaaguauucgcuagaucaauuccggcuaacgcaguugaguucuacgaaagauaucuaauagaacgcaaauucuaccugacuggacuaucaaaugaaauaaagaaaggcaaccgcguugauguuccauuuauacgaagagaccaaaauaaauggaaaacccccgccaugaaaacauuaggaaggauauacucagaagacuuacccguagaacucccaagacaaauguuugacaaugaaauuaaaucacaucucaaaucacugccacaaauggaaggcauagauuucaauaacgccaacguaacuuauuuaauugccgaauacaugaaacguguauuagaugaugauuuucaaacuuuuuaccaguggaaccgaaacuaucgauauauggacaugcuaaaaggagaauacgauagaaaaggaagccuucaacauuguuuuacaaguguugaagaaagagaaggguuauggaaagagagagccucccggacagagagauacagaaaacaagcuaguaauaaaauccguuccaacagacaaaugagaaaugcaaguuccgaagaaaucgaaacaauauuagauaaacgacuaucgaacucacgaaaugaguaccaaaagagugaaaaaguaauacggagauauagaguucaagaugcucuuuuauuucugcuagcaaagaaaacauuaacagagcuagccgauuuugacggggaaagauuuaaauuaaaagaaauaaugcccgaugcagaaaaaggcauauuaucagaaauuaugccaaugucuuuuacuuuugaaaaaggugguaagaaauauacaauaacgucugaaggcaugaaacucaaaaauuauggagacuucuucguauuagcaagugacaaaaggauaggaaauuuacuugaauuaguuggaucugacauagucagcaaagaggacgguucacuucaacuuccacccuuagaaagacuaacccuagguucucaauugcaucugccucaaguuuuagcugaugccguauccaggcuaguacuaggcaaauuuggagauuuaacggauaacuucaguaguccacacgcacggagaaaagucuuagcgggaguaguaaugaccacugguaccgacguaaaagaugccaaaguaaucucggugucgacaggagggaaaugcauaaacggcgaauauaugagugauagaggauuagcuuuaaaugacugccacgcagaaauaauauccagaagaucacuacucagguucuuauacacgcaauuggaauuauaucuaaauaacaaagacgaccaaaaacgcucaaucuuucagaaaagugaaagaggcggcuuuagacuaaaagaaaacguccaauuucaccuguauauaucgacgucaccuuguggagaugcucguauuuucucaccacaugaaccaauauuagaagaaccagccgauagacaucccaauagaaaagcaagaggacaauuacggacaaaaauagagaguggucaaggcacuauaccaguaagauccaacgcaaguauacaaacgugggacgggguacuccaaggugaacgauuacucacuaugucaugcucagauaaaauugcaagauggaaugucguugggauucaaggauccuuacucucuaucuuugucgagccaauuuauuucaguagcauaauauuaggaaguuuauaucauggagaucaucucagucgagcaauguaccaacggauauccaacauagaagaucuuccaccacucuauacucucaauaaaccuuuauuguccgggauaucaaaugcugaggcaaggcaaccaggaaaagcaccaaauuuuagcguaaacuggacuguaggagauuccgccauagaaguaauuaaugccacuaccgggaaagaugaguuaggccgcgccucacgauuguguaaacacgcccuauauuguagguggaugcgcguacauggaaaagucccaucacaccucuuaagaucaaaaauaacaaaaccgaacguauaccaugaaaguaaacuugccgccaaagaguaccaagcugcaaaagcaagauuauucacggcuuucauuaaagcaggucuuggcgcauggguagagaaaccaacugaacaagaucaauuuucauugacauaa

SEQ ID NO: 11878 - RNA, 2862 nt, Artificial Sequence
  Cas13b variant__Alistipes sp.__WP_047447901.1__Cas13b
augucuaaugaaauuggagccuuucgugaacaccaauuugcauacgcucccggaaacgaaaaacaagaagaagcaacauuugcaacauacuuuaaucuagcacuauccaacguagaaggcaugauguuuggagaaguagagagcaauccagacaagauugaaaaaucgcuagacacauuaccuccagcuauccuaagacaaaucgcaucauuuauauggcucagcaaagaagaccauccagauaaagccuacagcacagaagaaguaaaaguaauaguuacagaccuaguacgacgcuuauguuucuacagaaauuacuucucgcauugcuuuuaucuugauacccaauauuuuuauuccgaugaacucguugauacaacggcaauuggagaaaaauuacccuauaacuuccaucauuuuauuacaaaucgacuuuucagguauucccuaccagaaauaacauuauuuagauggaacgaaggcgaaagaaaauaugaaauacuuagagacggauuaauauucuuuugcuguuuauuucuaaagcguggucaagcagaacgauuuuuaaacgaauuaagauucuuuaaaagaacagaugaagaaggacgaauaaaaagaacuauauuuacgaaauauugcacaagagaaucacacaaacauauaggaaucgaagaacaagacuuuuuaauauuucaagauaucauaggagaucuaaauagaguaccaaaaguuugcgauggaguagucgacuuauccaaagaaaaugaaagauacauaaagaauagagaaacaucaaacgaaagugaugaaaauaaagcuagauaucgucuuuuaauucgagaaaaagauaaauuuccauacuaucuaaugagauauauaguagauuucggagucuuaccauguauaacauuuaaacaaaaugacuacucaacuaaagaaggaagaggacaauuucauuaucaagaugcagcaguagcccaagaagaacgauguuacaauuucguaguaaggaacggaaauguauacuauaguuauaugccacaagcgcaaaauguaguuagaaucagugaacuucagggaacaauaaguguagaggaauuacgaaacaugguguaugcaucaauaaauggcaaagacgucaacaaaucaguugaacaauauuuauaccaccuucacuuauuauaugagaaaauauuaacaauauccggacaaacuauaaaagaaggaagaguugacguugaagauuauagaccauuauuagauaaacuacuucuuagaccagcuaguaauggugaagaacuaagacgagaauuaagaaaacuacuaccaaaacgagugugugauuuacuaaguaauagauuugacugcagugaaggagucagugcuguagagaaaagauuaaaagcuauuuuguuacgccaugaacaguuacuacuaucacaaaacccagcauuacacaucgacaaaauaaaaagcguuauagauuaucuauaccucuucuucucugacgaugaaaaauuuagacaacaacccaccgaaaaagcccauagaggacuaaaagaugaagaguuccagauguaccauuaccucgugggagacuaugacagccacccauuagcuuuauggaaagaauuggaagcaucaggcaggcuaaagccugaaaugcgaaaacugacuucagcaacgagucuacacggccuauauaugcuuugucuaaaaggaacuguagaguggugccguaaacagcuuaugaguauaggaaaaggaaccgccaaaguggaagcuaucgcagaucgaguuggguuaaaacuuuaugauaaauuaaaagaauauacuccagagcaauuagaaagagaaguuaagcuaguaguaaugcacggcuaugcagcggcggcaaccccaaaaccgaaagcccaagcagcaauaccuucaaaauuaacagaauuaagauuuuacucauuucugggcaaaagagaaaugucuuucgcugccuucauuagacaagacaagaaagcccaaaaacucuggcuuagaaauuucuauacuguagaaaauaucaaaacacuucagaaaagacaagcagcggcagaugcagcauguaagaaauuauauaauuuagucggagaaguagaaagaguucacacaaacgauaaaguauuagugcuaguagcacaaagauauagagaaagacucuuaaauguaggaaguaaaugcgcugugacacuagacaaucccgaaagacaacagaaacuagcagauguuuaugaaguacaaaaugcaugguuaaguauuagauucgaugacuuagacuuuacacugacccauguaaacuuaucaaaucuaagaaaggcuuacaaccuaauaccaagaaaacacauacuagcauuuaaagaauaucuagauaacagaguaaaacaaaaacugugcgaagaaugcagaaacguacgacguaaagaagauuuauguacauguuguuccccaagauacagcaaucuaacaaguuggcuuaaagaaaaucacagugaaucaaguauugagcgugaagcagcaacuaugauguuacuugaugucgagaggaaauuacucagcuuccuacuagacgaacgaagaaaagccauaauagaauacggaaaguuuauaccauucucagcccuaguaaaggaaugccgauuagcugacgcaggacuuuguggaauaagaaacgauguauuacaugauaacguaauaucauaugcagaugcaauaggaaaauuaucagccuauuuuccaaaagaagcaucagaggcaguagaauauauaaggaggacaaaagaaguaagagagcaacggagagaagaacuaauggcuaauaguucacaguaa

SEQ ID NO: 11879 - RNA, 3348 nt, Artificial Sequence
  Cas13b variant__Bacteroides pyogenes__ERI81700.1__Cas13b
auggaaucaaucaaaaauucucaaaaauccacagguaagacacuacaaaaagauccaccuuauuuuggccuuuacuuaaacauggcacuauugaacguaagaaaaguagagaaucacauaagaaaaugguuaggagacguagcguugcucccagaaaaaucaggguuucacagucuucuaacuacagacaaucuaucgucggcaaaauggacaagauuuuacuauaaaagccgaaaauuucucccauuccuagaaauguuugauuccgauaaaaaaagcuaugagaacaggcgagaaacuacagaaugucuugauaccauagacaggcaaaagauaucaagccucuugaaagaaguauauggaaaacuacaagauauacguaacgccuuuucacauuaucacaucgacgaccaaaguguaaagcauacagcauugauaauaagcucugaaaugcaucgauuuauugaaaaugcauacucauuugcuuuacaaaaaacgagagcuagauucacaggaguauuuguagagacagacuuucuucaagcagaagaaaaaggagacaauaaaaaauucuuugcuauagggggaaacgaaggcauaaaacucaaagauaaugcacuaauauuccuaauauguuuauucuuggacagagaagaagcauucaaauuucuaagcagagcgacaggcuuuaaaagcacaaaagaaaaaggcuuuuuagcagucagagaaaccuuuugugcauuauguuguagacaaccgcaugagagacuacuaaguguaaacccacgugaagccuuacucauggauauguugaaugaacuaaaucgauguccagacauacuauucgaaaugcuugaugaaaaagaccaaaaaucauucuuaccauuacuaggagaagaggaacaagcacacauauuagaaaacucccucaacgacgaacuuugcgaagcaauagacgacccguuugaaaugauugcaucacuaucaaaacguguaagauauaagaaucguuucccauacuuaaugcuccgcuacauugaagaaaaaaaucuacugccauuuaucagauuuagaauagauuuaggaugccuugaauuagcaucuuaucccaaaaaaaugggagaagaaaacaacuaugaaagaucagugacagaccacgcuauggcauuuggcagguuaacagauuuccauaaugaggaugcuguauuacaacagauaacaaaaggaaucacagaugaaguuagauucucacucuacgcgccuagauaugcaauuuacaauaauaaaauagguuuugucagaacaggaggcucugauaaaauaaguuuuccaacuuuaaaaaaaaaagggggagaaggacauuguguagccuacacauuacaaaauacuaaaagcuuuggguuuauaucaauauacgaccugagaaaaauacucuuacucuccuuuuuagauaaagauaaagccaaaaauauagucagcggcuuauuagaacagugcgaaaaacacuggaaagauuuauccgaaaaccuguucgaugccaucagaacagaacuccaaaaagaguuuccaguacccuuaaucagauauacacucccucgcaguaaaggaggaaaacuaguaucaucaaaauuagcagauaaacaagaaaaguaugaaagugaauucgaaagacgaaaagagaaacuuacagaaauccuaagcgaaaaagacuucgauuuaagucaaaucccaagacgaaugauagaugaguggcucaauguauugccaacauccagagaaaaaaaacuuaaagguuauguugaaacacucaaauuagauuguagagaacgacugagaguuuucgaaaaacgagaaaaaggggaacacccagucccaccaagaauaggagaaauggcaaccgaccuagcaaaagacaucauaagaauggucauugaccagggcguaaagcaacgaaucacaagugcuuacuacagcgagauacaacguuguuuagcacaguacgcaggugaugauaauagaagacacuuagauucaauaauacgggaacuuagacugaaagacacaaaaaacgggcauccauuucuaggaaaaguauuacgcccuggacugggacacacugaaaaauuguaccaaagauauuuugaagaaaaaaaagagugguuagaagcgacuuuuuacccagcugccuccccaaagagaguaccacgcuucguuaacccaccuacaggcaaacagaaagaauuaccacuaauaauaagaaacuuaaugaaagaacguccugaauggagggauuggaaacaaagaaaaaauagccaucccauagaccucccaagccaauuauuugaaaacgaaauaugucgacuauuaaaagauaaaauagggaaagaaccaaguggaaaacuaaaauggaaugagauguucaaauuauauugggauaaagaauuuccuaacgggaugcaaagguucuacagauguaaaagaagaguagaaguauucgacaaaguaguagaauaugaauacucagaggaaggagguaacuacaaaaaguacuacgaagcguuaauagacgaaguuguaagacagaaaauauccaguagcaaagaaaagaguaaauuacaaguagaagaucuuacccucaguguuagaagaguauuuaaaagagcaaucaaugaaaaagaauaccaauuaagauuacugugcgaagaugaccgucuucucuucauggccguacgagauuuguacgauuggaaagaagcccaacuagaucucgauaaaauagauaacauguuaggagaaccagugucaguaucacaagucauacaauuagaggguggacagccugaugcagugauuaaagcagaaugcaaacuaaaagacgucuccaagcuaaugcgcuauuguuaugauggucgaguuaaaggucucaugcccuacuuugcaaaucaugaagcaacucaagagcaaguagaaauggaacuacgacauuacgaagaccacaggagaagaguuuucaacuggguauuugcacuagaaaaaucuguucuaaaaaaugaaaaacucagaagauuuuacgaagaaagucaaggcggaugcgagcacaggagauguauagacgcacuacgcaaagcaucacugguuagcgaggaagaauacgaauuuuuaguucacauacgaaauaaauccgcacauaaucaauuuccugaucuagaaaucggaaaacuacccccaaaugucacuaguggauuuugugaauguauauggagcaaauauaaagcaauaauuuguagaauaaucccuuucaucgauccagaacgccgcuucuucggcaaguuauuagaacaaaaauaa

SEQ ID NO: 11880 - RNA, 3348 nt, Artificial Sequence
  Cas13b variant__Bacteroides pyogenes__WP_034542281.1__Cas13b
auggaaucaaucaagaauagucaaaaaucaacaggaaaaacauuacaaaaagauccaccuuacuuuggccuuuaucuaaauauggcacuuuuaaauguaagaaaaguagaaaaucacauaagaaaaugguugggcgauguagcgcuacucccagagaaaaguggauuccacaguuuacuaacaacugauaauuuaucaucugcuaaauggaccagauucuauuacaaaucuagaaaauuucuaccauuccuggaaauguuugauucagauaagaaauccuaugaaaauagaagagaaacagccgaaugcuuagacacaauagauagacagaaaaucucuagucuccucaaagaaguauacggcaaacuccaagacauacgaaaugcauucagucacuaucauaucgacgaccaaucaguuaaacauacagcauuaauaauaucaagcgaaaugcauagauuuaucgaaaacgcauauagcuuugcccuacagaaaacaagagcacgauuuaccggaguuuucguagaaacugauuucuugcaagccgaagaaaaaggagacaauaagaaauucuucgcaauaggaggaaacgaaggaauaaaacucaaagacaaugcccucauuuuccuaauaugucuuuuccuugauagagaagaggcuuucaaauuccuuucuagagcuacugguuucaaaucuacgaaagaaaaagguuuucuagcaguaagggaaacauucugugcauuaugcugccgccaaccacaugaaagacuauugucaguuaacccgcgagaagcacuauuaauggauaugcuaaaugaacuuaacagaugucccgauauauuauucgaaaugcuugacgaaaaagaccagaaaucuuuucuacccuuacuaggagaagaggaacaagcacacauacuagaaaacagucuaaacgaugaacuaugcgaagcuauagacgacccauuugaaaugaucgcaucacucucgaaacgaguucguuacaaaaaccgcuuuccuuacuuaaugcuaagguacaucgaagagaaaaaccucuugccuuucaucagauucaggauugaccucggaugcuuagaauuagcuucuuauccuaagaagaugggggaagaaaacaauuacgaaagaucaguaacagaucaugcaauggcauuuggaagauuaaccgacuuucacaaugaagacgccguguuacaacaaauuacuaaaggaauaaccgaugaaguccgcuuuagcuuauaugcacccagauacgcuauuuauaauaacaaaauagguuucguucguacaagugguucggacaagaucagcuuccccacacuaaagaagaaaggcggugaaggacauugcguagcuuacacacuccaaaauaccaaauccuucgguuucauauccauauaugacuugcgaaaaauacuucucuuauccuuucuagacaaagauaaagcgaaaaauaucguaucaggauuacucgaacaaugcgaaaaacacuggaaagaccugagugaaaaccuauuugaugcaauaagaacagaauuacaaaaagaauuuccuguaccccuaauuagauacacauuaccaagaucaaaagguggcaagcuaguaucaucaaaauuagcagacaaacaagaaaaauaugaauccgaguucgaacgaagaaaagaaaaacuaacagaaauauuaagugaaaaagacuucgaucucucacaaauaccacgaagaaugaucgacgaauggcucaacguucuaccaacaucaagggaaaagaaauuaaaaggauauguagaaacacuuaaacuagacugcagagaacgauuaagaguauucgagaaaagagaaaaaggggaacauccauuacccccacgcauaggugaaauggcaacagaucuagcuaaagacaucauacgaauggugauagaccagggaguaaaacaacgaauaacaucagcuuauuauucagaaauucaaaggugccuagcccaauaugccggugacgauaacaggagacaccucgacucuauaauuagagaacuaagacuaaaagauacuaaaaacggacacccauuccuaggaaaaguacuacgaccagguuuaggucauacagaaaaauuauaccaaagauacuucgaagagaagaaagaauggcucgaagcaacauuuuacccagcagcaaguccuaaaaggguaccaagauucguaaauccaccaacuggcaaacaaaaagagcuaccucuuauaauaagaaauuuaaugaaagaacgaccugaauggagagauuggaaacaaaggaaaaacucacaucccauagacuuaccaucucaacuauucgaaaacgaaaucugcagacuacuuaaagacaaaaucggaaaagaaccgucaggcaaacuaaaauggaacgaaauguuuaaacuuuacugggacaaagaguucccgaauggaaugcaaagauucuacagaugcaaacgaagaguagaagucuucgauaaaguaguagaguaugaauauucagaagaaggaggaaacuacaagaaauacuacgaagcauuaauugacgaaguagugcgacagaaaaucaguaguucuaaagaaaaauccaaacugcaaguagaagaucuaacccucucaguaagacgaguauuuaaacgagcaauuaacgaaaaagaauaccaauuacgguuacuaugugaagaugaucgacuacuauucauggccgucagagacuuguacgauuggaaagaagcacaacuagaccuggauaaaaucgacaauauguuaggcgagcccguaagugucagccaaguaauacaacuagaaggcggccaaccagaugcaguaaucaaagcggaguguaaauuaaaagacguuucaaaacucaugagauacuguuaugauggaagaguuaaaggucuaaugccuuacuuugcuaaccacgaagcaacacaagaacaaguggaaauggaacuucgacacuaugaagaucauagaagaagaguauuuaauugggucuuugcucuagagaaaaguguacuaaagaaugaaaaauuacgacgauuuuacgaagaaagccaagggggaugcgaacauagaagauguauagacgcauuacgaaaagcaaguuuaguuagugaagaagaguacgaguucuuaguacauauuagaaacaaaagugcacauaaccaauuuccagaucuugaaauaggaaaacucccacccaacguaacuuccgguuuuugcgaaugcauauggaguaaauacaaagcaauaauaugucgaauaauaccuuuuauagacccagaaagaagauucuuuggaaaacuacucgaacaaaaauaa

SEQ ID NO: 11881 - RNA, 3675 nt, Artificial Sequence
  Cas13b variant__Bergeyella zoohelcum__WP_002664492.1__Cas13b
auggaaaauaaaacaucacuaggcaacaauauauacuacaaccccuucaaaccacaagacaaaucuuauuuugcaggauacuuuaacgcagccauggaaaacacagauucaguauucagagaacucggaaaacguuuaaaaggaaaagaauacacaucagaaaacuucuuugacgcgaucuuuaaagaaaauauaucauuaguugaauacgaaagguacguaaaauuauuaucagacuauuucccuauggcacgauuauuagauaagaaagaaguucccauuaaagaacgcaaagaaaauuucaagaaaaauuuuaaagguauaauaaaagcaguuagagauuuacgaaacuuuuacacacauaaagaacacggcgaaguugaaauaacagacgaaauauuuggaguacucgaugaaauguugaaaaguacaguacucaccgucaagaaaaagaaagucaaaaccgauaaaacaaaagaaauacuaaagaaaagcauagaaaaacaauuagacauccuaugccagaagaaacucgaauaucuaagagacacugcaagaaaaaucgaagagaaaagaaggaaucaaagagaaagaggugaaaaagaauuaguagccccauucaaauacucggacaaaagagacgaucuaauagcagccauauauaacgacgcguuugacguauauauagacaagaagaaagacucacucaaagaaagcuccaaagcgaaauauaacacaaaaucagacccucaacaagaagaaggagaccuaaaaauaccaauaaguaaaaacggcgucgucuuucuauuaucgcuauuuuuaaccaaacaagaaauucaugcauucaaaagcaaaauagcaggcuuuaaagcaacaguaauugacgaagcaacugucagcgaagccacaguaucacauggaaagaacucaaucugcuuuauggcaacgcacgaaauauucucacacuuagcauacaagaaacuuaaaagaaaaguucgaacugcagaaaucaauuacggcgaagcugagaaugcggaacaacuaagcguguacgcgaaagaaacgcuaaugaugcaaaugcuagaugaacuaaguaaagucccggacguuguauaccaaaauuuaagugaagacguacagaaaacguuuauagaagauuggaacgaauaucugaaagaaaacaacggagauguaggcacuauggaagaagaacaaguuauccacccagucauuagaaaaagguacgaagacaaauucaauuauuuugcuauaagauuccuagacgaauuugcccaauucccuacccuacguuuucaaguacaucuaggaaacuaccuacacgacucacgccccaaagaaaauuuaaucuccgacagaagaaucaaagagaaaauaacagucuucggacgacuauccgaacuagaacauaaaaaggcacuauuuaucaaaaacaccgaaacaaaugaagaccgagaacacuacugggaaauauuuccaaacccaaacuaugauuucccaaaagaaaacauaucaguaaacgauaaagacuuuccuaucgcagggagcauauuagacagagaaaaacaaccgguagcaggaaaaauuggaaucaaaguaaaacucuuaaaccagcaauacgugucggaagucgacaaagcaguaaaagcucaucaacugaaacaacguaaagccuccaaaccauccauacaaaacaucauagaagaaauaguaccaaucaaugaauccaauccuaaagaagcaauaguguuuggcgggcaaccaacagcuuaccuaucaaugaaugauauccauucaauacuuuacgaguucuucgacaaaugggagaaaaagaaagaaaaacucgaaaagaaaggagaaaaagaacuuaggaaagaaauaggaaaagaacucgagaagaaaaucgucggaaaaauacaagcgcaaauacaacaaauaaucgacaaagauacaaacgcuaaaauauuaaaaccuuaccaagacggaaauaguacugcaaucgauaaagaaaaacuaaucaaagaucuaaaacaggaacagaauaucuuacaaaaauuaaaagacgaacaaacagugagagagaaagaauacaaugauuucaucgcauaucaagauaaaaaccgugaaauaaacaaaguaagagaucgaaaccauaaacaauaccuaaaagacaaccucaaacgaaaauaucccgaagccccagcaagaaaagaaguccucuauuauagagagaaaggcaaagucgccguauggcuagcaaacgauauuaaaagauucaugccaacagacuucaaaaacgaauggaaaggagaacaacauucacucuuacaaaaaucccuagccuauuacgaacaaugcaaagaagaacuuaaaaacuuacucccagaaaaaguauuucagcacuuaccguucaaacucggaggauacuuccaacaaaaauauuuauaccaauucuauacuugcuaccuagauaaaagacuugaauacauuucaggucuuguucaacaagcagagaacuuuaaaucagaaaacaaaguauucaaaaaggucgaaaacgaaugcuuuaaguucuuaaagaaacaaaauuacacccacaaagaauuagaugcaagaguacaaucuauucucgguuaccccauauuucuagaacgcggguucauggaugaaaaacccacaauaauaaaaggaaaaacauuuaaaggaaaugaggccuuauuugcagauugguucagauacuacaaagaauaucaaaauuuucaaaccuucuaugauacagaaaacuauccguuaguagaauuagagaaaaagcaggcagacagaaaaagaaaaacaaaaauauaucaacagaagaaaaacgacguguucacacucuuaauggccaaacacaucuucaaaucgguauucaaacaagacucaauagaccaauucagcuuggaagaccuauaucaaagcagagaagaaagacuaggcaaucaagaacgugcaaggcaaacgggagaaagaaacaccaacuauauauggaauaagacagucgacuuaaaacuaugugacgggaagauaacaguagaaaauguuaaacuuaaaaacguaggcgacuucauaaaauaugaauaugaucaacgaguacaagcauuucuaaaauacgaagaaaauauagaauggcaagcauuuuuaauaaaagaaaguaaagaggaagaaaauuauccauauguaguagaaagagaaaucgaacaauaugaaaaaguaagaagagaagaauuauuaaaagaagugcaucuaauugaagaauacauauuagaaaagguuaaagacaaagaaaucuugaagaaaggagauaaucagaacuuuaaauauuacauucugaauggacucuuaaaacagcuuaaaaaugaggauguagaguccuauaaaguuuucaaccuaaacacagaaccagaagacguaaacauuaaccaacuaaaacaagaagcaacugaucuggaacaaaaagcauucguccuaacauacauaagaaacaaguucgcucauaaccagcuccccaagaaagaguucugggauuacugucaagaaaaauauggaaaaaucgaaaaagagaaaaccuaugcagaauacuucgcagaaguauuuaagaaagaaaaagaagcacuaauaaaauaa

SEQ ID NO: 11882 - RNA, 3600 nt, Artificial Sequence
  Cas13b variant__Capnocytophaga canimorsus__WP_013997271.1__Cas13b
augaaaaacauacaacgacucggaaaagggaacgaauucucgccauuuaaaaaagaagacaaauuuuacuuuggaggcuuucucaaucuagccaacaacaacauagaagauuucuuuaaagaaaucauaacccgauucgggauaguuauaacagacgagaauaaaaaacccaaagaaacauuuggagaaaaaauauugaaugaaaucuucaagaaagauauaucaaucguggacuaugaaaaauggguaaacauauuugcugacuacuuucccuucacaaaauaccuuucacucuacuuagaagaaaugcaauucaaaaauagaguaauaugcuuccgugauguaaugaaagaacuacuaaaaacgguggaagcccuaaggaacuuuuacacccauuaugaccacgaacccauaaagauagaagacagaguauuuuacuuucuugacaaaguccuccuagauguuucucucacaguaaaaaacaaauaccugaaaacugacaaaacuaaagaauucuugaaccaacacauuggagaggaauuaaaagaauuaugcaaacaaagaaaagacuacuuaguaggaaaagguaaaagaauagacaaagaaagcgaaaucauuaaugguauauauaacaaugccuuuaaagacuucauaugcaaacgagaaaaacaagacgacaaagaaaaccauaauagcguugaaaagauccuauguaacaaagaaccacaaaacaaaaaacaaaaauccucugcgacuguaugggaacuaugcucaaaaucaucauccaaauacacagagaaaucuuucccaaaucgcgaaaacgacaaacauugccuagaaguaccaauaagucaaaaaggaauaguauuccuacugaguuucuuucucaacaaaggcgagaucuacgcacuaacaucaaauauuaaaggauucaaagcgaaaauuacuaaagaagagccagucacguaugacaaaaacuccauccguuacauggcaacacacagaauguuuucauuccuugcauacaaaggucuaaaacgcaaaauucgaacaagcgaaauaaauuauaacgaagacggacaagcgucaaguaccuaugaaaaagaaacacuaauguuacaaaugcuugaugaacuaaacaaagucccagauguaguuuaucaaaaccuaucagaggacguacaaaaaacauucauugaagacuggaacgaguaucucaaagaaaacaacggagacguagguacaauggaagaagaacaggucauccaucccguuauaagaaaaagauaugaagacaaguucaacuacuucgcaauacgguuucuagacgaauucgcucaauucccaacgcuaagauuucaaguccaucuaggaaacuaccucugcgacaaaagaacgaaacaaauaugcgauaccacaacggaacgagaggugaaaaaaaaaaucacaguauuuggacgccuaagcgaacucgaaaacaaaaaagccauauucuuaaacgagcgugaagaaauaaaaggaugggaaguauucccaaacccuucauacgacuucccgaaagagaauauaucaguaaacuauaaagacuuuccgauugucggcucaaucuuggauagagaaaaacaacccguaucaaacaaaaucggaauacggguuaaaauugcagaugaacuacaaagagagauagacaaagccauaaaagaaaaaaaauugagaaauccaaaaaauagaaaggccaaccaagaugaaaaacaaaaagaaagauuaguuaacgaaauagugucuacaaacucaaaugaacaaggagaaccaguagucuucaucggacaaccaaccgcauacuugagcaugaaugacauacacagcguacuuuacgaauuucuaauuaacaaaauaucuggagaagcacucgaaacaaaaauagucgaaaaaaucgaaacacaaauaaaacaaauuauagguaaagaugccacaacaaaaauccucaaaccguauacaaaugcaaacuccaacucgauuaaccgugaaaaauuauuacgugacuuagaacaggaacaacaaauucuaaaaacccuacuugaagaacaacaacaacgagaaaaagacaaaaaagacaaaaaaaguaaaagaaaacaugaacuauacccaucagaaaaaggcaaaguagcaguuuggcuagcuaaugauauuaaacgauuuaugcccaaagcuuuuaaagaacaauggcgugguuaccaucacucauuacuacaaaaauaccuagcuuacuacgaacagagcaaagaagaauuaaaaaacuuacugcccaaagagguauucaaacacuucccauucaaauuaaaaggauauuuucaacaacaauaccuaaaccaauuuuacaccgauuauuuaaaaagacgucuuuccuaugucaaugagcuacuguuaaauauacaaaauuuuaaaaaugacaaagaugcucuaaaggcuacagagaaagaauguuucaaauuuuucagaaaacaaaauuauauuauaaauccaauaaacauacaaauacaaagcauccucgucuauccaauauuccucaaacgaggcuucuuagaugagaaaccuacuaugaucgaucgagaaaaauucaaagaaaacaaagacaccgaacuagcagauugguucaugcauuacaaaaauuacaaagaagauaauuaccaaaaauucuaugcuuacccccucgaaaaaguagaagaaaaagaaaaauucaaacgaaacaaacaaauaaacaaacaaaaaaaaaaugacguauacacguuaaugaugguagaauauauaauacaaaaaaucuuuggugacaaauucguagaagagaauccacuagugcuaaaagggauauuucagucaaaagccgaaagacaacaaaacaacacgcaugcggcaacaacccaagaacgaaaccuaaacggcauccuaaaccaaccgaaagacauaaaaauacaaggaaaaauaacagucaaaggggugaaacuaaaagauauaggaaacuuccgaaaauacgaaauagaucaacgaguaaacacauuccuagacuacgagccccgaaaagaauggauggcuuauuuaccuaacgacuggaaggagaaagaaaagcaagggcaauuaccaccaaacaacgucaucgaccgacaaaucucaaaauaugagacaguuagaucaaaaauauuauuaaaagacguccaagaauuagaaaaaauuauaucagaugaaauaaaagaagaacacagacaugaucucaaacaaggaaaauacuacaacuuuaaauacuacauccuuaaugggcuucuccgacaacuaaaaaacgaaaacguggaaaacuacaaaguauucaaacuuaauaccaacccggaaaaagucaacaucacacaauuaaaacaagaagccacagauuuagaacaaaaagcauucguauugaccuacauacgcaauaaauuugcacacaaccaauuaccuaaaaaagaauucugggauuacugucaagaaaaauacggcaaaauagaaaaagaaaaaacuuacgcggaauacuucgcagaaguauucaagagggaaaaagaagcacuaauuaaauaa

SEQ ID NO: 11883 - RNA, 3657 nt, Artificial Sequence
  Cas13b variant__Capnocytophaga cynodegmi__WP_041989581.1__Cas13b
auggaaaacaaaacaaguuuagggaauaacaucuauuacaacccauucaaaccacaagauaaaaguuacuuugcaggauaccuaaacgcagcaauggaaaacauagacucaguauuccgagaauuaggaaaaagauugaagggaaaagaauacacaagcgaaaauuucuucgaugcuauauuuaaagagaauauaagucuaguagaauaugaaagauacgucaaacuacuaucagauuauuuuccaauggcuaggcuauuagauaagaaagaaguuccaauaaaagaaaggaaggaaaauuuuaaaaaaaauuuuagagguauaauuaaggcaguacgagacuuacggaauuucuauacgcacaaagaacauggcgaagucgaaauaacugacgaaauauucggcgugcuagaugaaaugcuaaaaaguacaguacuaacgguaaaaaaaaaaaaaauaaaaaccgauaaaacuaaagaaauuuuaaaaaaauccauugagaaacagcuagacauauuaugucaaaaaaaauuagaauaucucaaagacaccgcaagaaaaauagaagaaaaacgaagaaaccaaagggaacgaggagaaaaaaaacugguaccaagauuugaauacagugacagaagggacgacuugauugcggcaauauauaacgacgcuuucgauguauauaucgauaaaaaaaaagauagucuuaaagaaaguucaaaaaccaaauauaauacagaaucauauccucaacaagaagaaggagaccuuaaaauaccaauaagcaaaaacggagugguuuuccuucuaucccucuuuuuaucaaagcaagaaguacacgcauucaaaaguaagaucgcgggauucaaagcgaccgugaucgaugaagcuacaguaucacacaggaaaaauaguauaugcuuuauggcaacccacgaaauauucucacaccuagcuuacaaaaaacuaaaaaggaaagugcgcacggcagaaauaaacuacucagaagccgaaaacgcugaacaacuaucaauuuacgcuaaagagacacuaaugaugcaaauguuagaugaacuaucaaaagucccagacgugguuuaccaaaaucuaucagaagauguccaaaaaacauucaucgaagacuggaacgaauaccuaaaagaaaauaacggagauguagggacaauggaagaagaacaaguaauacaccccguaauuaggaaacguuacgaagauaaauuuaauuacuucgcaauacgauuccuugacgaauucgcacaguuccccacccuaagauuccaaguccaccuaggcaauuaucugcacgacagcagaccaaaagagcaccuaauauccgaccgacgcauaaaagagaaaauaacgguauucggucgauuaucugaauuagaacacaaaaaagcacuuuuuauaaaaaacacagaaacgaacgaagaucguaaacacuauugggaaguauucccaaacccaaauuacgauuucccaaaagaaaacauaagcguaaacgacaaagacuucccaauagcagguucgauacuagauagagaaaaacaaccaaccgcaggaaaaauaggcauaaagguaaauuugcuaaaccaaaaauacauaucagaggucgauaaagcagucaaagcacaccaacucaagcagagaaauaacaaaccuucaauucagaauauaaucgaggagauaguaccaauaaacgggucaaauccaaaagaaaucauaguuuucggaggacaaccaaccgcguacuugucuaugaaugacauacacucaauacucuacgaguuuuucgacaaaugggaaaaaaaaaaagaaaaacuagaaaaaaaaggcgaaaaagaacuucgaaaagagauaggcaaagaacucgaagaaaaaauagugggaaaaauccaaacacaaauacaacaaauuauugacaaagauauuaaugcaaaaauauugaaaccuuaccaagacgacgauucaacagcgauagacaaagaaaaguugaucaaagaccuaaaacaagaacaaaaaauauuacaaaaacucaaaaaugaacaaacagcccgagaaaaggaauaccaagaaugcaucgcauaccaagaagaauccagaaaaauaaagagaucagauaaaucacgacaaaaauaccuuagaaaccaguugaaaaggaaauaccccgaaguacccacgaggaaagaaauuuuauauuaccaagagaaaggaaaaguggcuguauggcucgcaaaugauauaaaacgauucaugcccacagacuucaaaaaugaauggaaaggcgaacagcacucuuuauugcaaaagucacuagcauacuacgaacaauguaaagaggaauuaaaaaaccuacucccucaacaaaaagucuuuaagcauuugccuuucgaacuaggaggccauuuucaacagaaauaucuuuaccaauuuuauacaagauauuuagacaaacgauuagaacacauaucaggucuaguacaacaagccgagaacuucaaaaacgaaaacaaaguauuuaaaaaaguagaaaacgaauguuuuaaauuuuugaaaaaacaaaauuacacacacaaaggauuagaugcacaagcucaaucaguacuaggauaccccauauuucuagaaagaggcuuuauggaugaaaagccaacuauaauuaaaggaaaaaccuuuaaaggaaacgaaucuuuauuuacagacugguuccgauacuauaaagaauaccaaaauuuccaaacauucuacgacacagaaaacuauccauuaguagagcuagaaaaaaaacaagcagaccgaaaacgagagacaaaaauauaccaacaaaaaaaaaaugaugucuuuaccuuacuaauggcaaaacacauauuuaaaucuguauuuaaacaagacuccauugauagauucucccuagaagaccucuaucaaagcagagaagaacgacuagaaaaucaagaaaaagcgaaacaaacaggagaaagaaacacaaacuacauauggaauaaaacagucgaccuaaaucuaugcgauggaaaaguaaccguagaaaauguaaaacugaaaaacgucggaaacuuuauuaaguacgaauaugaccaaaggguacaaaccuuccucaaauacgaagaaaauauuaaauggcaagcauuucuuauaaaagaaagcaaagaagaggaaaacuauccauauauaguagaaagagagauagaacaauacgaaaaaguaagaagagaagaauuauuaaaagaaguucaucuuauugaagaauauauacuagaaaaagucaaagacaaagaaaucuuaaaaaagggagacaaucagaauuuuaaguauuacauacuaaacggacuauuaaaacaauuaaaaaacgaagauguagaaucauauaagguauucaacuuaaacacaaaaccggaagaugugaauauaaaucaacuuaaacaagaagccacagacuuggaacaaaaagccuuugugcuaacauacaucagaaacaaguucgcgcacaaccaauuaccaaagaaagaauuuugggacuacugucaagaaaaauauggaaaaauagaaaaagagaaaaccuacgcagaguacuucgcggaaguguucaaaagagagaaagaagccuuaaugaaauaa

SEQ ID NO: 11884 - RNA, 3438 nt, Artificial Sequence
  Cas13b variant__Chryseobacterium sp.__WP_047431796.1__Cas13b
auggaaacccaaacaaucggccacggaaucgcauacgaccauucaaaaauccaagacaaacacuuuuucggaggguucuuaaacuuagcugaaaauaacauaaaagccguacucaaagccuuuucugaaaaauucaaugucgguaauguagauguaaaacaauuugccgacguaucccugaaagauaacuuaccagauaacgauuuccagaaaagaguaucauuucuuaaaauguacuucccaguugucgauuucauaaauaucccaaauaaccgagcaaaauucagauccgacuuaacaacccucuucaaaaguguagaccaacugcguaauuucuacacucacuauuaccacaaaccucuagacuucgacgcaagccuauuuauauuauuagaugacaucuuugcccgaacagcaaaagaaguaagagaucagaaaaugaaagacgauaaaacacgacaauuacuaaguaaaucuuuaucggaagaauuacaaaaagguuacgaacuacaacuggaaagacuaaaagaauuaaauagacuaggaaagaaagucaacauccaugaccaauuagguauuaaaaauggaguacucaacaacgcuuucaaccaccuaauauauaaagauggcgaauccuucaaaacaaaacuaacauacuccucugcuuugacaucauucgaaucagcagaaaacggaauagaaauaagucaaucaggauuacucuuuuuacuaucgauguuccuuaaacgaaaagaaaucgaagaccuaaagaacagaaacaaaggauucaaagcaaaaguaguaaucgacgaggacgguaaaguuaacggccuaaaguuuauggcaacacacuggguauuuagcuacuuaugcuucaaaggccucaaaucaaaauuaucaaccgaguuccaugaagaaacauuauuaauacaaauuauagacgaacuaucuaaaguaccagacgaacucuacugugccuucgacaaagaaacacgagacaaauucauugaagacauaaacgaauauguaaaagaaggacaucaagauuucucccuagaagacgcaaaagucauucacccagucauacgaaaacgauaugaaaauaaauucaacuacuuugcuauaagauucuuagaugaguucgucaaguucccaucacuaagauuccaaguacacguaggcaauuauguacacgacagaagaaucaaaaacauagauggcacaacauuugaaacugaacgagucgucaaagaccgcaucaaaguuuucggaagauuauccgaaauauccaguuacaaagcacaauaccucucaucagucucugacaaacacgaugaaacuggaugggaaauauuuccaaaucccagcuacguuuuuauaaacaauaacauccccauucacauaucaguagacacaucauucaagaaagaaauagccgacuuuaagaaauuaaggagagcacaagucccagacgaacuuaaaauaagaggugccgaaaagaaaagaaaauucgaaauaacccaaaugaucggaucaaaaucgguacuuaaccaagaagaacccauagcauuacugucacuaaaugaaauaccggcauuacuauaugaaauacucauaaacggcaaagaaccagcggaaauugaaagaaucaucaaagauaaauuaaacgaaaggcaagacguaaucaaaaauuacaauccagaaaauugguugcccgcaagucaaauaaguagaaggcugagaagcaauaaaggugaaaggauaaucaacaccgauaaacuacuccaacucgugacaaaagaauuauuaguuacagaacaaaaacucaaaauaauaucggacaaucgcgaagcccuaaaacaaaagaaagaaggaaaauauauaagaaaauucaucuucacaaacucugaacuagguagggaagccauuugguuagcugacgauaucaaaagauucaugccagcagauguacgcaaagaauggaaaggauaucaacauucucaauuacaacaaucacuugcuuucuacaauuccagaccaaaagaagcacuagcaaucuuggaaucaucuuggaaucuaaaagaugagaaaaucauuuggaacgaauggaucuuaaaauccuuuacgcaaaacaaauuuuucgacgcauucuacaaugaauacuuaaaaggaagaaagaaauacuuugcauuuuuaucugaacauauaguccaauacacaaguaaugcgaaaaaccuacaaaaauucauaaaacaacaaaugccaaaagaccuauucgagaaaagacauuacaucauugaagaccuacagacugagaaaaacaaaauacuauccaaacccuuuauauuucccagagggauuuucgacaagaaaccaaccuucauaaaagguguaaaaguagaagauucucccgaauccuucgcaaacugguaccaauacggauaccaaaaagaucaccaauuccaaaaauucuacgauuggaaaagagauuauucugacguauuucucgaacauuuaggaaaaccauucaucaauaauggcgauagaagaacacuaggaauggaagaacuuaaagaaagaauaauaauuaaacaagaccuaaaaauaaagaaaauaaaaauucaagaccuauucuuacguuuaauagcagaaaaucuauuucaaaaagucuuuaaauacuccgcaaaacugccauugagugacuuuuaucuaacucaagaagaaagaauggaaaaagaaaacauggcagcacugcaaaauguaagggaagaaggcgacaaaucaccaaacauaaucaaagacaauuuuauuuggaguaaaaugauaccauacaagaaaggacaaauaauagagaacgcugugaaacuaaaagauaucgguaaauuaaauguacucagucuagacgacaaaguccaaacgcuacuaucauacgacgaugcaaaaccauggucaaaaauagcacuagaaaacgaguucucuauaggcgaaaacucauacgaaguaauaagacgugaaaaacucuuuaaagaaauacaacaauucgaaagugaaauacucuuucggucugguugggauggaauuaaccauccugcucaacucgaagauaauagaaacccaaaauucaaaauguacauaguaaaugggaucuuacgcaaaucagcaggacucuauagccagggagaagacauaugguuugaauauaaugccgauuucaacaauuuagacgcagauguauuagaaacaaaaagcgaacuuguacaacuagcuuucuuaguaacagcaauaaggaacaaauucgcucacaaucaacuaccagcaaaagaauuuuacuucuacauucgagcuaaauaugguuucgcugacgaaccauccgucgccuuaguuuaucuuaacuuuaccaaauaugcaauaaaugaauuuaagaaagugaugauuuga

SEQ ID NO: 11885 - RNA, 3453 nt, Artificial Sequence
  Cas13b variant__Flavobacterium branchiophilum__WP_014084666.1__Cas13b
auggaaaacuuaaauaaaauacucgacaaagaaaacgaaauaugcauauccaaaauauuuaauacgaaaggaauagcugcaccaauuacugaaaaagcacucgacaacaucaaaucaaaacagaaaaaugaucuuaauaaagaagcaagauuacauuacuucuccauuggacauucauucaaacaaaucgauaccaagaaaguauucgauuacguacucaucgaagaacucaaagaugaaaaaccauuaaaauucauaacacuucaaaaagacuuuuucacaaaagaauuuuccauaaaacuacaaaaacucauaaauucaauaaggaauaucaacaaucauuacguacacaacuuuaacgacauaaaccuaaacaaaauagacucaaacguauuccacuuucuaaaagaauccuucgaauuagcaauaauagaaaaauacuacaaaguaaauaagaaauacccacuagauaaugaaauaguccuuuuccucaaagaauuauucauaaaagaugaaaauacagcgcuucuaaauuauuucacaaaccuguccaaagaugaagcaaucgaauacauccuaacguucacaauaacagaaaacaaaaucuggaacauaaacaacgaacauaacauacucaauauagaaaaagguaaguaucucacauucgaagccaugcuuuuccuuaucacaauauucuuauacaaaaaugaagcaaaucaccuacucccuaaacuuuacgacuucaaaaauaacaaauccaaacaagaauuauuuacuuucuucucuaagaaauuuacaucucaagauauagacgcagaagaaggacaccuaauaaaauucagagacaugauucaauaucuuaaccacuacccaacugcauggaauaacgacuuaaaacuggagagcgaaaacaaaaacaaaaucaugacaacaaaacugauagacaguaucauagaguuugaacuuaauucaaacuaccccucauucgcaacagauauacaauucaagaaagaagccaaggcuuuccucuucgcaucaaauaagaaacgaaaccaaacauccuuuucaaauaaauccuacaacgaagaaauccgacacaacccacacauuaaacaauaucgagaugagauagccucagcauuaacaccuaucaguuucaacguaaaagaagacaaauuuaaaauauuugucaagaaacacgugcuagaagaauacuuccccaacuccauaggauacgaaaaauuucuugaguauaacgauuuuacagaaaaagaaaaagaagauuucggauugaaacuauacucaaauccuaaaacaaacaaacucauugaacguaucgauaaccauaaguuagugaaaagccacggacgaaaccaagacagauuuauggauuuuagcaugagauucuuagcagaaaacaauuauuucggaaaagacgcauuuuucaaauguuauaaauuuuacgacacacaagaacaagacgaguuccuacaaaguaacgaaaacaacgacgacgucaaauuucacaaagguaaaguuacaaccuacauaaaauacgaagaacaccucaaaaauuacucauauugggacugcccguuuguggaagaaaauaacuccauguccguaaaaauuucgaucggaucagaagagaaaauacucaaaauacaacgaaaucuuaugauauacuuccucgaaaacgcauuauauaaugaaaacguugaaaaucaaggauacaaauuaguaaacaacuacuaccgagagcuaaagaaagacgucgaagaaaguauagccucgcuagaccuuauuaaauccaauccagacuucaaaagcaaauauaagaaaauacucccuaaaagacugcuccauaauuacgcccccgccaaacaagauaaagccccggaaaacgccuuugaaacguuacucaagaaagcagacuuccgagaagaacaauacaagaaacuacuaaagaaagcagaacacgagaaaaacaaagaggauuucguaaaaagaaacaaagguaaacaguuuaaacuacacuuuauuagaaaagcaugccaaaugauguacuucaaagaaaaauacaauacacuaaaagaaggaaacgccgccuucgagaagaaagauccugucauagaaaaacguaaaaacaaagaacacgaguucggacaccacaaaaaccuaaauauaaccagagaagaguucaacgacuacugcaaauggauguucgcuuucaacggcaacgacaguuacaagaaauaucuaagagacuuauuuucagaaaaacacuucuuugacaaccaagaauacaaaaaccuauucgaaucaucaguaaaucuagaagccuucuacgcaaaaaccaaagaacuguuuaagaaauggauugaaaccaacaaacccacaaauaacgaaaaccgauauacucuagaaaacuauaaaaaucuaaucuuacaaaaacaaguauuuauaaacguauaccacuuuaguaaauaucucauugacaaaaaccuccucaauuccgaaaauaacguuauacaauacaaaucacucgaaaauguagaauacuuaaucucugauuucuacuuccaaucaaaauuauccauagaucaauauaaaacaugcggaaaacuauucaacaaacuuaaaucaaacaaauuagaggacugccuccucuacgaaauugccuauaacuauaucgacaagaaaaauguacacaaaauagacauucagaaaauuuugacuucaaaaaucauccuaacuauaaacgaugcgaacaccccauacaaaaucagugucccauucaacaaacucgaaagauacacagaaaugaucgcaauuaaaaaccaaaacaaccuaaaagcuagauucuuaauagaucucccacuauauuuauccaaaaacaaaaucaagaaagggaaagauagugcagguuacgaaauaaucaucaaaaaugaccuagaaauagaagauaucaauaccaucaacaacaaaauaaucaaugacucagucaaauucaccgaaguccucauggaacuugaaaaauacuucaucuuaaaagacaaauguauucuuaguaaaaauuacauagauaacucagaaauaccauccuuaaaacaauuuucaaaagucuggaucaaagaaaacgaaaacgaaauaauaaacuauagaaacauagcuugccauuuccauuuacccuuacuagaaacguucgacaaccuacuucuaaauguagaacaaaaauuuauuaaagaagaauuacaaaacguaagcaccaucaacgaucucuccaaaccacaggaauaccuuauacuacucuucauaaaauucaaacacaauaacuuuuaccucaaccuauucaacaaaaaugaauccaaaaccauuaaaaacgacaaagaaguuaagaaaaacagaguccuacaaaaguucauaaaucaaguaauacuaaagaagaaauaa

SEQ ID NO: 11886 - RNA, 3642 nt, Artificial Sequence
  Cas13b variant__Flavobacterium columnare__WP_060381855.1__Cas13b
augucauccaaaaacgaaucauacaacaaacagaaaacauuuaaccauuacaaacaagaagauaaauacuucuuugguggauuucuaaacaacgcagacgacaaccuaaggcagguuggaaaagaauuuaaaacaagaaucaauuuuaaucacaacaacaacgaacuagcaucaguauucaaagacuauuucaauaaagagaaaagugucgcaaaacgagaacacgcuuuaaaccuccuuuccaacuacuucccaguccuggaaaggauucaaaaacacacuaaucacaacuucgaacaaacuagagaaauuuucgaacuuuuacuagacaccauuaagaaacuaagagacuacuacacucaccauuaucacaaaccaauuacuauaaacccgaaaguguacgacuuucuagacgacacacuuuuagacgucuuaauuacaaucaaaaagaagaaaguuaaaaaugauaccucucgagaacuacucaaagaaaaauuccgcccagaacucacacaacuaaagaaccagaaaagagaagaauuaaucaagaaaggcaagaaacuacuagaagaaaauuuagaaaaugccgucuucaaucacugcuuacgucccuucuuagaagaaaacaaaacagacgauaaacaaaauaaaacggucucccuccgcaaauaccgcaaaucaaaaccaaacgaagaaaccucgaucacauuaacacaauccggacucguauuccuaauaucauucuucuugcauagaaaagaauuucaaguguucaccucagggcuagagggauucaaagcaaaagucaauacuauaaaagaagaagaaauaagucuaaauaaaaacaauauaguauauaugauaacccauuggucguacucuuauuacaacuuuaaagguuuaaaacaccguaucaaaaccgaccaaggaguaucaacacuugaacaaaacaacaccacacauagccuaacaaauaccaacaccaaagaagcacuccuaacacaaauaguagauuaucucucaaaaguaccaaacgaaauuuaugaaacucuaagcgaaaaacaacaaaaagaguucgaagaagacauaaacgaauauaugcgagaaaacccagaaaacgaagacuccacauucagcagcauuguaagucacaaagugaucagaaaaagauaugaaaauaaauucaacuacuuugcaaugagauuucucgacgaauaugcagaauuaccaacccuuagauuuaugguaaacuucggagacuauauaaaagauagacagaagaaaauauuagaauccauacaauuugacuccgaaagaauaauaaagaaagaaauacacuuauuugaaaaacuaggccuagucacagaauauaagaaaaaugucuacuugaaagaaaccucgaacauagacuuaagccgauucccucucuuccccagcccaucauauguaauggccaacaauaauauaccuuucuacauagauucucguucaaauaaccuagaugaauaccucaaccagaaaaagaaagcacaaucgcaaaaccgcaaacgcaauuuaacauucgaaaaauacaauaaagaacaaucaaaagacgcaauaauagcaauguugcaaaaagaaauaggaguaaaagaccuccaacagagaagcaccauaggacuacuaaguuguaacgaacuacccucaaugcucuacgaaguaaucguaaaagacauuaaaggagcagaacuagaaaacaaaauagcucagaaaauuagagaacaauaccaauccauacgagauuuuacccuugauucuccacaaaaagacaacaucccaacaacacuuaccaaaacaauuucaacagacacaucaguaaccuuugaaaaccaacccauagacauuccacgacucaaaaaugcucuacaaaaagaacucaccuuaacacaagaaaaacuacucaauguaaaacaacacgaaauugaaguagauaauuauaaucggaacaaaaacacauacaaauucaaaaaccaaccuaaagacaaaguagaugacaacaaauuacaacggaaauacgucuucuaucguaacgagaucggacaagaagcuaauugguuagccagcgacuuaauccauuucaugaaaaacaagagcuuauggaaaggauauaugcacaacgaacuacagagcuuucuagccuucuuugaagacaagaaaaaugauuguaucgcacuuuuagaaaccgucuucaaccuuaaagaagacuguauauuaacaaaagaucugaaaaaccuauuccugaaacacggcaauuuuauagauuucuauaaagaguaccugaaacuaaaagaagauuuccuaaauacagaaucuacauuucucgaaaauggauuuaucggacuaccgccuaaaauccuaaagaaagaauuaagcaaaagauuaaacuauaucuucauaguuuuccaaaaacgccaauucauaaucaaagaacuggaagaaaagaaaaacaaccuauacgcagacgcuauaaaucuuucaagaggaauauucgaugaaaaaccaacaaugaucccauucaagaaacccaaccccgacgaguuugcauccugguuuguagcauccuaccaauauaacaacuaucaaucauucuacgagcuuacuccugauaaaauagaaaacgacaagaagaagaaauacaaaaaccuaagagcaauuaauaaaguuaaaauacaagacuacuaccuaaaacuuaugguagacacccuauaucaagaucucuucaaccaacccuuggacaaaucacucucagacuucuacgucaguaaaaccgacagagaaaagauaaaagcugacgcaaaagcauaucagaaaagaaacgacucauuucuauggaauaaaguaauccaucuaucacuccaaaacaacagaaucaccgccaauccuaagcuaaaagacauagggaaauauaaaagagccuuacaagacgagaaaauagcaaccuuacuuacauaugacgauagaacauggaccuacgcacuccaaaaaccugaaaaggaaaacgaaaaugacuacaaagaauuacacuacacagcacuuaacauggagcuucaagaauacgaaaaaguaagauccaagaaacuacugaaacaaguacaagaacuggaaaaacagauacuagacaaauucuaugacuucagcaacaacgcaacccaccccgaagaccucgaaauugaagauaagaaaggaaaacgccacccaaauuucaaauuauacaucaccaaagcacuccucaaaaacgaaagugaaaucauaaaccuggaaaacauugacaucgaaauuuuaauuaaauacuacgacuacaauacagagaaacuuaaagagaaaaucaaaaacauggacgaagacgaaaaagccaaaauuguaaacaccaaagaaaacuauaacaaaauuacaaauguacuuaucaagaaagccuuaguacucaucaucaucagaaauaaaauggcacacaaccaguauccacccaaauucaucuaugaucuagcaaccagauuuguacccaagaaagaagaagaauacuuugcuugcuauuucaauagaguguuugaaacaauaacuacagaacuaugggaaaacaagaaaaaggcuaaagaaauuguauag

SEQ ID NO: 11887 - RNA, 3540 nt, Artificial Sequence
  Cas13b variant__Flavobacterium columnare__WP_014165541.1__Cas13b
augucauccaaaaacgaaaguuacaauaaacagaaaacauucaaccacuacaaacaagaagacaaauacuucuucggaggauuuuuaaacaacgcugacgacaauuuaagacaaguagguaaagaguucaaaacaagaauaaacuucaaucacaacaacaaugaacucgcuucagucuucaaagacuacuuuaauaaagagaaaagcguugcgaaaagagaacacgcacuaaaucuuuuaagcaacuauuucccaguauuagaacgaauacaaaaacauacaaaccacaacuucgaacaaacaagagaaaucuucgaauuauuauuagacacaaucaagaaacuaagagauuacuacacgcaccacuaccauaaacccauaacaauuaauccaaaaauauaugacuuucuagacgacacacuauuagauguccucauaacaaucaagaagaagaaagucaaaaacgauaccucacgagaacuccuuaaagaaaaacuaagaccagaauuaacacaacuuaaaaaucaaaaacgagaagaacuaaucaagaaaggcaagaaacuccuagaagaaaaucuagagaaugcaguauucaaccacugucuuaggccauuccuagaagaaaacaaaaccgacgauaaacaaaacaaaaccguaucccuaagaaaauacagaaaaucaaaaccaaacgaagaaacuuccauuacacucacccaaucuggauuaguuuuccuaaugucuuucuucuuacaucgcaaagaauuucaaguauucacauccggauuagaagguuuuaaagcaaaaguuaauacaauaaaagaagaagaaauaucauuaaacaaaaacaacauaguauauaugauaacccacuggucauacagcuacuacaacuucaaaggacuuaaacaccgaauaaaaacagaucaaggagucuccacacuugaacaaaacaauacaacccacagucuaaccaauacaaacacaaaagaagcguuacuaacgcaaaucguagacuaucucaguaaaguaccaaacgaaauauaugaaacacugagugaaaaacaacaaaaagaauuugaagaagacaucaacgaauacaugagagaaaacccugaaaacgaagauucuacauuuucaagcauuguuucccauaaaguuauaagaaaaagauaugaaaacaaauuuaauuacuucgcuaugcgauuuuuagaugaauacgcagaacucccaacgcuuagauuuauggucaacuuuggagacuacauuaaagacagacaaaagaaaauacuugaaucaauccaauucgauucagagcgaaucauaaagaaagaaauucacuuauuugaaaaauuaucccuagucacagaauauaagaaaaauguauaucucaaagaaacaucaaacauagaccucucaagguucccuuuauuuccaaauccaucauacguaauggcuaacaauaauauaccuuucuacauugacucacguuccaauaacuuagaugaauaccuaaaucagaaaaagaaagcucaaucccaaaacaagaaacguaauuuaaccuucgaaaaauauaacaaagagcaaucaaaagaugcaauaaucgcaaugcuucaaaaagaaauugggguaaaagaucuacaacaaagauccacaauaggauuacucucaugcaacgaacuaccauccauguuauacgaaguaauuguaaaagacauaaaaggagccgaauuagaaaacaaaauugcacagaaaauacgagaacaauaccaaucuauucgugauuucacucuagacuccccacaaaaagacaacauacccacaacccucauuaaaacaauaaauacagacucgucuguaaccuuugaaaaucaaccaauagacauaccucgacucaaaaaugcuauccaaaaagaauuaacauuaacucaagaaaaacugcuaaacguaaaagaacaugaaauagaaguagacaauuacaaccgaaacaaaaacaccuacaaauuuaaaaaccaacccaaaaauaaaguagaugauaagaaacuccaaagaaaauacguuuucuaccguaacgaaauucgacaagaagccaacuggcuagcuucagaccuaauacacuucaugaaaaacaaaucucuuuggaaaggauauaugcauaacgaacuccaaucuuuccuagccuucuucgaagauaagaaaaacgauugcauugcccuacucgaaacaguauucaaucuuaaagaagacugcaucuuaacgaaaggccucaaaaaccuauuuuuaaaacacggaaacuuuaucgauuucuauaaagaguacuuaaaacugaaagaagauuuucuaaauacagaauccacguuuuuagaaaacggacucauaggcuuaccaccaaaaauucucaagaaagaauuauccaaaagauucaaauacaucuuuauaguauuccagaaaagacaauuuauaaucaaagaguuagaggagaagaaaaacaaccuuuaugccgacgcaauaaauuuaagcagaggaauauuugaugaaaaaccaacgaugauuccguuuaagaaacccaauccagacgaguucgcaaguugguucgucgcaaguuaccaauauaacaacuaucaaucauucuacgaacuaacucccgacauaguagaaagagacaagaaaaagaaauacaaaaaccuaagagcaauuaauaaaguaaaaauucaagacuacuaccugaaauuaaugguagacacucuuuaccaagacuuauuuaaucaaccacuggauaaaucacuaucugacuuuuacguauccaaagccgaaagagagaaaauaaaagccgaugcaaaagccuaccaaaaacgaaacgacucuucucuauggaacaaaguaauacauuuaagccuacaaaacaacagaauaacagccaacccaaaacuuaaagauaucggcaaauauaaacgugcacuucaagaugagaaaaucgccacccuacucacuuacgacgaccgaacauggacauaugcgcuccaaaaacccgaaaaagaaaacgaaaacgacuacaaggaauuacauuacacugcccuuaauauggaacuacaagaauacgaaaagguaagauccaaagaacuccuaaaacaagugcaagaacuagaaaagcaaauacuagaagaauauacugacuuucuauccacccaaauccacccagccgacuuugaaagggaagguaacccaaacuucaagaaauaucuagcccacucaauauuagagaacgaagacgaucuagauaaguuaccagaaaaaguagaagcaaugagagaacuagacgaaacgauaacaaauccaauaaucaagaaagcaaucguucucauaaucauaagaaacaaaauggcacauaaccaauauccaccgaaauucauuuacgaccuagcaaaccgcuucguucccaagaaagaggaagaauacuucgccaccuauuuuaacagaguauucgaaacuauaacaaaagaacucugggaaaauaaagagaagaaagauaaaacccaaguauaa

SEQ ID NO: 11888 - RNA, 3642 nt, Artificial Sequence
  Cas13b variant__Flavobacterium columnare__WP_063744070.1__Cas13b
augagcuccaaaaacgaaagcuacaacaaacaaaaaacauucaaucacuacaagcaggaagauaaauacuuuuucggaggauuccuaaacaacgcggacgacaacuuaagacaagucggaaaagaauucaaaacacguaucaacuucaaccauaauaacaacgaacuagcuuccguauuuaaagauuacuucaacaaagaaaaaucaguagccaaaagagaacacgccuugaaucuacuaucaaauuacuuccccguucuugagaggauccagaaacauacuaaucacaacuuugaacagacccgcgaaauauucgaacuacuacucgacacaauuaaaaaauuacgagauuacuacacacaccacuaccacaaaccaaucacaauaaacccaaaaauauacgacuuccucgaugacacacuccuagacguuuuaauaacaaucaagaaaaaaaaaguaaaaaacgacaccucacgggaacuacucaaagaaaaacuacgaccggaacuuacacaacuaaaaaaucaaaagagagaggaacuaauaaaaaaaggaaaaaaacuguuggaagaaaaccuagaaaaugcgguauuuaaccauugccuacgacccuuucuagaagaaaauaaaacagaugacaagcaaaacaaaacaguaucccucagaaaauauagaaaaucaaaacccaaugaagagacgucaaucacucuaacacaaucaggucucguuuuucucauguccuucuuccuacauaggaaagaauuccaaguauuuacaagugggcucgaaggauuuaaagccaaaguuaacacaaucaaagaagaaaaaaucuccuuaaauaaaaacaacauaguauacaugauuacacacuggucauauucuuacuacaacuuuaaaggacuaaaacauagaauaaaaacagaccaaggcgucaguacccuugaacaaaacaacaccacccauucccugacaaauacaaacaccaaagaagcauuacucacucaaaucguagauuacuuaucaaaaguuccuaaugagauuuacgaaacauuaucagaaaaacaacaaaaggaauuugaagaagacauuaaugaauauaugagagaaaauccugaaaacgaggacucaacguucuccucuauuguaucacacaaaguaauccgaaaacgcuacgaaaauaaauuuaacuacuuugcaaugcgauuucuagacgaauacgccgaacuccccacgcuacguuucauggucaacuuuggugacuacauaaaagaucgacaaaaaaagauucuugaaucaauucaauucgacagugaaagaaucaucaaaaaagaaauacaccuauucgaaaaacuaggauuaguaacagaauacaaaaaaaacguauacuuaaaagaaacauccaacauagaccuaucucgcuucccccuauucccuucucccucuuauguaauggcaaauaacaauauucccuuuuacauugauagcagaagcaacaauuuagacgaauaccuaaaccaaaaaaaaaaagcacaaagccaaaacaggaaaagaaaccuaacauucgagaaauauaauaaagaacaguccaaagaugccaucaucgcuaugcuccaaaaagaaauaggcguaaaagaccuccaacaaagauccacaauaggauuguuaucaugcaacgagcuuccuaguaugcucuaugaagugauuguaaaggacaucaaaggcgcagaacucgagaacaaaauugcacaaaaaauuagagaacaauaccaaucaauacgcgauuuuacccuaaacaguccacaaaaagacaauauccccacaacacucauuaaaaccauaucuacagacacuucagucacuuuugaaaaccaacccauagacauaccacgccuuaaaaacgcuauacaaaaagaacuagcauuaacacaagaaaaacuuuuaaacguaaaacaacaugaaauagaagucaauaacuacaaucgaaacaaaaacacauauaaauucaaaaaucaaccaaaagauaagguagacgauaacaaacuacaacgaaaauacguauuuuacagaaacgaaauaggacaagaggcaaauuggcucgcuucagauuuaauacauuucaugaagaacaaaaguuuauggaaaggcuauaugcacaaugaacuacaaagcuuucuagccuuuuucgaagacaaaaaaaacgacugcauagcccuuuuagaaacuguauuuaaccucaaagaagacugcauacuaacaaaagaucuaaagaacuuauuccuuaagcauggaaauuucauagacuucuacaaagaauacuuaaagcuaaaagaagacuucuugaacacagaaagcacguucuuagaaaacggcuucauagggcuuccaccaaaaaucuuaaaaaaggaacugaguaaacgcuuaaacuacauuuuuauagucuuucaaaaacgacaguuuauaaucaaggaacuagaagaaaagaaaaacaaccuuuacgccgacgcaauaaaucuuucacgcggaauauucgacgaaaaacccacaaugauucccuuuaaaaaaccaaacccugacgaauucgcguccugguuuguagccagcuaucaauacaacaauuaucaaucuuuuuacgaauuaacaccagacaaaauagaaaaugauaaaaaaaaaaaauacaaaaacuuacgcgcaauaaauaaaguaaaaauccaagacuauuaucuaaaauuaauggucgacacccuguaccaggaccuauucaaucaaccacucgauaagucacucucagauuucuacguaucaaaaacugaucgagaaaaaaucaaagccgacgcaaaggccuaccaaaaacgaaacgacucauuccuauggaauaaaguuauacacuuaaguuuacagaacaaccgaauaaccgcuaauccuaaacuaaaagacauagguaaauauaagagagcauuacaagacgaaaaaauagcaacccuucugacuuacgacgaccggacauggaccuaugcacuccaaaaaccugaaaaagagaacgaaaacgacuacaaagaacuccacuauaccgcccuuaacauggaacugcaagaauaugaaaaagucaggucaaaaaaauugcucaaacaaguacaagaacuagaaaaacaaauacuagauaaauucuacgacuucucuaacaacgccacacacccagaagaccucgaaauagaagacaaaaaagguaaacgacacccgaacuucaaacuauacaucacgaaagcucuauuaaaaaaugaaucagaaaucauuaaccuagaaaacaucgauauagaaauccuaauaaaauacuacgacuacaauacagaaaaacuuaaagaaaaaauuaaaaacauggaugaagacgagaaagcaaaaauuguaaauaccaaagaaaauuauaacaaaauaacgaauguacugaucaaaaaggcccugguauuaauuauaauaagaaauaaaauggcacacaaccaauacccaccaaaauucauauaugauuuagcaacccguuucguuccaaaaaaagaagaagaauauuucgcauguuauuuuaacaggguguuugaaaccaucacaaccgaacuuugggaaaacaaaaaaaaagcaaaggagaucguauaa

SEQ ID NO: 11889 - RNA, 3645 nt, Artificial Sequence
  Cas13b variant__Flavobacterium columnare__WP_065213424.1__Cas13b
augucaucaaaaaacgaaucuuauaacaaacaaaaaacauucaaucacuauaaacaagaagacaaauacuucuuuggugguuuccucaauaacgcagacgauaauuuaagacaaguugggaaagaguucaagaccagaauaaacuucaaccacaacaacaacgaauuagcauccguauucaaggacuacuucaacaaagaaaaaagcguagcaaaacgagaacacgcauuaaaccuacuauccaauuauuucccaguacuagaacgcauccaaaaacauacaaaccauaauuuugaacaaaccagagaaaucuucgaacuacucuuagauacaauaaaaaaauuacgagauuauuauacucaucacuaucauaaacccaucacaauaaacccaaaaauuuacgauuuucucgacgacacacuacuugacgucuuaaucacuaucaaaaaaaagaaagucaaaaacgacacuucacgagaauuacuaaaagaaaaacuaagaccagagcuuacacaauuaaaaaaccaaaaacgcgaggaacucauuaaaaaaggaaaaaaacucuuggaagaaaacuuggaaaacgccguauucaaccauugcuuaauacccuuccuagaggaaaauaaaacugaugauaaacaaaacaaaacagucucauuacguaaauacagaaagagcaaaccaaaugaggaaacauccauuacacuaacacaaucaggacuagucuuuuuaauguccuucuuccugcacagaaaagaauuccaagucuucacaaguggucuagaaagauucaaagcaaaaguaaacaccauaaaagaagaagaaauuucacucaauaaaaacaacauuguauacaugaucacacacuggagcuauagcuauuauaacuuuaaaggacuaaaacaucgaaucaaaacagaucaagguguaucaacccuugaacaaaacaacaccacacauagccuaacaaauaccaacacuaaggaagcccuauuaacucaaauaguagacuaucuaucaaaaguaccaaacgaaauauaugagacacuaucugaaaaacaacaaaaagaauuugaggaagauaucaaugaguacaugagagaaaacccagaaaacgaagauagcacauucaguucaaucgucucucauaagguaaucagaaaaagauaugaaaacaaauuuaacuauuuugcaaugagauuuuuggacgaauaugccgaacuaccuacauuacgcuuuaugguaaauuucggugacuauauaaaagacagacagaaaaaaauucucgaaucaauacaguucgacucagaaagaaucauaaaaaaagaaauccaucuguucgaaaaacuaagcuuaguaacagaauacaaaaaaaaugucuacuuaaaagaaacaucaaacauugauuuaucacgauucccauuauucccuaacccuaguuacguuauggcaaacaacaacauacccuuuuauauagauucaagaucaaacaacuuagacgaauaucuaaaucaaaagaaaaaagcccaaucacagaacaaaaaacgcaaucuaacuuucgaaaaauauaauaaagaacaaucaaaagaugcuaucaucgcuauguuacaaaaagaaauuggaguuaaagacuuacaacaaagaagcacuauaggcuuauuaaguugcaacgaacuucccucaaugcucuaugaagucauagucaaagacauaaaaggcgcugagcuagaaaacaaaaucgcucaaaaaauaagagaacaauaucaaagcauucgcgacuuuacacuagacucuccgcagaaagacaauauacccacuacacuaauaaaaacaauaaauaccgacucgagcguaacauucgaaaaucagccaauagauauacccagacuaaaaaacgcucugcaaaaggaacucacucuaacacaagaaaaacucuuaaacguuaaagaacacgaaaucgaaguagacaauuauaacagaaauaaaaacacauacaaauuuaaaaaccagccaaaaaacaaaguagacgacaagaagcuacaaagaaaauauguauucuauagaaacgaaauuagacaagaagcaaacuggcuagcaucagaccuaauacacuuuaugaagaauaaaucauuauggaaaggauauaugcacaacgaauuacaauccuuccuagccuucuucgaagacaaaaaaaaugacugcauugcacuacuagaaacaguauucaaucucaaagaagacuguauccuuaccaaaggauuaaagaacuuauuucuuaaacacgguaacuucauugauuucuauaaggaauacuuaaaacuaaaggaagacuuccuaucaaccgaaucaacguuccucgaaaauggcuucauaggacuaccuccaaaaauucucaaaaaagaacuauccaaaagauugaaauauaucuucauagucuuccaaaaacgucaauuuaucauaaaagaacucgaagaaaaaaaaaauaauuuguacgcagacgcaauaaaccuaagcagaggaauauuugaugaaaaaccaacgaugauuccauuuaaaaaaccgaauccagacgaauucgcuucaugguuugucgccucguaucaauauaacaauuaucaaucauucuaugaguuaacgccagacauuguugaacgcgacaaaaagaaaaaauauaaaaaccuaagagccauaaacaaaguaaaaauacaagacuacuaucuaaaauuaauggucgacacccuauaucaagauuuauuuaaucaaccucuagacaaaucacuuuccgauuuuuacgucucuaaagcagagcgggaaaaaaucaaggcagacgcaaaagcauaucaaaaacucaacgacaguagucucuggaacaaagucauacacuuaucucuacaaaauaauagaauuacagcuaacccaaaacuaaaagacaucgggaaauauaaacgcgcauuacaagacgaaaaaauagccacgcuacucacauacgacgcccguacauggacauaugcccuacaaaaaccagaaaaggagaacgaaaacgacuacaaagagcuacauuacacagcauuaaacauggaacuacaagaauacgagaaaguccgaucaaaagaacuacuaaaacaagugcaagagcucgaaaagaaaauauuggacaaauucuacgacuucucuaauaacgccucccauccagaagaucucgagauagaggacaaaaaaggcaaacggcacccaaauuucaaacuauacauaacuaaagcacuccuuaaaaaugaaagcgaaauuauuaacuuagagaauaucgacaucgaaauacuacucaaauacuacgauuacaacacagaagaacucaaggaaaaaauaaaaaauauggacgaagacgaaaaagccaaaauuaucaacaccaaagaaaauuacaacaaaaucacaaacguauuaauaaaaaaagcucuaguacucaucaucauccgaaauaaaauggcccacaaucaauacccgccaaaauucauuuaugaccucgcaaauagauuuguaccaaaaaaagaagaagaauauuucgcaacguauuuuaaccgaguguucgaaacaauuaccaaagaacucugggaaaacaaagagaaaaaagacaaaacacaaguauag

SEQ ID NO: 11890 - RNA, 3468 nt, Artificial Sequence
  Cas13b variant__Flavobacterium sp.__WP_045968377.1__Cas13b
auggacaauaauauaacagucgaaaagacagaacuaggacuaggaaucaccuacaaccacgacaaaguagaagacaaacauuacuuuggaggauucuucaacuuagcacaaaacaauauagaccuugucgcccaagaauucaagaaaagauuacuaauacaaggaaaagacucaauuaacauuuucgcgaacuauuuuuccgaccaauguucaauaacuaaucuugaaagagggauaaaaauacucgcugaauacuucccuguagucucauacauagaccuagaugaaaagaacaaauccaaaagcauccgagaacacuuaauauuacuacuagagacaauaaacaaccuccgaaauuauuauacacacuauuaccacaaaaaaaucauaauagauggaucucuauucccauuacucgacacaauuuuacuaaaggucguacuagaaauuaaaaaaaaaaaacuaaaagaagauaaaacuaaacaacuccuuaagaaaggucuagaaaaagaaaugacgauccuauucaauuuaaugaaagcagagcaaaaagaaaaaaaaauaaaaggauggaauaucgaugaaaauauuaaaggggcuguacucaaucgagcguuuucccaucuucuauacaaugaugaacuuuccgacuaccgaaagucaaaauacaacacugaagaugaaacgcuuaaagauacacucaccgaaucggguauacucuuucuauugucuuucuuuuuaaacaagaaagaacaagaacaauugaaagcaaacauaaaaggcuacaaggguaaaauagccagcauaccagacgaagaaaucacucuuaaaaacaauagucuacgaaacauggcaacacacuggacauauagccaccucaccuacaaaggucuaaaacacagaaucaaaacagaucacgaaaaagaaacccuacuaguaaauauggucgacuacuuaucaaaagugccccaugaaauauaccaaaaccuuucagaacaaaacaaaucacuguuccuagaagauaucaaugaguauaugagagacaaugaagaaaaccaugacuccucagaagccucacgagucauacauccagugauacgaaaacgauacgaaaacaaauuugcauauuucgcuauacgcuuccuagacgaauucgccgaguuuccaacccucagauucauggucaaugucgguaacuacauacacgauaaccgcaaaaaagauaucggaggaacuucgcuaauaacaaaucgcaccaucaaacaacaaauuaauguauucggaaacuuaacagaaauucacaaaaaaaaaaacgacuacuuugaaaaagaagaaaacaaagaaaaaaccuuagaaugggaacuuuuccccaaucccucuuaucacuuccaaaaagaaaauaucccaaucuucaucgacuuagaaaagucgaaagaaacaaaugacuuagccaaagaauaugccaaggaaaaaaaaaaaaucuucggaucguccaggaaaaagcaacaaaacacagccaaaaaaaauagggaaacaaucauaaaccuugucuucgacaaauauaaaacuagcgacagaaaaacaguaacauucgaacaacccacagcuuuauuaucguucaaugaauugaacagcuuccuauaugcauucuuggucgaaaauaaaacugguaaagagcuagaaaaaauuaucauagaaaaaaucgcaaaccaauaucaaauccuuaaaaacuguucaucuacaguugauaaaacaaacgauaacauaccaaagucaaucaaaaaaaucguaaauaccaccacugacucguucuacuuugaagggaaaaaaauagacauagaaaagcuugaaaaagacauuacaauagaaaucgaaaaaacaaacgaaaaacucgaaacaauaaaagaaaacgaggaaucugcacaaaauuacaaacgcaacgaacgcaauacucaaaaaagaaagcucuaucgcaaauacguauuuuuuacaaaugaaaucggcauagaagcaaccuggauaaccaaugauauauuacgguuccucgauaacaaagaaaauuggaaaggcuaccaacacuccgaacugcaaaaauucauaagucaauacgacaacuacaaaaaagaagcccucggacuacuugaaagcgaauggaaucuagaaagugaugcauucuucggccaaaauuuaaaaagaauguuccaaucuaacucaacauucgaaaccuucuauaaaaaauaucucgauaaccgaaaaaacacacuagaaaccuaccuaagugcaauugaaaaccuuaaaacaaugacagacguacgcccaaaaguucucaaaaagaaauggacagaacuuuucagauuuuuugacaaaaaaauauacuuacuuuccaccaucgaaaccaaaauaaacgaauuaauuaccaaacccauaaaccuuaguagagguauauucgaagaaaaaccgaccuucauuaauggcaaaaauccaaauaaagaaaauaaccaacaccucuucgccaauugguucaucuacgcaaaaaaacaaacaauacuccaagacuucuacaaccuaccacuugaacaaccaaaagcuauaacuaaccuaaaaaaacauaaauacaagcucgaaaggaguauaaacaaccuaaaaauagaagacauuuacauuaaacaaaugguugauuuccuuuaucaaaaacucuucgaacaaucguucauaggaucacuucaagacuuauauacaaguaaagaaaaacgagagauugaaaaagguaaagcuaaaaacgaacaaacacccgaugaaucauuuauauggaaaaaacaaguagaaauaaacacacauaauggccgaauaauagccaaaacaaaaauaaaggauauaggaaaauuuaaaaaucuacuuaccgauaacaaaauagcacaccuaauaagcuacgaugacagaauaugggacuucucacuaaacaaugacggcgacauaaccaaaaaacuauacagcaucaauacggaguuagaaucuuacgaaacaauacgcagggaaaaacuacugaaacaaauccaacaauuugaacaauuuuuacucgaacaagaaaccgaauacucagccgaacgaaaacacccagaaaaauuugaaaaagauuguaaccccaacuuuaaaaaauauaucauagaaggaguccucaacaaaauaauaccaaaucacgaaauagaagaaaucgaaauccucaagagcaaagaagauguauuuaaaauaaacuuuagugacauacuaauauugaauaaugauaacauaaaaaaagguuaucucuuaauaaugauaagaaauaaauucgcccacaaccaacuuauagauaaaaaccuuuuuaauuuuucacuucaacucuauucaaaaaacgagaaugaaaacuucuccgaauaccuaaacaaaguaugccaaaacaucauucaagaauuuaaggaaaaacuuaaauaa

SEQ ID NO: 11891 - RNA, 3480 nt, Artificial Sequence
  Cas13b variant__Myroides odoratimimus__EHO06562.1__Cas13b
augaaagauaucuuaacaaccgacacgacagaaaaacaaaauagauuuuauucccacaaaaucgcggacaaauauuucuucggaggcuauuucaaucuagccucuaauaauauauacgaaguauuugaagaaguuaacaaaagaaacacguuuggcaaacuagcuaaacgagacaacggaaauuuaaagaauuauaucauacacguauucaaagaugaauuauccauaucagacuucgaaaaacgugucgcuauauuugccagcuacuuuccaauucucgaaacagucgauaaaaaguccauaaaagaacguaauaggacaauagauuugaccuuaagucaacguauaagacaauuuagagagauguuaaucagcuuaguaacagcgguagaucaacuaaggaacuuuuacacacauuaucaccacagugacauaguaauagaaaauaaaguauuagacuuccuuaacagcuccuuuguguccacugcccuacauguuaaagauaaauaccucaaaacagacaaaaccaaagaguucuuaaaagaaaccauagcagcagaacuagauauauuaauagaagcauacaaaaagaaacagauagaaaagaaaaauaccagauuuaaagcaaauaaaagagaagacauauugaacgcaauauauaaugaagccuucuggucauucauaaacgauaaagacaaagacaaagacaaagaaacaguuguagcaaaaggagcagacgcauauuucgagaaaaaucaccacaaaucaaacgacccugacuuugcacuuaacauauccgaaaaagguauaguauaccuucuauccuuuuuccuaacaaacaaagaaauggauucccuaaaagcaaauuuaacugguuuuaaagguaaaguugaucgcgaaucaggcaauagcauaaaauacauggcaacgcaacgaaucuacagcuuucacacauacagagggcuuaaacagaaaaucagaacaucagaagaaggaguaaaagaaacguuacuaaugcaaaugauagacgaacuaucaaaagugccaaauguaguauaucaacaucuaagcacaacucaacaaaacucauucaucgaggacuggaaugaauacuacaaagacuaugaagaugaugucgaaacugacgacuuaucucgaguaauccacccugucauucgcaaaagauacgaagaccgauuuaacuauuuugcaauaagauuccuugacgaauuuuucgauuuuccuaccuuacgauuucaaguacaccuaggcgacuauguacaugaccgaagaacaaaacaacuagguaaagucgagagcgaccguauaauaaaagaaaaaguaacagucuucgcaaggcuaaaggacaucaauucggcaaaagccagcuauuuccacucauuagaggaacaagauaaagaagaacuagacaauaaauggacucuauucccaaacccaucauaugacuuucccaaagaacauacccuacaacaccaaggcgaacagaaaaacgcaggaaaaauaggaauuuauguaaaacuaagggacacccaauacaaagaaaaagcagcucucgaagaagcacgaaaaaguuuaaauccaaaagaaagaucugcuacaaaagcaagcaaguacgacauaauaacacaaauaauagaagcaaacgacaacguaaaaucagagaaaccauuagucuuuacaggccaaccaauagcauaccucaguaugaaugauauacacucaaugcuguucucauuacuaacggauaacgcugaacuaaagaaaacaccagaagaaguggaagcaaaacuuauagaucaaauuggcaaacaaauaaacgaaauuuuaucaaaagacacagacacaaaaauacuaaagaaauacaaagauaacgaucuaaaagaaacugacacagacaaaauaacccgugaucuggcaagagacaaagaagaaauugaaaaacuuauacuagaacaaaaacaacgagccgacgacuauaacuacacaucaucgacaaaauucaacauagacaaaucuagaaaacgcaaacaccuacuuuucaaugcagaaaaaggaaaaaucggagucuggcuagcaaaugacauaaaaagauucauguucaaagaauccaaaaguaaauggaaaggauaccaacauacugaacuacaaaaacuguuugcauauuucgauacaucaaaaagugaccuugaauuaaucuuaucaaacaugguuaugguaaaagacuacccaauagaauuaauagauuuaguaaagaaaucacgaacucuaguugauuucuuaaauaaauaucuugaagccagacuagaauacaucgaaaauguuaucacacguguuaaaaauucaaucggaaccccacaauucaaaacaguacggaaagaaugcuuuacauuccuaaagaaaucaaauuauacagucguauccuuagauaaacaaguugaaaggauacuaucaaugccccuguucauagaaagaggauuuauggacgacaaacccacaaugcuugaaggaaaaucauacaaacaacauaaagaaaaauuugccgacugguuuguucacuacaaagaaaacucgaauuaccaaaacuucuacgauacagaagucuacgaaauaaccacugaggauaaaagagaaaaagcgaaagucacuaagaaaauaaaacaacaacagaaaaaugacguauucacacuaaugaugguuaacuauauguuagaagaaguucuaaaacugucguccaacgaccguuuaucauuaaaugaacuauaucaaacaaaagaagaaagaaucguaaacaaacaaguagcuaaagauacacaagagcgaaacaaaaacuacaucuggaacaaaguaguugacuugcaacucugugacggguuaguacacaucgauaacguaaaacuaaaagauauaggaaacuuucgcaaauacgaaaacgauucaagggucaaagaauuucuaacauaccagucagacauagucuggucagccuauuugucuaacgaaguagacucaaacaaacucuaugucauagagcgccaacuagacaacuaugaauccauaaggagcaaagaguuauuaaaagaaguacaagaaauagaguguucaguuuacaaccaaguugcaaauaaggaaucauuaaaacagucaggcaacgaaaacuucaaacaauauguauuacaaggacuacucccgauaggcauggacguacgagaaaugcuaauacucucuacagaugucaaauucaagaaagaagaaauaauccaauuaggccaagcuggagaaguagaacaagauuuauauucucuuauauacaucagaaauaaauucgcccacaaucaacuacccauuaaagaguucuuugauuucugcgaaaacaacuaccguucaauauccgacaaugaauauuacgcugaauauuauauggaaauauuucgaagcaucaaagaaaaauaugcaaacuaa

SEQ ID NO: 11892 - RNA, 3474 nt, Artificial Sequence
  Cas13b variant__Myroides odoratimimus__WP_006261414.1__Cas13b
augaaggacauacuaacaacagauacaaccgaaaaacaaaauagauuuuacucacauaaaauagcggauaaguacuucuuugggggauauuuuaaucuugcaucaaacaauauauaugaaguauucgaagaagugaacaagagaaauacuuucggaaaacuagcaaaacgcgauaauggaaaccuuaaaaauuacauaauacacgucuucaaagaugaauuaucuaucagcgacuucgaaaaacgcguagcaaucuucgcaucauacuucccaauucuagaaaccguagacaagaaaucaauaaaagaaagaaaccguaccauagaccugacacuaucacaacgcaucagacaauucagagaaaugcugauaucacucguaacagcagucgaccaguuaagaaauuucuacacucacuaccaccacagugaaauaguaauagaaaacaaagugcucgauuuucuaaauucaucccugguuaguacagcacuacauguaaaagauaaauaccucaaaacagacaaaacaaaagaguucuuaaaagaaacaaucgcagcagaauuagacauacucauagaagcauacaaaaagaaacagauagaaaagaaaaauacacguuucaaagcaaacaaacgugaagacauacuaaacgcuauauauaaugaagcauucugguccuucauaaaugacaaagacaaagauaaagaaacagugguggccaaaggagcugaugccuacuuugagaaaaaucaccacaaaaguaacgaucccgauuuugcacuaaauaucucagaaaaaggaaucguauacuuauuaucauucuuccucacaaauaaagaaauggacucacucaaagcaaaucuaaccggauucaaaggcaaagucgaccgagaaaguggaaauaguauaaaauauauggcaacacaaaggauauacucuuuucacacauacagaggacuuaaacagaaaaucagaacauccgaagaagguguaaaagaaacacuccuuaugcaaaugauugacgaacuaagcaaaguaccaaauguagucuaccaacaucucaguacaacacaacaaaacucauucauugaagauuggaacgaauauuacaaagauuaugaagaugauguagaaacagaugaccugaguagaguaauucacccaguuauaagaaaaagauacgaagaucgauuuaauuauuucgcaauaagguuucucgaugaguucuucgacuuucccacacuuagguuccaaguacaccuaggcgauuacguacaugaucgacguacuaaacaauuaggaaaaguugaaucagacaggauaauuaaagaaaaagucacaguauucgcccgacucaaagacaucaauucagcuaaagccaacuacuuucacucacuagaagaacaagauaaagaagaacuagacaacaaauggacauuauuuccuaacccuagcuacgacuuccccaaagaacacacuuuacaacaccaaggagaacagaaaaacgcagguaaaauaggaauauaugucaaauuacgagacacgcaauacaaagaaaaggccgcacuugaagaagcaagaaaaucauuaaauccaaaggaaagaagcgcaacuaaagcaaguaaauaugauauaauaacacaaaucauagaagcaaaugauaacguaaaaagcgaaaagccccugguuuucacugggcaaccuauagccuaccucucuaugaaugacauacacucaaugcuuuucucacuucuaaccgauaaugcagaacuuaagaaaacuccagaagaaguagaagcaaaacuaaucgaucaaauagguaaacaaaucaacgaaauauuauccaaagacacagauaccaaaauacugaagaaauacaaagacaaugaccugaaagaaacagacacagauaaaauaacuagagaccuagcccgcgauaaagaagaaauagagaaacuaauacuagaacaaaaacaaagagcugaugacuacaacuauacaucuuccacaaaauuuaacauugacaaauccagaaaacgcaaacaucuacucuucaacgccgaaaaagguaaaauuggaguaugguuagccaacgacauaaaacgauucaugaccgaagaauuuaaaagcaaguggaaaggauaccaacauacugaacuacaaaaauuauucgcauacuacgacacauccaaauccgacuuagaccuaauccucagugacaugguuauggucaaggacuaccccauugaauuaauagcauuaguuaaaaagucacgaacucuaguagauuuccuaaauaaauaccuagaagccagacucggcuacauggaaaauguaaucacgcgaguuaaaaacaguauaggcaccccacaauucaaaacaguacgcaaagaaugcuuuacauuccuaaagaaaucaaauuacacuguagugagucucgacaaacaagucgaaagaauacuaucaaugccccuauuuaucgaaagaggauuuauggacgacaaaccaacgauguuagaaggaaaaucauaucaacaacacaaagaaaaauuugcagauugguucguacacuacaaagaaaacucaaacuaccaaaauuuuuaugauacugaaguauacgaaauuacaacagaagacaaacgagaaaaagcaaaagugacaaagaaaauuaaacaacaacagaaaaaugacguauuuacacuaaugaugguaaauuacaugcuagaagaaguccuuaaacuaucgaguaacgacagacucucuuuaaaugaauuauaucaaacuaaagaagaacgcauagucaacaaacaaguggcaaaagacacccaagagagaaacaaaaacuauauuuggaacaaaguugucgaucuacaacugugcgaaggucuaguaagaauagauaaagucaaacucaaggacauagggaacuuccgaaaauacgaaaacgacuccagagucaaagaguuccuaacauaccaaucagacauaguauggagcgccuaccucucaaaugaagucgacucaaauaaauuauacgucauugaacgucaauuagacaacuacgaaucaauccguucuaaagaacuccuaaaggaaguacaagaaauagaaugcucaguauacaaucaaguagcgaacaaggaaucccucaaacaaucagguaaugaaaacuucaaacaauacguauuacaaggccuuguuccaauaggaauggauguacgagagaugcucauucuaaguaccgauguaaaauucauaaaagaagaaauaauacaacuaggucaagccggugaaguagagcaagacuuauauagccuuauauacaucaggaacaaauucgcacauaaucagcuaccaaucaaagaguucuuugacuuuugcgaaaauaauuaucgcucuauauccgauaacgaauacuacgccgaauacuauauggaaaucuuccgaaguauaaaagaaaaauacacauccuaa

SEQ ID NO: 11893 - RNA, 3474 nt, Artificial Sequence
  Cas13b variant__Myroides odoratimimus__EKB06014.1__Cas13b
augaaagacauucucacuacagauacaacagaaaaacaaaaucguuucuacucacacaaaauugccgauaaauacuucuuugguggguauuucaacuuagcgucaaacaacauauacgaagucuucgaagaaguuaacaaaaggaauacauucgguaaacuugcaaaaagagauaauggcaaccucaaaaacuauauaauacauguuuucaaagaugaacuaagcauauccgacuuugaaaaacgugucgcaauauucgcgucauauuuuccaauacuagaaacagucgacaagaaaucuauaaaagaacggaauagaacuaucgauuuaacacuaagucaaagaaucaggcaauuuagagaaaugcucauaucacucguaacagccguagaucaacuaagaaauuuuuauacucacuaccaucacucagaaauagucaucgaaaauaaagugcuggacuuucugaacaguaguuuggugucaacugcuuuacauguaaaagacaaauacuuaaaaacugacaaaacaaaagaguuccuaaaagaaacaaucgcugccgaacuagauauacucauagaagcauacaaaaagaaacaaauugaaaagaaaaacacaagauucaaagccaacaaaagagaagauauacuaaacgcaauauauaacgaagcauucuggagcuuuauaaaugacaaagacaaagauaaagaaacaguaguagcuaaaggcgccgaugcuuacuucgagaaaaaucaccacaaaucuaacgauccugacuuugcacuaaauaucucugaaaaaggaauuguauaccuauuauccuucuucuuaaccaacaaagaaauggauuccuuaaaggcaaauuuaacaggguucaaaggcaaaguagacagagaaagcggaaauagcaucaaauacauggcaacccaaagaauauauuccuuucacacuuacagaggccugaagcaaaagauacgaaccucagaagaaggcguuaaagaaacauuauuaaugcaaaugauagacgaauuauccaaaguaccaaacguuguauaccaacaucucaguaccacacaacaaaauagcuuuauugaagacuggaacgaauacuacaaagauuaugaagacgacguagaaacugaugacuuaagcagaguaauacacccagucauuagaaaacgcuacgaagaccgauucaacuauuucgcaauaagguuucuagacgaguucuuugacuucccgacacuacgauuccaaguccaccuaggcgacuacguccaugacagaagaaccaagcaacugggaaaaguagaaucggaccgaaucauuaaagaaaaaguaacaguauucgcaagauuaaaagauaucaacucagcaaaagcaucauauuuccacagccuagaagaacaagauaaagaagaauuagauaacaaguggacacuuuucccaaauccaagcuaugacuuccccaaagaacacacacuccaacaccagggagaacagaaaaaugcaggaaaaauaggcauauacguaaagcuccgugauacacaauauaaggaaaaagccgcccuagaagaagcaagaaaaucacuaaacccgaaagagagaagcgcuacaaaagcaaguaaauaugacauuauaacacaaauaauagaagccaacgacaauguuaaauccgaaaaaccucuaguuuuuacaggucaaccaaucgcuuacuuaaguaugaacgacauacauaguauguuauuuagcuuauuaacagacaacgccgaacucaagaaaacaccagaggaaguagaagccaaacuaauagaccaaauugguaaacagauaaaugaaauauugaguaaggacacagacacuaaaauucucaagaaauacaaagacaacgaccucaaagaaacagauacagacaaaaucacaagggaucuagcacgagauaaagaagaaauagaaaaacuaauuuuagaacaaaaacaaagagcagaugacuauaacuacacaagcagcacgaaauuuaauauagauaaaaguagaaagagaaagcacuuauuguuuaacgcggaaaaaggaaaaaucggaguuuggcuagccaacgacauaaaacgauuuauguucaaagaguccaaaucuaaauggaaaggguaccagcauacagaauuacaaaaacucuucgcauacuucgauacuucuaagucagauuuagagcuaauccuauccgacauggucauggucaaagauuaucccauagaacuaauagaccuaguaagaaaaucaagaacucucguagauuucuuaaacaaauaccuugaggcucgacuuggauacaucgaaaacguaauuacaagaguuaaaaauucuauaggaacaccgcaauucaaaaccguacggaaagaauguuuugcauuccuaaaagaaaguaauuacacagucgcaucacuagauaaacaaaucgaaaggauauugagcaugccucuauuuauagagagagguuucauggacucaaaaccaacuaugcucgaagguaaaucauaucaacagcauaaagaggacuucgcagacugguuuguacacuacaaagaaaacucaaacuaucaaaacuuuuacgacacggaaguauaugaaauaauaacagaagacaaacgagaacaagcaaaaguaacaaagaaaauaaaacaacaacagaaaaaugacguauuuacccuaaugaugguaaacuauaugcuugaagagguacugaaauuaccgucaaaugaucgucuuaguuuaaacgaacuuuaccaaacaaaagaggagagaaucgucaacaaacaaguugcaaaagauacccaagaaagaaauaaaaacuacauauggaauaaaguaguugaucuucaacuuugcgaaggccuagugagaauagacaaagucaaacuuaaagauauaggaaauuuuagaaaauaugagaaugauagcagaguaaaagaguuccuuacauaccaaucagacauuguauggagcggauaccuaucuaacgaaguagauuccaacaaauuauaugucauagaacgacaacuagauaauuaugaguccauacgaucuaaagaacugcuaaaagaaguccaagaaauugaaugcauuguauacaaccaagucgcaaauaaagagucacuuaaacaaucaggaaacgaaaacuuuaaacaauacguccuccaaggacucuuaccaagagguacagacguacgagaaaugcuaauacuaaguacggaugucaaauuuaagaaagaggaaauaaugcaacuuggacaaguccgagagguugaacaagaccucuacucacuaaucuauaucagaaauaaauucgcacauaaccaauuaccaauaaaagaguuuuucgauuuuugcgaaaauaauuacagaccaaucagcgauaaugaauacuaugcagaauauuauauggaaaucuucagaucaauaaaagaaaaauacgcuucauaa

SEQ ID NO: 11894 - RNA, 3480 nt, Artificial Sequence
  Cas13b variant__Myroides odoratimimus__WP_058700060.1__Cas13b
augaaagauauauuaacgacagauacuacggaaaaacaaaaccgcuuuuauucccacaaaauagcggauaaauacuucuuuggaggguacuuuaaucuagcuucuaacaacauauacgaagucuuugaagaaguaaauaaaagaaacaccuuuggaaaauuggcaaaaagagauaacggaaaccuuaaaaacuacaucauacacguauuuaaagacgaauuaucuauuagcgauuuugagaaaagagucgcaauauucgcaucauacuuuccuauacuugaaaccguagacaagaaaucaaucaaagaacguaauaggaccauagaccuuacauuaagccaacgaauaagacaauuucgagaaaugcugauaucccuaguaacggcagucgaccaauuacguaacuucuacacacauuaucaccacucagacauagucaucgaaaauaaaguauuagauuuucuaaacaguaguuuugucagcacagcguuacacgucaaagacaaauacuuaaaaacagacaaaacaaaagaguucuuaaaagaaacaaucgccgcagaacuagacauacuaauagaagcauauaaaaagaaacagaucgaaaagaaaaauaccagauucaaagcaaauaaacgagaggauauauuaaacgcaauauauaaugaagcauuuuggaguuuuauaaacgacaaagauaaagacaaagauaaagaaacugugguagccaaaggcgcagaugcauacuuugagaaaaaucaucauaaauccaacgacccggacuucgcacuaaauauaucagaaaaaggaauagucuaucuccuaucauucuuccucacuaacaaagaaauggacucauuaaaagcuaacuuaaccggcuucaaaggaaaagucgauagagaaucgggaaacucaaucaaauacauggcgacucaacgaauuuauucauuccauacuuauagaggauuaaaacagaaaauacgcacaucagaagaaggaguuaaagaaacauuacugaugcaaaugauagacgaauuaucaaaaguuccaaacguaguauaccaacaucucaguacgacacaacaaaauucuuuuauagaagauuggaaugaauauuacaaagauuacgaagacgauguugaaaccgacgacuuguccaggguaacccauccugucauaagaaaaagauacgaagaccgguucaacuacuuugccaucagauucuuagacgaguucuuugacuuucccacuuuacgcuuccaaguucaccuaggugauuacguacacgaccgacgaacaaagcaacuuggcaaaguagaaucagauagaauaauaaaagaaaaaguuacuguauucgcaagacuaaaagacaucaacucagcaaaagcaaguuacuuccauagucucgaggaacaagauaaagaagaacuugauaacaaauggacacuauuuccuaacccaucuuacgacuuuccuaaagagcacacauuacaacaccaaggagaacagaaaaacgcaggcaagauaggaauauacgugaaacucagagacacgcaauauaaagaaaaagcagcauuagaagaggcuagaaaaucccucaauccaaaagaacggucggccacaaaggcuucaaaauaugauauaaucacacaaauaauugaagccaaugacaacgugaaauccgaaaaaccuuuaguuuuuacuggacaaccaauagccuaccuaucaaugaacgauauacacagcauguuguucagucuccuaacagacaaugcugaauuaaagaaaacaccagaagaggucgaagcuaaacuaauagaccaaauaggaaaacaaauaaaugaaauccuaucaaaagacaccgacacaaaaauacuaaagaaauacaaagacaaugaucuaaaagaaacggacacagauaaaaucacaagagaccucgcuagagacaaagaagaaauagaaaaauuaauacuagaacaaaaacaacgagcagacgauuauaauuauacaucaaguacaaaauuuaauauagauaaaagucgcaagagaaaacacuuguuauucaacgcagaaaaaggaaagauuggagucugguuagccaaugacauaaaaagguucauguucaaagaaaguaaauccaaauggaaaggauaucaacauaucgaacuccaaaaacuuuucgcauacuuugauacaucaaaaagcgaccucgaacugauacuauccaauaugguaaugguuaaagacuacccgaucgaacuaauagaccuaguaaagaaaucacgaacuuuaguugacuuccuaaauaaauaucuggaagcaagguuagaauacaucgaaaacguuaucacacggguuaaaaacucaaucggaaccccacaauuuaaaacugucagaaaagaguguuucacuuuccuaaagaaaucaaauuauaccguagucagcuuagacaaacaaguagaaagaauauugucaaugccuuuauuuauagaaagagguuuuauggaugauaaaccaacaaugcuagaagguaaaaguuauaaacaacauaaagaaaaauucgccgacugguucguacacuacaaagaaaacucaaauuaucaaaauuucuacgacaccgaaguauacgaaauaacaacagaagacaaacgagaaaaagccaaaguuacgaagaaaauaaaacaacaacagaaaaacgauguauucacacuaaugaugguuaacuacaugcuagaagagguacuaaaauuaucgagcaaugaccgauugagucucaacgaauuauaccaaacaaaagaggaaagaaucguaaacaaacaaguagccaaagacacacaagaaaggaacaaaaacuauaucuggaauaaaguuguagaccuccaacuaugcgacggucuuguccacauagacaaugugaaacuaaaagauauaggaaacuuuagaaaauacgaaaaugauagucggguaaaagaguuuuuaacauaucaaucagauauaguauggucugcauaccuaaguaacgaagucgauucaaauaaacuauauguaauagaaagacaauuagacaacuacgaaaguauuagaucuaaagagcuucuaaaagaaguucaagaaauagaaugcagcguguacaaucaaguugcaaacaaagaaagccugaaacaaagcggcaaugagaacuucaaacaauacguacuacaaggcuuauuaccaauugggauggauguacgagaaauguuaauauuaagcacagacgugaaauuuaagaaagaggagauaauacaacuugggcaagcaggagaaguagaacaagaccuguacucccucauauacaucagaaacaaauuugcacauaaccaacuaccaauaaaagaguucuuugauuuuugcgaaaacaauuauagaucaaucagcgauaacgaauacuaugccgaauacuacauggaaauauuucguuccauaaaagaaaaauacgcuaacuaa

SEQ ID NO: 11895 - RNA, 3465 nt, Artificial Sequence
  Cas13b variant__Paludibacter propionicigenes__WP_013446107.1__Cas13b
augaagacuucugccaacaauauauacuucaaugguaucaauuccuucaagaaaaucuucgauucaaaaggagcaauugcuccaaucgcagaaaaaucauguagaaacuucgacauaaaagcccagaaugauguuaauaaagaacaaagaauccacuauuucgcagucggacacaccuucaaacaacuggacacagagaacuuguucgaauacguucuugaugaaaaccuaagagcaaaaagaccaacccguuuuauaucacuucaacaguucgacaaagaauucauagaaaauauuaaaagacuaauuuccgacauaagaaauaucaacucacacuacauacaccgcuuugacccccugaaaauagacgccgucccuacaaacauaauagacuucuuaaaggaaagcuucgaacuagcaguaauacaaaucuaccucaaagaaaaagguauaaauuacuuacaauuuucagaaaacccccaugcagaucaaaaauuaguggcauucuuacacgacaaauuccuaccacuugacgaaaaaaaaaccucaaugcuucagaacgaaacaccacaacugaaagaauacaaagaauaccgcaaauauuuuaagacucucuccaagcaagcugcaauagaccaacugcuauuugccgaaaaagaaacugacuacaucuggaaucucuucgacucccacccaguccuaacaauaucagcugguaaguaucuauccuucuacucaugccuguuucuccuaucaauguuccuauauaagucagaagccaaucaacuuauuucaaaaaucaaaggauuuaaaaaaaauaccaccgaagaagaaaaauccaaaagagaaauuuucacauucuucaguaaacgcuucaauucaauggauauagauucagaagagaaccaguuaguaaaauucagagacuuaauccuguaccuaaaccacuacccaguagcauggaauaaagaccuugaacuggacucaagcaacccagccaugacagacaaguuaaaaucuaaaauaauagaauuagaaauaaacaggucuuucccccuauaugaaggcaacgaacgauuugccacauuugcaaaauaccagauauggggaaaaaaacacuuagguaaaucaauugaaaaagaauauaucaaugcaucauuuacagacgaagaaauuacagcauauaccuacgaaacagauacaugccccgaacucaaagaugcccauaaaaaacuagccgaccucaaagcagcuaaaggacuauucggcaaaagaaaggaaaaaaaugaauccgacauaaaaaaaaccgaaacuuccauaagagaauuacaacacgaaccaaacccaauaaaagauaaacuuauucaacguauagaaaaaaaccuccuaacuguuagcuacggcagaaaccaagaucguuuuauggauuuuucagcaagauuccuagcagaaauuaacuacuucggacaagacgccagcuucaaaauguaccacuuuuacgccacagacgaacaaaacagugagcuugaaaaauaugaauuaccuaaagacaaaaaaaaauacgauagcuuaaaauuccaccagggaaaauuaguucacuuuauaucuuacaaagaacauuugaaacgguacgaaucaugggacgacgccuucgucaucgagaacaacgcaauacaacucaagcucucauucgacggaguagaaaacacaguuacaauacaaagagcacuccuaauauaucuacucgaagaugcucuacgaaacauacaaaauaacaccgcagagaacgccgggaaacaacuacuacaagaauauuacagccauaacaaagcugaucuaagcgcauucaaacaaauacuaacacaacaagauagcaucgaaccccaacaaaaaacagaauucaaaaaacuucugccacgucguuuauuaaauaauuacucaccagcaauaaaccacuugcagaccccccacuccucacuuccauuaauccuagaaaaagcucuacucgcagaaaaaagauauugcagccuagucguaaaagcgaaagccgagggaaacuacgaugacuuuauaaaaagaaacaaaggcaaacaauucaaauuacaauuuauacgcaaagcauggaaccucauguauuuucguaacucauaccuacaaaacguccaagccgcuggccaccacaaaucauuucacauagaaagagaugaauuuaacgacuucagccgguauauguuugccuucgaagaauuaucccaauacaaauacuaccuaaacgagauguucgaaaaaaaaggauuuuucgaaaacaaugaguuuaaaauauuauuccaaagugguacuucacucgaaaaucuuuaugaaaaaacaaaacaaaaauucgaaauuuggcuagccuccaacacagcaaaaacuaauaaaccugauaauuaccaucuaaauaacuaugaacaacaauuuucaaaccaacuuuucuucauuaauuuaagccacuucauaaacuaucuaaaaucaacaggaaaacuccaaacagaugccaaugggcaaauaauauacgaagcacuaaacaacguacaauacuugaucccagaauacuacuacacugacaaacccgaacgaagcgaauccaaaaguggaaacaaacuuuauaacaaauuaaaagcuacgaagcuagaagacgcacuccucuacgaaauggcaauguguuaucuuaaagcagacaaacaaauagcugauaaagcaaaacacccaaucacuaaacuauugacaagcgaugucgaauucaacauaacaaauaaggaagggauccaauuguaccaccuccuagucccauuuaaaaaaauugaugccuucaucggucuaaaaaugcacaaagaacagcaagauaaaaaacauccaaccucuuucuuagcaaacauaguaaauuaccuagaacuaguaaaaaacgauaaagacauaagaaaaacauacgaagcguucagcaccaacccaguaaaacgaacauuaacauacgaugaucuagcaaaaauugauggccaccucauuuccaaaucaauaaaauucacuaauguaacacuagaacucgagagguacuucauuuucaaggagucacuaauaguuaaaaaaggcaacaauauugacuuuaaauacaucaaaggacugcgaaacuacuacaacaacgaaaaaaaaaaaaacgaaggaauacgcaauaaagccuuccauuuuggcauuccggacucaaaaucauaugaccaauugauacgagacgcagaaguaauguucauugcaaacgagguaaaaccuacacaugcaaccaaauacacagaucucaauaaacaacuucacacuguaugcgacaaauugauggaaacaguccacaacgauuauuucucaaaagaaggagaugguaaaaaaaaacgagaagcugccggccaaaaauauuucgaaaauauuaucucugcaaaauaa

SEQ ID NO: 11896 - RNA, 3396 nt, Artificial Sequence
  Cas13b variant__Phaeodactylibacter xiamenensis__WP_044218239.1__Cas13b
augacgaauacgccaaaacgaaggacucuccaccgacacccuucauacuucggagcuuuccugaauauagcccgacauaaugcauucaugaucauggaacaccuuucaacuaaauaugacauggaagacaaaaacacacuggaugaagcucaacuaccaaacgccaaauuauuuggauguuuaaaaaaaagguacggcaaaccugacguaacagaaggaguaagcagagaucuuaggagguauuuccccuuuuuaaauuacccacucuucuuacaccuagaaaagcaacaaaacgcagaacaagcagccaccuacgacauuaauccagaagacauagaauuuacacuaaaagguuucuucagacuauuaaaccaaaugagaaacaacuauagccacuauaucucaaauacagauuauggaaaguuugacaaacuacccguacaagauaucuaugaagccgcaauauuccguuuacuagaucgaggaaaacacacaaagcgauucgauguguucgaaagcaaacauacuagacaccuagagucaaacaacagcgaauaccgaccaagaucacuagccaauucaccagaccacgaaaacaccgucgcguuuguaacaugcuuauuuuuagagagaaaauaugccuuuccauuuuuaucuagacuugauugcuuccggucaacuaacgaugccgcugaaggagaucccuuaauacgaaaagccagccaugaauguuacacaauguuuugcugucgccucccccaaccuaaacucgagucauccgauauauuacucgauauggucaaugaguuaggaagaugcccaucagcucuauacaaccuauuaucggaagaagaucaagcaagauuccacaucaaaagagaagagauaacagguuucgaagaagacccagaugaagaacucgaacaagaaauuguccucaagcgccauucagauagauucccauauuuugcauuaagauacuucgacgauacagaagcauuccaaacucucagauucgacguauaucuaggaagauggagaacaaaaccgguauacaaaaaaagaauauacggucaagaaagagaccgcguccuaacacaaucuauaagaaccuucacaagacuaagucgcuuacuaccuaucuacgaaaauguaaaacacgaugccguucgucaaaaugaagaagauggaaaauuaguaaauccagacguaacgagucaguuccacaaauccuggauccaaaucgaaucagacgacagagcuuuucuauccgauagaauugaacacuuuucuccucauuauaauuucggagaucaagugauaggauuaaaauuuaucaauccagauagguacgccgcgauacaaaacguauucccaaaacuaccaggagaagaaaagaaagacaaagacgccaaacuugucaaugaaaccgcagaugcaaucauaucaacacacgaaaucagaaguuuguuccuauaccacuaccuaucaaaaaaaccuauaagugcaggugaugaaagacguuucauacaaguagacacagaaacuuucauuaaacaauacauagauacaauaaaauuauucuucgaagauauuaaaagcggugaauugcagccaaucgcagacccaccaaauuaccaaaaaaacgaaccccucccauacguacgcggagauaaagaaaagacacaagaagaacgagcacaauacagagaaaggcaaaaggaaauaaaagagcguagaaaagaguuaaacacauugcuacaaaaccguuauggacuuagcauucaauauauaccuagucgccuucgagaauacuuacuaggguacaaaaaaguaccauaugaaaagcuagccuugcagaaauuaagagcgcaacgaaaggaaguaaaaaaaaggauuaaagacauagaaaaaaugcgaacaccacguguaggagaacaagcaacaugguuagcagaagauauaguuuuuuuaacaccaccuaaaaugcacacgccagaaagaaaaacuacaaaacacccucaaaaacuaaacaaugaccaguuccgaauuaugcaaucaucucuagcuuacuuuucuguaaauaaaaaagccaucaaaaaauucuuucagaaagaaacuggaauaggucuaucaaaucgcgaaacgucucauccauucuuguauagaaucgacgucggccgaugcagaggaauacuugauuucuacacaggauaucuaaaauacaaaauggacuggcuugaugacgcuauuaaaaagguagauaacagaaaacacggcaaaaaagaagcgaaaaaauaugaaaaauaucuaccaaguuccauucaacauaaaaccccacuugaacuagacuacacuagacuaccaguauaccuaccuagaggucuuuuuaaaaaagcuauaguaaaagcucuagcagcucacgcagacuuccaaguugaaccagaagaagauaacguaaucuucugccuggaccaacuccuggauggagacacucaagauuucuauaacuggcaaagauacuaccguagugcauuaaccgaaaaagagacagauaaucaacuagucuuagcacauccguacgcagagcaaauacuaggaacaauaaaaacacuagaaggaaaacaaaaaaacaauaaacucggaaacaaagcuaagcaaaaaauaaaagaugaacuaauugaccuaaaaagagccaaaagaaggcucuuagacagagaacaauacuuaagagcaguccaggcagaagauagggcauuguggcuaaugauucaagaaagacaaaaacaaaaagccgaacacgaggagaucgcauucgaucaacuagaucuaaagaacaucacaaaaauauuaacagaaaguauagaugcacguuuaagaauaccagacaccaaaguagacauaacugauaaauuaccacuaagacgauacggagauuuaagaagaguugcaaaagaccguagauuaguaaacuuagcaucauacuaccaugucgcaggguuaucagaaauaccuuaugauuugguaaaaaaggaauuagaggaauacgauagacgaagaguggcauucuucgaacaugucuaccaauuugagaaagaaguauacgaccgauaugcggccgaauuaagaaaugaaaauccaaaaggugaaaguacauauuucucccacugggaauauguugccguagcaguaaaacauagugcagauacccauuuuaaugaacuguuuaaagaaaaaguaaugcaacuccgaaauaaauuucaucauaacgaauucccuuacuuugacugguugcuaccagaaguagaaaaagcuagugcagcacuuuaugcugauagggucuuugaugucgcagaaggauacuaccaaaaaaugaggaagcuaaugagacaguaa

SEQ ID NO: 11897 - RNA, 3408 nt, Artificial Sequence
  Cas13b variant__Porohyromonas gingivalis__WP_012458151.1__Cas13b
augaacacaguacccgccucggaaaauaaaggacaaagucggaccguagaagaugauccccaauacuucggcuuauacuuaaaucuagcccgcgaaaacuuaauagaaguagaaucucacgugcgaauaaaauucggcaaaaagaaauuaaaugaagaaaguuuaaaacaaucucuacuaugcgaccaucuucugucaguagauagauggaccaaaguauauggacacaguagaagguaccuaccuuucuuacacuauuuugaccccgauagucaaauagaaaaagaucaugauaguaaaaccgguguagauccagauucugcucagagacucauaagagaacuuuacagucuacuagacuuucuaagaaaugauuuuucacauaaucgacucgacggcacaacauuugaacaucuugaaguaucaccagauauaucaucauucauaacaggcaccuacucuuuagcaugcggacgagcccaaucuagauucgcaguauucuuuaaaccagaugacuucguguuagcaaagaauagaaaagaacaacucauuucaguugcagaugguaaggaaugccucacgguaucaggauuugcauucuuuauuugucuauuucuagacagagaacaagcaagcggcaugcuauccagaaucagaggauuuaaaagaacugacgaaaauugggcccgagcaguccacgaaacauuuugcgauuuaugcauccgacacccacacgauagacucgaaucaucaaauacaaaagaagcacuauuacuagacaugcuuaacgaacugaauagauguccaagaauauuauacgauaugcuacccgaggaagaaagagcccaauucuuaccugcuuuagacgagaacucgaugaauaacuuaagcgaaaacucauuagacgaagaaucaagauuauuaugggacggcucaagugacugggccgaagcucugacaaaacgaauacgacaccaagacagauucccauauuuaaugcucagauuuauagaagaaauggauuuacuaaaaggaauacgauuuaggguugaccuaggagaaauugaacuagacagcuauucaaagaaaguaggaagaaacggggaauaugauagaacaauaacagaucacgcauuagccuucggaaaacuaucagauuuccaaaaugaagaagaaguaucacguaugauaucuggagaagcaucauauccagucagauucucauuauuugcaccaagauaugcaauuuaugauaauaaaauaggcuacugccauacgucagaucccguauauccaaaaaguaaaacuggagagaaaagagcacucucaaacccucaaaguaugggcuucauuucaguccacgauuuaagaaaacucuugcuaauggaacuacuaugcgaaggaucuuucucaagaaugcaauccgacuuuuuacgcaaagcaaaucgaauccuugaugaaacagcagaagguaaauugcaauuuucagcacuuuucccagaaaugagacauagauuuauuccaccccaaaaucccaaaaguaaagaccguagagaaaaagcugagacaacacuugaaaaauauaaacaagaaauaaaagguagaaaagacaaauuaaauucacaacuauuaagcgcauucgacauggaucagagacaacuucccucgagacugcuagaugaauggaugaauauucgacccgcaagucacaguguaaaacuaagaacuuacguaaagcaauuaaaugaagacugucgauugagacuaaggaaauuuaggaaggacggagacgggaaagcuagagcaauaccgcuaguuggagaaauggccacguucuuaucacaagacauaguccgcaugauuauaagcgaagaaacaaagaaauuaauaacaagcgcguacuauaaugaaaugcaaaggagcuuggcucaguaugcaggggaggagaacagaagacaauuucgagcgauaguagccgaacuaagguuauuggauccuucaagcggacacccuuucuuaucggcaacaauggaaacagcucacagauacacagaagguuuuuauaaguguuauuuagaaaagaaacgagaauggcucgcuaaaauauucuaccgaccagaacaagacgaaaacacaaaaagaagaauuucaguuuucuuugucccagauggagaggcuagaaaacuucuuccccuauuaauacgaagaaggaugaaagaacaaaaugaucuucaagacuggauacguaauaaacaagcacauccaauagaucuaccuucacauuuguuugauagcaaaguaauggaauuguuaaaaguuaaagaugguaaaaagaaauggaaugaagcguuuaaagauuggugguccacaaaauauccagaugggaugcaaccauucuacggauuaagaagagaacucaacauucauggaaaaucggucucguacauuccaucagauggaaagaaauucgcugauuguuauacacauuuaauggagaaaacaguuagggacaagaaacgagaauuaagaaccgcaggaaaaccaguaccgcccgaucuagcagcggauauaaaaagaucauuccauagggcugucaacgaaagggaguucaugcuccgauuaguccaagaagaugauagauuaaugcuaauggcaaucaacaaaaugaugacugaucgagaagaagauauacuaccgggucuaaagaauaucgauaguauauuagacgaagaaaaucaauuuagccuugcuguccacgcuaaaguguuagaaaaagaaggagaaggaggcgacaauagucuaaguuuaguacccgcuacaauugaaauaaaaagcaaaagaaaagacuggucuaaauauauaagauaccgauaugaucgcagaguacccggacugaugagucauuuucccgaacacaaagcuacccuagacgaaguaaaaacucuccuaggagaauaugacagaugccguauaaaaauauuugauugggcauuugcacucgaaggugcaauuaugucugauagagaucuaaaaccuuauuuacaugaaaguagcucccgcgaaggaaaaucaggggaacacagcacauuagucaaaaugcugguugaaaagaaaggaugccugacacccgaugaaucccaguaucucauuuuaauaaggaauaaagccgcucacaaucaguuucccugcgccgcagaaaugccacuuauauauagagauguuucagcaaaaguaggcucuauagaagguucaucagcaaaagaccuaccagagggaaguagccuugucgacucuuuauggaagaaauacgagaugauaaucagaaaaauauuaccaauauuagauccagaaaacagauucuucgguaaacuacucaacaacaugagucaaccaauuaaugaucuauag

SEQ ID NO: 11898 - RNA, 3408 nt, Artificial Sequence
  Cas13b variant__Porohyromonas gingivalis__ERJ81987.1__Cas13b
augaauaccguaccagcaucagagaauaaaggacaguccagaacaguagaagaugacccucaauauuuugguuuauauuuaaaucuagcccgcgaaaaccuaauugaaguagaaucacauguaagaauaaaauucggaaagaaaaaauuaaacgaagaaucuuuaaagcaaagucuacuuugcgaccauuuauuauccguagaccguuggacuaaagucuauggccacagcagaagauauuuaccuuuucuacacuauuucgauccagacucucaaauagagaaagaccaugauuccaaaacaggaguagauccagauagcgcucaacguuugauucgagaauuauacucccucuuagauuuuuuaagaaaugacuucagucacaaccguuuggacggaaccacauucgaacaucuagaagucucacccgauauaaguucauucauuacaggaacuuacucacuugcaugcggacgagcccaaucacgguucgcugacuuuuuuaaaccugacgauuucguccuggcuaaaaaccgcaaagaacaacuaauaucuguagcagauggcaaagaauguuuaacuguuuccggguuagcguuuuucauauguuuguuucucgauagagaacaagcaucaggcauguuaagcagaauaagaggguucaaaagaacggacgagaacugggcaagagcuguccacgaaaccuuuugcgaucuauguauaagacauccucaugacagacuagaaucaucaaauaccaaagaagcacuacuacuugauauguuaaaugaauuaaaucgaugucccagaauauuauaugacauguugccugaagaagaaagagcccaauuuuuaccugcucuagacgaaaacaguaugaacaaucuaagugaaaauucucuaaaugaagaaucaagauuacugugggauggauccucagacugggccgaagcauugacuaaaagaauaagacaccaagaccgauuuccauaccuaaugcuaagauuuauugaagaaauggaccuucuaaaaggaauccgauuuagaguagaucuaggugaaauagaauuagacagcuacucgaaaaagguaggaagaaauggugaauaugauagaacaauaacagaccacgcucuagcauucggaaaauuaagcgauuuucaaaacgaagaagaaguaagcagaaugauaagcggggaagcaucauacccaguacgauuuucucuguuugcuccuagguaugcuauauaugauaacaaaauaggguauugucauacaucagauccaguauacccgaaaucaaaaacaggagaaaaacgugcacuaagcaacccacaaaguaugggcuucaucucuguacaugauuuaagaaaauuacuacuaauggaauuacuuugugaaggaaguuucuccagaaugcaauccgguuuucuaagaaaggcaaauagaauacuugaugaaaccgcagaaggaaaacuccaauucagugcacuauuuccugagaugcgacaccgauuuauaccaccccaaaauccaaaaaguaaagacagaagagaaaaagcagaaacaacccuagaaaaauacaaacaagaaauaaaagggagaaaggauaaacuaaacagucaacugcuaucagcauuugauaugaaccagcgacaauuaccaucacgauuacuagacgaguggaugaacaucagaccggcaagucacucaguaaaauuaagaacauacguaaaacaauugaacgaagauugcagacucagauuacgaaaguuccgaaaagauggggacgggaaagcucgagcuauuccacuaguaggagaaauggcaacuuuucucucacaagauauaguaagaaugauaauuagugaagaaacaaaaaaacuaauaacuagugccuauuauaaugaaaugcagagaucauuagcucaauacgcgggagaagaaaaccgaagacaauuuagagcaaucgucgccgaacuacauuuacuugacccaucaucaggccauccauuucuauccgcaaccauggaaacagcacaccguuacacugaagauuucuacaaauguuacuuggaaaaaaaaagggaaugguuagccaaaacauucuacagacccgaacaagacgagaauacuaaaaggagaauaagugucuucuuuguaccagauggagaagcgcgaaaacuacuaccacuccucauaaggcgucgcaugaaagaacaaaaugaucuucaggacuggauccguaauaaacaagcgcauccaaucgauuugccuucacaccuauucgacucuaaaauaauggaauuacucaaaguaaaagacggcaaaaaaaaguggaaugaagcuuucaaagauugguggucaacgaaauauccagacggaaugcaacccuucuauggacuaagaagggaguuaaauauacauggaaaauccguaucauacauuccaagcgacgguaaaaaauuugcagacuguuauacgcaucucauggaaaaaacaguacaagauaaaaaacgagaauuacgcacagccggaaaaccaguuccucccgaccuagccgcagacauaaaaagaaguuuccauagagcaguaaaugaaagagaauuuaugcuacgacuaguucaggaagaugacagauuaaugcuaauggcaauaaauaagaugaugacagaccgcgaagaagauauucuaccaggccuaaaaaauauagacucuauuuuagacgaggaaaaucaguucagcuuagcgguccacgcaaaaguccuagaaaaagaaggagaaggaggugauaacagucuaagccuugugccagccacuauagaaauaaaaaguaagagaaaagauuggagcaaauauauaagguauagauacgaccgaagaguaccagguuuaaugagccacuuuccagaacauaaggcaacacuugacgaaguuaaaacuuuauuaggugaauaugacagaugccgcaucaaaaucuucgauugggcauuugcucucgaaggagcaauaaugagugacagggauuuaaaacccuacuuacacgaaucaucaucaagagaaggcaaaagcggggaacauaguacacuaguaaaaaugcuagucgagaaaaaagguuguuuaacaccagacgaaucccaauauuuaauauuaaucagaaauaaagcagcucauaaucaauuuccaugcgcugcugaaaugccacucauauauagggauguauccgcgaaaguggguucaauagaaggaaguuccgcuaaagauuuacccgaaggcucaagccuuguugacucauuauggaagaaauacgaaaugauaauccgaaaaauccuaccaauacuagaccaugaaaaccgcuuuuuuggcaaacuauuaaauaauaugucucaaccuauaaacgaccucuaa

SEQ ID NO: 11899 - RNA, 3408 nt, Artificial Sequence
  Cas13b variant__Porohyromonas gingivalis__ERJ65637.1__Cas13b
augaauacaguuccagcaucugaaaacaaaggucaaagccgaacaguugaagaugauccucaauauuucggccuguaccuaaaccuagcgagagaaaauuuaaucgaaguagaaagucaugucaggauaaaauucgggaaaaagaaauugaacgaagaaagucuaaaacaaucccucuuaugugaucaucuucucucuguugaccgauggacaaaaguauacggacauucacgaagauacuuaccauuucuacauuauuucgauccagauucacaaauugaaaaagaucacgauuccaaaacagguguagauccagauucagcccaaagacucauaagagaacuauauuccuuauuagacuuuuugagaaaugacuucagucauaaccgacuagauggaacgaccuuugaacaucuagaaguaucucccgauaucucauccuuuauuacaggcacauacucgcuagcguguggcagagcacaaucucgauuugcagauuucuuuaaaccggaugacuucgugcuugccaaaaaccgcaaagaacaacuaauaaguguagcagauggaaaagaaugccucacugugucaggcuuagcauucuucauaugccuauucuuagauagagaacaagcaaguggaaugcuaagucgcauacgagguuuuaaacgaacagaugaaaacugggcacgagcuguacacgaaaccuucugcgaucuuugcauacgacacccacacgaucgauuagaaucuucaaauacuaaagaagcucuauuacuagauaugcuaaaugaacuaaaucgcugccccagaauccucuaugauaugcucccagaagaagaaagggcucaauuccuaccagcacuagacgagaacagcaugaauaaucuaagcgaaaacucucucaacgaagaaucaagauuacuaugggauggcucaucagacugggcagaagcacuaacaaaaagaaucagacaccaagauagauuuccguaucuaaugcuacgauuuauagaagaaauggauuuacucaaaggaauacguuuccguguugaucugggugaaauugaacuggauucauauaguaagaaagucggaaggaauggcgaauaugacagaacaauaacagaccaugcacucgcauucggaaaauuaagcgauuuccagaacgaagaagaaguuucacgcaugauaaguggcgaagcaagcuaccccguaagauuuagcuuauucgcaccacgauaugcaauauacgauaacaaaauuggguacugucauacaucagacccaguauauccaaaaucaaaaacaggugagaaaagagccuuaucaaaccccaggaguauggguuuuauaucuguacaugaccuaagaaaauuacuguuaauggaacuacuuugugaaggaaguuucucacguaugcaaucagacuucuuacgaaaagccaaucguauacucgacgaaacagcugaaggaaaacuacaauucagcgcucuauucccagaaaugcgacacagauucauuccaccccaaaauccgaaaucaaaagaccgaagagaaaaagccgaaacgacauuagaaaaauauaaacaagaaauaaaaggccggaaagauaaacuaaauucacaacuacuaagugcauucgacauggaccaacgucaauuaccaaguagacuauuagaugaauggaugaacauacgaccugcaagucauuccguaaaauuaaggacauacguaaaacaacucaaugaagauuguagacucagauuacaaaaauuuagaaaagauggagacggaaaagcaagggcaauaccccuaguaggugaaauggccacuuuucucucacaagauauuguaagaaugaucauaagcgaagaaacuaagaaacuuaucacaucagcuuauuauaaugaaaugcaaaggucauuagcacaauaugcuggagaagaaaauaggcaucaauuccgagccauugucgcagaacuacggcuauuagacccauccucuggacaucccuuuuugucugccacaauggaaacugcacaccgcuauacagaagacuuuuauaaaugcuaucuagaaaagaaaagagaauggcuugcuaaaacauucuaccgaccugagcaagaugaaaacacgaaacgcagaauaagcguauuuuucguaccggauggagaggcacggaaauuacuuccacuacuaauccgaagaaggaugaaagaacaaaaugacuugcaagauuggauaagaaauaaacaagcacauccaauagauuuaccaucacaucuuuuugauagcaaaauuauggaacuuuuaaaaguaaaagauggcaaaaagaaauggaacgaagcauuuaaagacugguggagcacaaaauacccagacgggaugcaaccguucuauggcuugagaagagaacucaacauccacggaaaaucaguaaguuauauuccauccgacggcaagaaauuugcugauuguuacacacaccucauggagaaaacaguacaagauaagaaaagagaacugagaacugcaggcaaaccaguaccaccggauuuagccgcagauauuaaaagaucauuucacagagcaguaaacgaaagggaguucaugcuaagacucguacaagaagaugauagauuaaugcuaauggcaaucaacaaaaugaugacagaucgcgaagaagauauacuuccaggacuuaaaaacauagacucaauacuagacgaagaaaaccaauucucuuuggccguucacgcaaaaguacuagaaaaagaaggagaaggaggugacaauucucuaucucuaguaccugcuacgauagaaauaaaaaguaaacgcaaagauuggucaaaauauauacgauacagguacgacagaagaguucccggucucaugucacauuucccugaacauaaagcaacccuggacgaagucaaaacguuacuaggcgaauaugacagaugcagaaucaaaaucuucgacugggccuuugcacuagaaggugcaauaaugagugaucgugacuuaaaaccauauuuacaugaaucaucuagccgagaaggcaaaaguggagaacacucaacccuaguaaaaaugcuagucgaaaagaaaggaugucuuacaccagaugagucacaauaccucauuuuaauacguaauaaagcagcccacaaucaauuuccuugcgcagcagaaaugccacucauuuaccgagacguuagcgcaaaaguaggauccauagaaggaucaagugcaaaagaucuuccagaagggagcagcuuaguugacagucuuuggaagaaauaugaaaugauaauuagaaaaauacuaccaauuuuagauccagagaaucgcuucuucggaaaacuauugaacaacaugagucagcccaucaaugacuuauaa

SEQ ID NO: 11900 - RNA, 3408 nt, Artificial Sequence
  Cas13b variant__Porohyromonas gingivalis__WP_021665475.1__Cas13b
augaauacaguuccagcuagugaaaacaaaggccaaagucgaacuguagaagaugauccucaauacuucgguuuauacuuaaaccuagcgagagaaaauuugauugaagucgaaucacauguaagaauaaaguucgguaaaaagaaacuaaacgaagaaucacuaaaacaaucauuacuaugugaucaccuauuguccguagaccgauggaccaaaguauacgggcauucuagacgauaucuaccauucuuacacuauuuugacccagacagccaaauagaaaaagaucacgauucaaaaacagguguagauccagauucagcacaaagacuaauacgagaacuuuauucacuucucgauuuccucagaaacgacuuuucacauaauagauuagauggcacaacauuugaacauuuggaaguaucaccagacauaucauccuuuauaacaggaacauacucauuagcauguggccgagcacagucuagauuugcugauuucuuuaaaccugaugauuucguacuagcuaaaaacagaaaagaacaauuaauaucaguagccgacggcaaagaauguuuaacuguaucuggacuggcauucuucauaugcuuauucuuagacagggaacaagccaguggaaugcugucaagaauuagaggauuuaagaggacaaacgaaaauugggcucgagcaguacacgaaaccuucugugauuuauguaucagacauccacaugaccgauuagaaaguagcaacacaaaagaagcacuacuacucgauaugcucaacgagcuaaauagauguccacgaauauuauaugauaugcuacccgaagaagaaagagcucaauuuuuaccagcauuagaugaaaacaguaugaauaaucuaagugaaaacagucuaaacgaggaaucacgacuacugugggacgguaguucggauugggcggaagcacuuaccaaacgaauuagacaccaagacagauuucccuauuuaaugcuuagauuuaucgaagaaauggacuuauuaaaaggcauaagauuuagaguugaucucggcgaaauagagcuagacucuuauucaaagaaaguaggacggaacggugaguaugacagaacaauaacagaucacgcauuggcauuuggaaaacuaucagacuuccagaaugaagaagaaguaagucguaugauuaguggggaagcaucuuauccgguaagauucucauuauuugcgccaagauaugcaauauaugacaacaaaaucggauauugucauacaucagacccaguguacccaaaaucuaaaacaggagagaaaagagcucuauccaauccacaauccaugggauuuauuuccguacaugaccuccgcaaacuccuuuuaauggaauuacuaugcgaagggagcuuuucaagaaugcaaucaggauucuuaagaaaggcaaauagaauauuagacgaaacggccgaaggaaaguugcaauuuucagcacuuuucccagagaugcgacaucgauucauacccccacagaauccuaaaagcaaagauaggagagaaaaagcugaaacaacacuagaaaaauauaaacaagagaucaaaggccgaaaagacaaacuuaacagucaacuuuuaucagcauuugauaugaaccaaagacaauuaccuaguagauugcuagacgaauggaugaacauaagaccagcaagccacuccguaaaauuaagaacauacguaaaacaacugaacgaagacugccgucuaagauuaaggaaauuucgaaaagauggagacggaaaagcuagagcaaucccguuagugggcgaaauggcaacguuucuaucccaagacauugucagaaugauaauaucagaagaaaccaaaaagcuaaucacaucugcauauuauaacgaaaugcaaagaucucuagcacaauacgcgggugaagaaaauagaagacaauuuagagcaauaguugccgaauuacaccuacuagauccauccucaggacauccguuuuuaucagcgacuauggaaacagcacauagauacacagaagacuuuuauaaauguuacuuagaaaagaaaagagaaugguuagccaaaacauucuaucgcccagaacaggacgaaaauacuaaaagaagaauuagcguuuucuucguaccugauggagaggcccgaaaauuacugccucuucuaauaagaagacguaugaaagaacaaaaugaccuacaagauuggauaagaaacaaacaggcccauccaauugaccuccccucacacuuauuugacucaaaaaucauggaacugcuaaaaguaaaagacgguaaaaagaaauggaacgaggcuuucaaagacugguggagcacaaaauauccagacgguaugcaaccauucuacggucuaagaagagaacuaaacauucacgguaaaucuguuucuuauauacccucagacggcaagaaauuugccgauugcuacacccaucuuauggagaaaacaguacaagauaagaaaagagaauuacgaacugcaggcaaaccaguaccaccugaucuagcugcugauauuaaaaggagcuuucauagagcaguaaaugaaagagaauuuauguuacgauugguacaagaagaugauagacuaaugcuaauggcaauaaauaaaaugaugaccgauagagaagaagacauucuaccaggacucaaaaacauugacucaauuuuagacaaagaaaaucaauucaguuuagccguacaugccaaaguucucgaaaaagaaggcgaaggaggggacaauagucuaucacuuguaccugcaaccauagaaaucaaaucaaaaaggaaagauugguccaaauacauaagauaucgcuaugauagaagaguccccgggcuaaugagucauuuuccagaacacaaagcaacauuagaugaaguuaaaacguuacuuggggaauacgauagaugccgaauaaaaauauucgacugggcguucgcacuagaaggagcuauuaugucugauagagauuuaaaaccauaucuacaugaauccucaaguagagaaggaaaaucaggugaacacucgacacuuguaaaaaugcuaguagaaaagaaagguugccuaacccccgaugaaagucaauauuugauucugauacggaauaaagcugcccauaaccaauucccaugugcagccgaaaugccauuaaucuaccgugacgugucugcaaaaguugguucuauagaaggaucaucagcaaaagaucuaccagaagguagcucacuuguagauucgcucuggaagaaauacgaaaugauuauaaggaaaauccuaccaauauuggaucaugaaaacagauuuuucgguaaacucuugaacaacaugucacaaccaauaaacgaccuauaa

SEQ ID NO: 11901 - RNA, 3408 nt, Artificial Sequence
  Cas13b variant__Porohyromonas gingivalis__WP_061156637.1__Cas13b
augaauaccguacccgcuuccgaaaacaaaggccagucccguaccguagaagaugacccacaauauuuuggauuauaccuaaaccuagcacgcgaaaacuugauagaagucgaaucacauguccgaauuaaauuuggaaagaagaaauuaaaugaagaaagucuaaaacaaucuuuauuaugugaccaccuuuuaucaguugaucgauggacuaaaguauauggacauucacgccguuaccuaccguuucuccauuauuucgauccagacagucaaauugaaaaagaucaugauaguaaaacagguguagauccagacagugcacaacgacuaauuagggaacuauacucacuucucgacuuuuuaagaaaugauuuuucacauaacaggcuagauggcacaacauuugaacaccuggaagucaguccugacauaagcaguuucauaacaggcacauauagcuuagcaugcggcagagcgcaaucaagauucgcugacuucuuuaaacccgacgauuuuguacuagccaaaaacagaaaagaacaacuaauaucaguagcugacggaaaagaauguuuaacagugucaggcuuagcguucuuuauaugccucuuucuagacagagaacaagcaagcgguauguuaucuaggauaagaggauuuaaacgcacagaugaaaauugggcaagagcaguacaugaaacauuuugugaucuuugcauacgucacccucaugacagacuagagucaucuaacacuaaagaagccuuauuauuagacauguuaaaugaauuaaauagauguccaagaauccuauacgauaugcuucccgaagaagaacgugcacaguuucuuccagcauuagaugaaaacucaaugaacaauuuaucugaaaacuccuuaaacgaagaaucucgccuccuaugggacgguucaucagauugggcagaagccuuaacuaaaagaauuaggcaucaggauagauucccuuacuuaaugcucagauuuauagaagaaauggacuuauugaaagguauccguuucagagucgaccuuggagaaauugaauuagacaguuacaguaagaaaguuggaagaaacggagaauacgauagaacaaucacagaccaugcccuagcauuugguaaauuaagugacuuucagaacgaagaagaggucucucggaugauaucgggcgaggccucauacccaguacgauucucacuuuucgcuccacguuaugcaauauaugauaacaaaauaggguacugucacacuuccgauccaguauacccgaaaaguaaaacuggagagaaaagagccuuaaguaauccgcaaucaaugggauuuauaagcguucacgaccuuagaaaauuacuguuaauggaacuauuaugugaagguagcuuuucaaggaugcaaaguggauuucuaaggaaagcaaacaggauacuagaugaaacggcagaaggaaaauuacaauucucagcacuuuucccagaaaugagacauagguuuauacccccacagaauccuaaaucuaaagauagaagagaaaaagcagaaaccacacucgagaaauauaaacaagaaauaaaaggaagaaaagacaaauuaaauucccaacuuuuaagcgcuuucgauaugaaucaaaggcaauuaccuucacgacuauuagaugaauggaugaacauacgaccugccucacacuccgucaaauuaaggacuuacguaaaacaauugaaugaagacugccgacuaagacuaagaaaauuccgcaaagacggagauggcaaagcccgcgcaauaccuuuaguuggagaaauggcaacauuucuaagccaagauaucguuagaaugauaauaagcgaagaaacaaagaaauuaauaacuucggccuauuacaaugaaaugcaacgaucauuagcgcaguaugcaggcgaagaaaauagaagacaauuuagagcuauaguagcugaacuccaucuccuagauccaucaaguggacauccauucuuaagcgccacaauggaaacagcacaucgauauaccgaagacuucuacaaaugcuaccuagagaagaaacgggaauggcuagcaaaaacauuuuauagaccagaacaagacgaaaauacuaaacgaagaaucagcgucuucuuuguccccgauggugaagcucgaaaacuauugccccuauuaauaagacgacgcaugaaagagcaaaaugaucuccaagacuggauaagaaacaagcaagcacauccaaucgaucuaccaucacacuuauuugacucuaaaauaauggagcuauuaaaaguaaaagacggaaagaagaaauggaacgaggcauuuaaagauugguggaguacuaaauacccagacggaaugcaaccuuucuaugguuuaagacgcgaacuaaauauacacgguaaaucagucaguuacauaccgagugaugggaagaaauucgccgauuguuauacucauuuaauggagaaaacaguucaagauaagaaacgugaacuuagaacugcaggcaaaccgguuccuccugauuuagcagcagauaucaaaaggucauuccaucgugcaguaaaugaaagggaauuuaugcuaagauuaguacaagaagacgaucggcucauguuaauggcaauaaauaaaaugaugacugaucgcgaggaagauauacuacccgguuuaaagaauauagauagcauacuagacaaagaaaaucaauucucucuagccguacaugcgaaaguacuagaaaaagaaggagaagguggagauaauucacuaucucuuguaccugcaacaauagaaauaaaaagcaaaagaaaagacugguccaaauauauaagauacagauacgacagaagaguuccaggauuaaugucucauuucccagaacacaaagcaacauuagacgagguaaaaacauuauuaggugaauaugauagaugucgaauaaaaauuuuugauugggcuuucgcucuugaaggagcaaucaugagcgacagagacuuaaaaccuuauuuacaugagucaucaagccgagaagguaaaucuggcgaacacucaacauuaguuaaaaugcugguugaaaagaaaggcugcuuaacaccugacgaaucacaauauuugauacuuaucaggaacaaagcugcucauaaucaauuucccugcgcagccgaaaugccauuaauauauagagacguauccgccaaaguggguucaauugaaggaagcagcgccaaagaucuuccagaaggauccucacuuguagacucacuguggaagaaauaugaaaugaucauacgaaaaauacuucccauauuagauccggagaacagauuuuucggcaaacucuuaaacaacaugagccaacccauaaaugaccuuuaa

SEQ ID NO: 11902 - RNA, 3408 nt, Artificial Sequence
  Cas13b variant__Porohyromonas gingivalis__WP_023846767.1__Cas13b
augaauaccguaccagccagcgaaaacaaaggacagucccgaacaguagaagacgauccacaauauuuuggcuuauacuuaaaucuugcaagagaaaauuuaauagaaguagaaucucauguacgaauuaaauuuggcaaaaagaaauuaaaugaagaaucucuaaaacaaucgcuacucugugaucacuuacuuuccguagauagauggacaaaaguauacggacauagccgucguuacuuacccuuucuacauuacuucgauccagacagucagauugaaaaagaccacgauucuaaaacaggaguggaucccgacagugcacaacgacuaauaagagaauuauacaguuugcuagauuuucuacgaaacgauuucagucauaacagauuggauggcacuacguuugaacacuuagaaguaucaccagacauaagcagcuucauaaccggaacuuacucgcucgcauguggaagggcccaaucgcguuuugcagacuuuuucaaacccgacgauuuuguacuagcuaaaaauagaaaagaacaacuaauaaguguagcagauggaaaagaaugucuaacagucucaggucuugcauuuuucaucugccuauucuuagauagagaacaagcaucuggaaugcuuucaaggauaagagguuucaaacgaacagaugaaaauugggcacgggccguacaugaaaccuucugcgauuuauguauaagacauccacaugauagauuagaaucaucaaacacgaaagaagcauuacuacuagauaugcugaacgaacuuaaucgguguccccgaauuuuauacgauauguuaccagaagaagaacgugcacaauuucuacccgcucuagacgaaaacaguaugaacaacuuauccgagaacagucuaaaugaagaaaguagacuccuaugggacggaucaucagacugggccgaagcacuuacaaaaagaauuagacaucaggaucgguuuccauauuuaaugcucagguuuauugaagaaauggauuuauuaaaaggcauucguuuuagaguagaucuaggagagaucgaauuagacucuuauucaaagaaagugggacgaaacggagaauaugacagaacuauaacugaucaugcacuggcauucggcaaacucagcgauuuucaaaacgaagaagaaguaucuagaaugauuuccggagaagcauccuaucccguaagauuuucauuauuugcucccagauaugccauauacgacaauaaaauaggauacugucauacaucugauccuguauauccaaaaucuaaaacuggggagaaaagagcacucucuaacccuagaagcaugggcuuuauaucaguacaugacuuacgaaaauuauuacuaauggaacuccucugugaaggaucuuuuucgagaaugcaaagugacuuccugagaaaagcaaaucguauucuagacgaaaccgcggaaggaaaauuacaauucucugcacuauuccccgaaaugagacauagauuuauaccaccacaaaauccgaaaucaaaagauagacgagaaaaagcagaaaccaccuuagaaaaauauaaacaagagauaaaagguagaaaagauaaacuaaacucucaauuacucucagcauucgacaugaaucaaagacaauuaccaaguagauuacuggacgaauggaugaacauaagaccagcaagucauagcguaaaacuaagaacauacguaaaacaacuuaacgaggauugccgacuacgauuacgcaaauuuagaaaagauggagaugguaaagcaagggcaauaccucuagucggcgaaauggcaacauuucucucacaagauauaguacguaugauaauaagcgaagaaacaaagaaacuaauuacaucugcauauuauaacgaaaugcaaagaucuuuagcucaauacgcaggagaagaaaaucgaagacaguucagagcaauuguagcagaacuucauuuauuagauccaucauccggacaccccuuucucucggccacaauggaaacggcccacagguacacagaagauuucuauaaauguuauuuagaaaagaaaagagaauggcuugcuaaaacuuucuaccgacccgaacaagaugagaacacaaaaaggagaauuucugucuucuucguaccagacggggaagcacgaaaacuauuaccccuucuaauacgaagaagaaugaaagaacaaaaugaccuccaagauuggauacgaaauaaacaagcucacccaauugaccuaccuucacauuuauucgauuccaaaauaauggaacuacuuaaaguaaaagacgguaaaaagaaauggaacgaggcuuuuaaagacugguggagcacuaaauauccggacgguaugcaaccauucuauggcuuacgaagagaauuaaacauacauggaaaaucuguaucauauauaccaagcgaugggaagaaauucgcggauuguuauacacauuuaauggagaaaacgguacaggauaagaaaagagaacuaagaacagcuggaaaaccagucccuccagaucuugcugcagauauaaaaaggucauuucauagagcaguaaaugaaagagaauuuauguuaaggcuaguacaagaagacgacagacuaauguuaauggcgauaaacaaaaugaugacugaccgugaagaagacauucuuccgggccuuaaaaauauagacucgauuuuagaugaagaaaaucaauucagcuuggcuguacaugcaaaagugcuagaaaaagaaggugaagggggagacaauucacuuagcuuaguacccgcaacaauugaaauaaaauccaaacgaaaagauugguccaaauauaucagauacagauaugacagaagaguaccagguuuaaugagucauuucccugaacacaaagcaaccuuagaugaaguaaaaacauuauuaggugaauaugaccgcuguagaauaaaaauauucgacugggcauucgcauuagagggugcaauaaugagugauagagacuuaaaaccuuaccuucacgaaucuucaagcagagaaggaaaaucaggagaacacucuacucuaguaaaaaugcucguggaaaagaaaggaugucucacaccagaugaaucucaauaccucauacuaauccgaaauaaagcggcgcauaaccaauuccccugugcagcagaaaugccgcuuauauaccgcgauguuucagccaaaguaggaucaauagaaggaucaucggcuaaagacuuaccagaagguaguagucuaguagauucacuauggaagaaauacgaaaugauaauuagaaaaauacuaccgauauuggacccugaaaaucgauuuuucggcaaacuucuaaauaauaugagucaaccaauaaacgaucuauaa

SEQ ID NO: 11903 - RNA, 3408 nt, Artificial Sequence
  Cas13b variant__Porohyromonas gingivalis__ERJ87335.1__Cas13b
augaauaccguaccagcauccgaaaauaaaggacaaucgagaacaguugaagaugacccacaguauuucggacuuuaccucaauuuggcaagagaaaaucuaauugaagucgaaucgcauguccgaauaaaauucggaaagaagaaauuaaaugaagaauccuugaaacaaucacucuuaugugaccaucuauuaucagucgacagauggacaaaaguauacggacauagccgaagauauuuaccauuucuucacuacuucgacccagauagucaaauagagaaagaucacgacaguaaaacagguguugacccagacagcgcacaaagacucauacgagaauuauacucauuauuagacuucuuaagaaacgacuuuagccauaauagacuugaugguacaacauuugaacauuuagaagugucuccugacauaaguuccuuuauuaccggaacguauucauuagcuugcggcagagcucaaagcagauucgcugacuuuuucaaaccagaugacuucguacuagcuaaaaaccgaaaagaacaauuaaucucaguugcagauggaaaagaguguuuaacaguaagcggacuggcauucuuuauauguuuauuucuugaucgugaacaagcaaguggaauguuaucaagaauaagagguuucaaaagaacagacgaaaacugggcacgagccguccacgaaaccuuuugcgaccuaugcauaagacacccccaugacagacuugaaagcucuaauacuaaagaagcacuucucuuagacauguugaacgaauuaaauagaugcccccgaauacuuuacgauaugcuuccagaggaggaaagagcacaauuccuuccagcacucgacgaaaauucuaugaauaaccucagcgaaaacucauuaaacgaagaaagcaggcuccuuugggacgguucaagugauugggccgaggcauuaacaaaaagaauuagacaccaagauagauucccauauuugaugcucagauuuauagaagaaauggacuuacuaaaaggcauacgauucagaguagauuugggugaaauagaacuagauucauauucaaagaaaguaggucgaaauggugaauaugacagaacaauaacagaucaugccuuagcuuuuggaaaauuaagugacuuccaaaacgaagaagaaguaagucgaaugaucagcggagaggcuucuuacccagucagauuuucauuauucgcaccucgauaugccauauacgacaauaaaauaggcuauugucacacguccgaccccgucuaccccaaaagcaaaacaggagaaaaacgugcacucagcaaucccagaucaaugggauuuauaagcguacacgauuuaagaaaacuacuacucauggaauuauuaugcgaaggaucuuuuaguagaaugcaaagcgauuuucuaagaaaagcaaacagaauauuagacgaaacagcagaaggaaaacuacaauuuagcgcacuauucccagaaaugagacacagauuuauucccccgcaaaauccuaaaagcaaagauagaagagaaaaagcagaaacaacguuagaaaaguacaaacaagaaauaaaagguaggaaagacaagcuaaauucacaauuacuaucagcuuuugauauggaucaacgacaacuaccaucccgcuuguuagaugaauggaugaauauacgccccgcaagccacucaguuaaacuucgaacauacguuaaacaauuaaacgaagauugcagauuaagacuacaaaaauuccgcaaggacggugacggaaaggcacgagcuauacccuuaguaggagaaauggcgaccuuuuugucucaagacauagucagaaugauaauauccgaagaaacuaagaaacuaauuacauccgccuacuauaacgaaaugcaacgaucauuagcucaauaugcgggagaagaaaaucgucaccaguuucgugcaauaguugcugaacuacgacuauuagacccuucuucaggccacccauuuuugucggcaacaauggaaacagcacauagauacacagaagacuucuacaaauguuaccucgaaaagaaacgagaauggcuagcaaaaaccuucuaccguccugaacaagacgaaaauaccaaaagacgaauaagcguauucuuuguaccugacggagaagcgaggaaacuauugccucuucuaauaaggagaagaaugaaagaacaaaacgauuuacaagauuggauuagaaauaaacaagcucaucccauagaucuacccagucaucuauuugacaguaaaguaauggaauuacucaaaguuaaagacgggaaaaagaaauggaaugaggcuuuuaaagauugguggaguacaaaauauccugauggaaugcaaccuuucuauggauuaagaagggaauuaaacauacaugggaaauccgugagcuauauuccuuccgauggaaagaaauucgcagauuguuacacacauuugauggagaaaacaguccgagacaagaaaagagaauuaagaacagcaggaaaaccaguaccaccagaucuagcagcauacauaaaacgauccuuccacagagccguaaacgaaagagaguucaugcuacggcucguucaagaagacgaccgccuaauguuaauggcaauaaauaaaaucaugacugauagagaagaagacauacuuccaggcuugaaaaacauugacucaauauuagacaaagaaaaucaguuuaguuuagccguacaugcuaaaguacucgaaaaagaaggagaagguggggacaauucuuuaucccuaguaccugcuacuaucgaaauuaaaucaaaacgaaaagacuggucaaaauacauucgauauagauacgacaggagaguacccgguuuaaugucacauuuuccugaacauaaagcaacauuagacgaaguaaaaacacuuuuaggugaauaugaucgguguagaauaaaaauauuugauugggcguuugcacuugaaggagcgaucaugucggacagggaucuaaaaccuuaccuacaugaaucaucuucucgagaagguaaaaguggagaacauucuacuuuagugaaaaugcuggucgaaaagaaaggaugucuaacaccggaugaaagccaauaucuaauccuaauacgaaauaaagcagcacacaaccaguuuccaugcgcagcagaaauuccauuaauuuaccgugaugugucagccaaagucgguuccauugagggaaguagugcaaaagaucuaccagagggaucuucuuugguugauagucucuggaagaaauacgaaaugauuauuagaaaaauauuaccaauauuagauccagaaaacagguuuuucggaaaacuucuaaauaacaugucacaaccaauuaaugaccucuaa

SEQ ID NO: 11904 - RNA, 3408 nt, Artificial Sequence
  Cas13b variant__Porohyromonas gingivalis__WP_005873511.1__Cas13b
augaacaccguaccugcuucagaaaacaaaggacagucaagaacaguagaagacgauccacaauacuuuggccuauaccucaaccuagcacgugaaaaucuaauagaaguugaaucgcauguaagaaucaaauuugguaaaaagaaauuaaacgaagaaucacuaaaacaaucacuccucugcgaucaucugcuaucaguagaucgauggaccaaagucuacggucauucacggcgauauuuaccauucuugcauuauuucgacccagauagccaaauagaaaaagaccacgacucuaaaacgggaguagaucccgacagcgcacaaagacuaauaagagaacuauauagccuacuagauuucuuaagaaaugauuuuucacacaaucgccuggauggcaccacauuugaacaucuugaaguaucuccugauaucagcaguuuuauaacuggcacauauucucuagcauguggacgugcacaaaguagauuugcugacuuuuucaaacccgaugacuuuguauuagcgaaaaauagaaaagaacaauuaauaucaguugcagauggaaaagagugcuuaacuguaucgggauuggccuuuuucauaugucuauuucucgaccgagaacaggcuucaggaauguuaucaagaauuaggggauucaaacguacugaugaaaacugggcuagagcaguucaugaaacauuuugcgaccuauguauaagacacccacaugauagauuagagucuagcaauacuaaagaagcacuacuccucgacaugcuaaacgaauuaaaccgauguccaagaauacuauacgauaugcuacccgaagaagaacgugcccaauuucucccagcuuuagaugaaaauucaaugaauaaccugagugaaaacuccuuaaaugaagaaucaagacucuuaugggauggauccucggauugggcagaagcucuaacaaaaagaauccgacaccaagauagauucccuuaucuaaugcuucguuucauagaagaaauggaucucuuaaaaggaauaagauuucguguugauuuaggagaaauagaguuagauucauacucaaagaaaguagguagaaacggagaauacgacagaacgauaacugaucaugcucucgcuuuuggaaaacuauccgauuuucaaaaugaagaagaaguaucacguaugauaucuggcgaggcuucauauccuguacgauuuaguuuauuugcaccuagguaugcaauauacgauaacaaaauaggauauugucauacgagcgauccaguuuacccaaaaucaaaaacaggugagaaaagagcacuauccaauccacaaagcauggguuucauuucaguucauaaucugagaaaacugcucuuaauggaauuauuaugugaaggaucauucuccagaaugcaaucagauuuccuccgaaaagcuaacagaauauuagaugaaacagcggaaggaaaacuacaguucucagcucuuuuuccugaaaugcgacaucguuucauuccaccucaaaauccgaaaucaaaagauagacgagaaaaagcagaaacuacgcucgaaaaauacaaacaggagauuaaggguagaaaagauaaacuaaauucgcaacuauuauccgcuuucgauaugaaucaaagacaauuaccgagucggcuauuagaugaauggaugaacauaagaccagcaagccauagcguaaaacuuagaacauauguaaaacaacucaaugaagauuguagauuacgacuaagaaaauuuagaaaagacggagacggcaaagcgcgagcaauuccauuagucggcgaaauggccacauuccuaucucaggauauagucagaaugauuauuuccgaagaaacaaagaaacuaaucacuucagcuuauuauaacgaaaugcaacguucauuggcucaguaugcaggagaagaaaacagacgucaauuucgcgcaauaguagcggaauuacaccuacuagacccaaguucaggucauccauucuuaagcgcuacaauggaaacugcucaccgauauacugaagacuucuauaaaugcuaucuagagaagaaacgagaguggcuagcuaaaacauucuaucgaccagaacaagaugaaaauaccaaaagaagaauauccguauucuuuguaccagacggagaggccagaaaacuacucccauuauuaauacgucgaagaaugaaagaacagaacgaccuucaggacuggauacguaacaaacaagcgcacccaauagaccugccuucacaucuguuugauucaaaaauaauggaauuacuaaaaguaaaagauggaaagaagaaauggaacgaagccuucaaagacugguggucaacaaaauauccagacggaaugcaaccauucuacggacucagacgagaauuaaacauacacggaaaaucaguaucauauauuccuagugacggcaagaaauucgcugacugcuauacccauuuaauggaaaagaccguucaagauaagaaaagagaacuaaggacagcuggaaaaccaguuccaccagauuuagcggccgacauaaaaaggagcuuucacagggccgucaaugaacgggaguucaugcuaagauuaguucaagaagacgacagacuaauguuaauggcuauaaauaaaaugaugacugaccgugaagaagacauacuaccaggucucaaaaacauagacucaauacuagaugaagaaaaucaauucagccuagcuguacaugcaaaaguucuagaaaaagaaggagaaggaggugauaacucauuaucucuuguacccgccacaauagaaauaaaaucgaaaagaaaagacuggucaaaauacauaagauauagauacgauagacgagucccaggucuaaugucucauuuuccugaacacaaagccacauuagaugaagucaaaacuuuacuaggagaauaugauagaugcagaauaaaaauauuugacugggcauucgcucuugaaggcgcaauaaugagcgaucgagaucuaaaaccuuauuugcaugaaagcagcucgcgagaaggaaaaucaggugaacauagcacccuagugaaaauguuaguagagaagaaaggaugcuuaacaccugaugaaagccaauaccuuaucuuaauaagaaauaaagcagcacauaaucaauuccccugcgcagccgaaaugccacuaauauaccgagaugucucagcgaaaguaggaagcauagaaggaagcagcgcuaaagaccuaccagaaggaaguagccuaguugacucauuauggaagaaauaugaaaugauuauccguaaaauauuaccaauauuagacccagaaaauagguucuuugguaaauuacuaaauaauaugucucaaccaauaaacgaucuguag

SEQ ID NO: 11905 - RNA, 3408 nt, Artificial Sequence
  Cas13b variant__Porohyromonas gulae__WP_039445055.1__Cas13b
augaacacuguaccggcuacugaaaacaaaggucagucaagaacaguagaagacgacccgcaauauuucggauuauaucuaaaucucgcacgagaaaaucuaauagaagucgaaagucacguccgaauaaaauucgguaaaaaaaaauuaaaugaagaaucucuaaaacaaagccuacuuugcgaucaucuauugagcauagacagauggaccaaaguauauggacauucuagacgauaucuuccauucuuacacugcuuugauccggacuccggaauagaaaaagaucacgauucaaaaacaggagucgauccagauagcgcacaacgucuaauaagagaacucuauucuuuacucgauuucuugagaaaugauuuuucacauaacagguuagaugggaccaccuuugaacauuugaaaguuagcccagauauaucaagcuuuauuaccggcgcuuacacauuugcaugcgaaagagcucaaaguagauuugccgacuuuuuuaaaccugaugauuuuuuauuagcaaaaaauagaaaagaacaacuaauaucaguagcagacggaaaagaaugcuuaacaguaucagguuucgccuuuuucauaugucuauucuuggaucgugaacaagcaaguggaaugcuaagucgcauacgcgguuucaagagaacagacgaaaauugggcaagagcaguacaugaaaccuuuugugacuuaugcauacgacacccucacgacagguuggaaaguucaaacacaaaagaagcauugcuauuagacaugcucaaugaacucaaccgauguccgagaauucuauaugacaugcuaccugaagaagaaagagcucaauuucuucccgcuuuagaugagaauucaaugaauaaccucucugaaaauaguuuaaacgaagaaagcagguuacuaugggacggaucuuccgauugggcugaggcacucaccaaaaggauucgacaccaggauagauucccauaucuaauguuaagguuuauagaagaaauggauuuauuaaagggaauaagauuuagaguagacuuaggcgagauagaacuugacagcuacucaaaaaaaguugggagaaacggagaauaugauagaaccauaacagaucaugcgcuagccuuugggaaacuauccgauuuccaaaacgaggaagaaguaucaagaaugauaucaggagaagcaaguuacccggucagauuuucacuuuucgcaccgagguaugcaauuuaugacaacaaaauuggcuauugucauacaucagauccaguauacccaaaaaguaaaacgggagaaaaacgugcacuaaguaacccacaaucaaugggauuuaucucaguacaugaucugagaaaacuauuacucauggaacuauuaugugaaggcagcuucucuagaaugcagagcgauuuccuucgaaaagcaaauagaauucuugaugaaaccgcagaaggaaaauuacaauuuucagcguuauuuccagaaaugagacauagauucaucccaccccaaaacccaaaaagcaaagaccgccgagaaaaggcugaaacaacguuagaaaaauacaaacaagaaauaaaaggaagaaaagacaaacuaaauagccaacuacucuccgcauucgauaugaaucaacgucaauuaccaucuagacuucuugaugaauggaugaauauaagaccagcuucacacagcgucaaauuacguacauacguaaaacaguuaaaugaagacugcagacuacgacuacguaaauuuagaaaagacggcgauggaaaagcaagagcaaucccucuagucggugaaauggcuaccuuccuaucucaagauaucguacguaugauaauaagcgaagaaacaaaaaaauuaauaacaagcgcauacuauaaugaaaugcaaagaucccuagcacaauaugccggcgaagaaaauaggagacaauuucgagcuauuguagcagaacuacaccuccuagauccaucaaguggacacccauuccuuagugcuacaauggaaacagcccauagguacacagaagauuucuauaaauguuaccuagagaaaaaacgagaaugguuagcuaaaacuuucuauagaccagaacaagaugaaaauacaaaaagaagaaucagcgucuuuuuuguaccagauggagaagcgagaaaauuacugccucuuuuaauaagaagaagaaugaaagaacagaaugaccuacaagauuggauucgaaauaaacaagcacacccaauugacuugccaucccaucucuuugauaguaaaauaauggaacuacuaaaagucaaagauggaaaaaaaaaauggaacgaagcguuuaaagauugguggaguaccaaauaucccgauggaaugcaaccauuuuauggucuuagaagagaauuaaacauacacggaaagucggucagcuacaucccaucagacggcaaaaaauucgcagauuguuauacacaucuaauggaaaaaacugugcgugauaaaaaaagagaauuaagaaccgcaggaaaaccugucccgccagaucuugccgcauauaucaaacgcaguuuccaucgcgcggucaaugagagagaauuuaugcuaagauuaguacaggaagacgaucgcuuaaugcucauggcuauaaauaaaaugaugacggauagagaagaagauauacugccaggucugaaaaacauugauuccaucuuagaugaagaaaaucaauucucacuagccguacacgcuaaaguguuagaaaaagaaggcgaagguggcgacaauagcuuaagucuuguaccagcaacaauagaaauaaaaaguaaaagaaaagauuggucuaaauacauaagauaccgauacgacagaagaguuccaggacuaaugucacauuucccagaacauaaggcuacacucgaugaaguuaaaacgcuucuaggagaguaugauagauguagaauaaaaauauucgacugggcauuugcacuugaaggagcaauuaugucagaccgcgacuuaaaaccauacuuacacgaauccuccagcagggaagggaaaucuggggaacauucaaccuuaguaaagauguuaguagagaaaaaaggaugucuaacaccagaugaaucucaguauuuaauacucauaagaaacaaagcagcucacaaccaauucccaugugccgcagaaaugccguuaauauacagagauguuucagcaaaaguaggaucuauugaaggaucuucagcuaaagacuuaccagaaggaagcucauuaguagauucauuauggaaaaaauaugaaaugauaauacgcaaaauauuaccaauucuggaucacgaaaaccgauucuuuggcaaauuacuaaauaauaugagccaaccaauaaacgaucuauga

SEQ ID NO: 11906 - RNA, 3528 nt, Artificial Sequence
  Cas13b variant__Porphyromonas gingivalis__WP_052912312.1__Cas13b
augacagaacagaacgaaaagccauauaauggcaccuauuacacguuagaagauaaacacuuuugggccgcauucuuuaauuuagccagacacaacgccuauauaacacuagcacacauagaucgacaacuagcauauucuaaagcugauauuacuaaugaugaagauauacuuuucuuuaaaggacaauggaagaacuuggauaaugacuuagaaagaaaagcgagacuccgaagccugauacugaaacauuuuucauuuuuagagggagccgcauacgguaagaaacuauuugagucacaaagcucuggaaacaagucaucaaagaagaaagaacuaacaaagaaagaaaaagaggaacuccaggcaaacgcucuaucuuuagauaaccuuaaaucaauauuauuugacuuucuacagaaauuaaaagauuuuagaaacuauuauucccacuaccgacacccagaaaguagugaacuuccacuauucgacggaaauaugcuacaaagacuauacaacguauucgauguaaguguucagagaguuaaaagggaucaugaacacaacgauaaaguggacccucacagacacuuuaaucauuuagucagaaaaggaaagaaagauaaauacggaaauaacgauaauccauucuuuaaacaucauuuuguggaucgcgaagaaaaaguaacugaagcuggacuacuauuuuucgugagccuauuccuugaaaaacgagaugcuauuuggaugcaaaagaaaauaagagguuuuaaaggcgguacagaagcauaucaacaaaugaccaacgaaguuuucuguaggucccgcauuucucuuccaaaauuaaaauuagaaucauugcgcaccgaugauuggaugcuccuagacauguuaaaugaauuaguuagaugcccaaaacucuuauaugacagacucagagaggaagauagagcaagauucagaguuccuguagauauucuaagugaugaagacgacacugacgggacagaagaagacccauucaaaaacacccuaguucgucaucaagacagauuuccauauuuugcucuuagauauuuugauuuaaagaaagucuucacaagucuuagauuccauauagauuuaggcacuuaucacuucgcaauauauaagaaaaacauaggagaacaaccagaagauaggcaucuaacaagaaaucuuuacggauucgguaggauucaagauuucgcagaagaacacagaccagaagaauggaaaagacucguaagagacuuagacuacuuugaaacaggugacaaacccuacauaacacagacaacaccacacuaucacauugaaaaagguaaaauaggauuaagauuuguccccgaaggacaauuauuauggccaaguccugaaguaggagcuacacgcaccgguaggagcaaauaugcgcaagauaaacgguuuacagcggaagcguucuuaaguguacacgaauuaaugccaaugauguucuacuacuucuuauuaagagaaaaguacagugaagaagcgucggcagaaaaaguacagggaagaauaaaacgaguaauagaagauguguacgcaguguaugaugccuuugcaagagacgaaauuaacaccagagacgaacuugacgcuugucucgcagacaaaggaauacgucgaggacaucuaccaagacaaaugaucgcaauacuuucucaggaacauaaagacauggaggagaaaguuagaaagaaauuacaagaaaugauagcugauacagaucauagacuggauauguuagaccgccaaacggacagaaaaaucagaauaggacgaaagaacgcaggacuaccaaaaaguggaguaauagcagauugguuaguaagagauaugaugagauuucaacccguagcuaaagacacuucuggaaaaccauuaaauaauuccaaagcgaauaguacggaauacagaaugcuacagagagcauuagcuuuauucggaggcgaaaaagaaagacucacacccuacuucagacagaugaauuuaacagggggaaauaauccacacccauuccuccaugaaacaagaugggaaagccauacgaacauccuuucauuuuaucgaaguuaucuaaaagcucgaaaagccuuucuucaaucuauaggaagaagcgacagagaagaaaaucacagauuccuccuccuuaaagaaccuaaaacagacagacaaacauuaguagcaggauggaaauccgaauuucaucucccaagagguauauucacugaggcaguaagagauugccuuaucgaaauggguuaugacgaaguaggaucguacaaggaaguaggauuuauggcuaaagccguaccacuauacuuugaaagagcaugcaaagaucgaguccaaccauuuuaugauuacccauuuaauguuggaaacucacuaaaaccaaagaaaggacgauucuuaucaaaagagaaaagagcagaagagugggaaaguggaaaagaaagauuuagagaucuagaagcauggucacacucagcagcaaggaggauagaagaugcguucguaggaauagaauacgcauccugggaaaacaagaagaaaaucgaacagcuccuacaagaccuaagucuuugggaaacauucgagucgaaacuaaaaguaaaagcagacaaaauaaauauagccaaacuuaagaaagaaauauuagaagcaaaagaacacccauaucaugauuuuaaaucuuggcagaaauucgaaagagaacuaagguuaguuaaaaaucaagauauaauaaccuggaugaugugucgugaccuaauggaggaaaacaaaguagaaggacucgacacaggaacauuauaucuuaaagacauucguacugauguacaagaacaaggaucauuaaacguuuuaaaucauguaaaaccaaugagacuaccaguaguaguauacagagcagacucaagaggccauguacauaaagaagaagcuccauuggcgacuguauacaucgaagagagagacacaaagcuacuaaaacaaggaaacuucaaaucauuuguaaaggacaggagauuaaacgggcucuuuucauucguagauacaggagcucuggccauggaacaauacccaauaucaaagcuaagaguugaauaugaacuagcuaaauaccaaacagcgcgaguaugcgcguuugaacagacacuagaauuggaagaaaguuuauuaacacgauauccacaccucccagaugaaucuuuccgcgagauguuagagucauggucggacccacuauuagacaaauggccagacuuacaaagagagguaaggcucuugauugcgguacgaaacgcauuuucacacaaccaauaccccauguaugacgaaacuauauuuucuaguauuagaaaauacgacccaucaagucuugacgccauugaagaacgaaugggacucaauauugcacacagacuaucggaagagguaaaacuagcgaaagaaaugguggaacgaauuauacaagccuaa

SEQ ID NO: 11907 - RNA, 3360 nt, Artificial Sequence
  Cas13b variant__Porphyromonas gingivalis__WP_053444417.1__Cas13b
augacagaacaaaacgagaaaccuuacaauggcacauauuauacuuuggaggacaagcacuuuugggccgcuuuccuaaacuuagcaaggcauaacgcguauauaacacuugcacacauagauagacaacuagcauauaguaaggcagauauuacuaaugaugaggacaucuuauuuuuuaaaggacaauggaaaaacuuagacaaugauuuagaaagaaaagcaagacucagaagccuaaucuuaaaacauuuuucauuucucgaaggggcagcauauggcaaaaaauuauucgaaagucaaaguuccggaaacaaaagcucuaaaaaaaaagaacuaucuaaaaaagaaaaagaagaacuacaagcgaacgccuuaagccuagauaaccuaaagucaauacuauucgauuuucuacaaaagcuaaaagacuucagaaacuauuauucucauuauagacaccccgaaucaagugaacuaccacuauucgaugguaacaugcuccaacgauuguauaacguauuugauguauccguacagagaguaaaaagggaucacgaacacaaugacaaaguugacccccaucgccacuucaaucauuuaguacgaaaaggaaaaaaagauaaauaugguaacaacgacaacccauucuucaaacaccauuucgucgaucgagaaggaacuguaacagaagccggcuuacuuuucuuuguuucauuauucuuagaaaaacgugaugcuauauggaugcaaaaaaaaauucgaggauucaaaggagguaccgaagcauaucaacaaaugaccaaugaagucuucuguagaagcagaauaucacuaccaaaauuaaaacuagaaucccuacgaacugacgauuggaugcuacuggacaugcuuaacgaauuaguacguuguccaaaaucauuauacgacagacucagagaagaagauagagcuagauucagaguccccguagauauacucagcgacgaagaugauacagacggaacggaagaagacccguuuaaaaauacacucguaagacaucaagauagauuuccuuacuucgcuuuaagauacuuugaccucaaaaaagucuuuacgagucuaagauuccacauagaucuuggaaccuaccauuuugcaauauauaaaaaaaauauaggcgagcaaccggaagacagacaccuaacuagaaaccuauacggcuuuggcagaauacaagacuucgcagaagaacaucgaccagaagaauggaaaagacuaguacgugauuuagauuacuuugaaacuggagacaagccuuacauuacucaaacaacaccucacuaucacauagaaaaagguaaaauuggauuaagauuuguuccagaaggccaacaccuauggccaucaccagaaguaggagcaacaaggacaggacgaagcaaauacgcacaagauaaacgacucaccgcagaagcauuucuaucgguccaugaacucaugccaaugauguuuuauuauuuucuguuaagagaaaaauauagcgaagaagugucagcagaaaaaguacaaggucggaucaaacgagucaucgaagauguauacgccgucuacgaugcauucgcaagagacgaaauaaacacaagagacgaacuagacgcgugcuuagcagacaaaggcauacgaagaggacaucuaccaagacaaaugauagcaauacuuucucaagaacauaaagauauggaagaaaaaguaagaaaaaaauuacaagaaaugauagcggacacagaucaccgguuagacaugcucgacagacagaccgacagaaaaauaagaauaggaagaaaaaacgcagggcugccuaaaucgggaguaguagcagauuggcuugugagggacaugaugagguuccaaccaguagcaaaagacacaucagggaaacccuuaaauaacaguaaagcaaauucgacugaauacagaaugcuucaaagagcauuagcccuuuuuggcggugagaaagaacgauuaacaccauauuuuagacaaaugaaccuaacaggaggcaacaauccacacccauuuuuacaugagacaaggugggaaagucacacuaauauacuaucauucuaccgaucuuaucucgaagcaagaaaagcauuuuuacaaaguaucggaagaucugacaggguagaaaaucaucgauucuugcuccuaaaagaaccuaaaacagauagacaaacucuaguugcuggauggaaaggugaauuccaccuuccaaggggaauauuuaccgaagcaguaagagacugucuaauagaaaugggauacgacgaaguaggaaguuauaaagaaguuggauucauggcaaaagccguaccccuauauuucgaacgagccaguaaagauagaguacaaccauucuaugauuacccuuuuaacguaggaaauucauuaaaaccuaaaaaaggacgauuuuugaguaaagaaaaaagagccgaagagugggaaagugggaaagaaagauuucgccuagcaaaauuaaaaaaagaaauuuuagaagcaaaagaacacccauaucacgacuucaaaaguuggcaaaaauuugaaagggaauuaagacuuguaaaaaaucaagauauuauaacauggaugauguguagagauuuaauggaagaaaauaaaguagaaggcuuagacacaggaacauuauaucucaaagauauaagaaccgacguucaagaacaagggaguuuaaauguacuaaauagaguaaaaccgaugagacuaccaguaguaguauacagggcagacucaagaggacacguucacaaagaacaagcaccgcuagcaacagucuauauugaagaacgagauacaaaacuauuaaaacaaggaaauuucaaaaguuuuguaaaagauagaagacuaaauggcuuauucuccuuuguugauacaggggcauuagcuauggaacaauacccuauaucuaaacucagagucgaguaugaauuagccaaauaucaaacggcaagggucugcgcauucgaacaaacauuagaacucgaagaaagucucuuaacaagauauccucaccuccccgauaaaaacuuucgcaaaauguuagagaguuggucagauccacuacuugacaaauggccugaucuacaugguaacguucgacuacuaauugccgucagaaaugcauuuucacacaaucaauacccaauguacgacgaaacccuauuuagcaguaucaggaaauaugacccaucaucacccgacgcaauagaagagcgaaugggccucaauauagcccacagauuaagcgaggaagucaaacaagcaaaagagaugguugaaagaauaauacaagcauaa

SEQ ID NO: 11908 - RNA, 3360 nt, Artificial Sequence
  Cas13b variant__Porphyromonas gingivalis__WP_012458414.1__Cas13b
augacagaacaaaaugaaagaccuuauaacggcacuuauuacacucucgaagauaagcacuuuugggcagcuuuuuuuaauuuagcacgacauaacgccuauauaacacuagcucauauugauagacaacuagcguacucaaaagccgauauaacaaaugacgaggauauauuguuuuucaaaggacaauggaaaaacuuagacaacgaccuugaaagaaaagccagacuacguucacuaauacugaaacauuucucauuccuugaaggagcagcauacggaaagaagcuauuugagucucaaagcagugguaauaaaagcaguaaaaaaaaagaacuaacaaaaaaagaaaaagaagaauuacaagcaaaugcucuaucccuugacaaucuuaagucaauacuuuuugacuucuugcaaaaacuaaaggacuucaggaauuacuauucucacuauaggcacccugaaucgucagaauuaccuuuauuugauggaaauauguugcaaagauuauacaauguauuugacguuagugugcaaagaguaaaaagagaucaugaacauaacgacaaaguagauccucaucggcacuuuaaucaucuaguaagaaaagguaaaaaagacagauauggcaacaaugacaauccauuuuucaaacaucauuuuguagauagggaagaaaaaguaacagaagcgggcuuacucuuuuuuguaucuuuguucuuagaaaaacgggaugcaauauggaugcaaaaaaaaauacguggcuuuaaaggcggaacagaaacguaccaacaaaugaccaaugaaguauuuugcagaucgagaauaucguuaccaaaacuaaaacuagaaucacuccggaccgacgauuggaugcuuuuagauaugcugaacgaacuaguacgaugcccuaagaguuuauaugacagauuaagagaagaagaccgcgccagauuuagaguaccugucgacauuuugucugaugaagaugauacagacggaacggaagaagauccauuuaaaaauaccuugguaaggcaucaagauagauuuccauacuuugcauuaagauauuucgacuuaaaaaaaguauucacuagucuccgcuuucauauagacuuaggaacuuaccacuuugcaaucuacaaaaaaaauauaggagaacaaccagaagacagacaucuuacaagaaacuuauacggauucggaaggauacaggacuuugcagaggaacacagaccugaagaauggaaacgauuaguaagggaucuagauuauuuugaaacuggcgauaaaccuuauauaacacagacuacaccacauuaucauauagaaaaaggaaagauuggacuacgauuuguaccugaaggucaacaucuauggccuagccccgaaguaggagccacaagaacaggaagaaguaaauacgcacaagacaaaagauuaacagcagaagcauuucuaucugugcacgaacuuaugcccaugauguuuuauuacuuccucuuaagggaaaaauacucagacgaggcaagcgcugaacgcguacaaggaagaauaaaaagaguuauagaagacguuuacgcaguguaugaugccuuugcuagaggagaaauaaacacaagagaugaacuagacgccugcuuagcagacaaagggauaaggaggggucauuuaccaagacaaaugaucggaauucucagccaagaacacaaagauauggaagaaaaagugagaaaaaaacuucaagaaaugauaguagauacagaucacagauuagacaugcuagacagacaaaccgacagaaagauacgcauuggaagaaaaaaugcugguuuaccuaaaagugggguaaucgcagacuggcucguacgagauaugaugagguuccaaccaguugcuaaagauacaagugguaagccauuaaauaacaguaaggccaacagcacugaauauagaauguuacaacgugcucuugcacuauuugguggagaaaaagaacgauuaacgccuuauuucagacagaugaaccuaacaggagguaauaacccucauccauuccuacacgaaacuagaugggaaucacauaccaauauacucucuuuuuauaggucguaccuaaaagcaagaaaagcuuucuuacaaagcauaggacgcuccgaucgaguugaaaaccaccgauuccuauuacuaaaagaaccgaaaacggauaggcaaacuuuagucgcagguuggaaaggugaauuucaccuaccacgugggauauuuacagaagcaguccgagauugucugauagaaaugggauuagaugaaguaggaaguuacaaagaaguagguuuuauggcgaaagcaguaccuuuauacuucgagagagcauguaaagacagaguucaaccauucuaugacuauccauuuaauguaggaaauucucuaaaacccaaaaaagggagauuuuuaucaaaagaaaaaagagcagaagaaugggaaucaggaaaagaaagauuuagacucgcaaaauuaaaaaaagaaauuuuagaagcaaaagaacaucccuacuuagauuucaaaucauggcaaaaauuugaaagagaacucagauugguaaaaaaucaagacauuauuacauggaugauaugccgagacuuaauggaggaaaauaaagucgaaggucuagauacagguacuuuauaccuaaaagauauuagaacagauguacaggaacagggaaaucuaaacguauuaaacaggguuaaaccaaugagauuaccaguagucguauauagagcugauagccgcggacacguucacaaagaacaagcaccauuagcaacuguguauauagaagaacgagauacaaaauuacugaaacaaggcaauuucaaaucguucguaaaagaccggagauuaaauggucuauuuucuuuuguagauacaggagcacuggcuauggaacaauauccgauuaguaagcuaaggguugaauacgaacuagcaaaauaucaaacugcaagagucugcgccuuugaacaaacucuagaacuagaagaaaguuuacuuaccagguacccccaucuuccagauaaaaauuuuagaaagaugcuagaaucauggucugauccucucuuagacaaauggccagauuuacauggcaauguacgauuacuaauagcaguaagaaaugcauuuagucauaaucaauauccaauguaugacgaagcagucuuuucaucaauacgaaaauaugauccaagcucaccugacgcgauagaagaaaggaugggucuaaacaucgcacauagacucucagaagaaguaaaacaagcuaaagagauggccgaacgaaucauacaagcuuag

SEQ ID NO: 11909 - RNA, 3360 nt, Artificial Sequence
  Cas13b variant__Porphyromonas gingivalis__WP_039417390.1__Cas13b
augaccgaacaaaaugaaagaccauauaacggaacauacuauacauuggaagauaaacauuucugggccgcauucuuuaaucuagcaagacauaaugcauacaucacgcuggcacacauagauagacaauuggccuacaguaaagcggacauaaccaacgacgaagauauacuauucuuuaaaggacaguggaaaaauuuggacaaugaccuugaaagaaaagcaagacugcggagucuaauacuaaaacauuuuucauuuuuagaaggggccgcauauggaaagaaacuauuugaaucacaaucuagugguaauaaaucauccaaaaagaaagaacuaacaaagaaagaaaaagaagaacuacaagccaaugcguuaucacuagacaaucugaaaucuauacuguucgacuuuuuacaaaaauuaaaagauuucagaaauuauuauucucauuaucgacaucccgagagcucagaacuuccccuauucgaugguaauaugcuucagcgcuuauacaauguguuugauguaucaguacaaagaguaaaaagggaucaugagcauaaugauaaaguggacccucauagacacuuuaaccauuuagucagaaaaggcaagaaagacagauauggaaacaacgauaauccuuucuuuaaacaucauuuuguggacagggaaggcacagucacagaagccggcuuauuauucuuuguaucacuuuuucuagaaaaacgagaugccauuuggaugcaaaagaaaauaagagguuuuaaaggcgggacagaagcauaucaacaaaugacgaaugaaguguuuugcaggagcagaauuucucuuccaaaauuaaaauuagaaagccuaagaacagaugacuggaugcuuuuagauaugcucaacgagcuaguacgcugcccaaaaaguuuauacgaccgauugagagaagaagacagagcaagauuuagaguaccuaucgauauacugagcgacgaagacgacacagacggaaccgaagaagauccguuuaaaaacacacugguaagacaucaagauagauuuccuuacuuugcacuaagguauuuugaucuuaagaaagucuuuacaucacuaagauuccauauagaucucggaacauaucauuucgccauuuauaagaaaaauauaggugaacaaccugaagauagacaucuaacaagaaaccuauaugguuuuggucggauacaagauuucgcugaagaacauagaccagaagaauggaaaagauuaguaagagacuuagauuauuuugaaaccggggacaaaccauauauaacccaaacaacaccacacuaccauaucgaaaaagguaaaauagguuuacguuucguaccagaaggccaacaucuuuggccaucaccugaaguuggagcaacaagaacagguagaagcaaauaugcacaagauaaaagauuaacagcugaagcauuccucucaguccacgaacuaaugccaaugauguuuuauuauuucuuguuaagggaaaaauacucagaagaaguuagcgcagaaaaaguacaagguagaauaaaaagagugaucgaggauguauacgcaguauacgaugcuuucgcacguggagaaauagauacuuuagauagauuagaugcaugucuggcagauaaaggaauacggcgaggccaccuaccacgccaaaugauagcgauauuaucgcaagaacauaaagauauggaagaaaaaguucggaagaaacuacaagaaaugauagcagauacagaccauaggcucgauaugcuagauagacaaacagaucgaaaaauuagaauuggucguaaaaacgcaggacuucccaaauccggcguuauagcggauugguuagucagggauaugaugagguuucaacccguagcaaaagauacaucaggaaaaccauuaaauaauucuaaagcaaauagcaccgaauaccgaaugcuccaaagagcauuagcccucuucggaggagaaaaagaaagacuaacaccguauuucagacaaaugaacuuaacaggaggaaauaauccucacccauuccugcacgaaacuagaugggaaucgcacacaaacauccuuaguuucuaccgaagcuacuuaaaagccagaaaagcauuccuacagucaauagguagaagugaccgggaagaaaaucacagauuccuauuguuaaaagaaccaaaaaccgauagacaaacacuggucgccggauggaaaucagaguuccaucugccuagaggcauauuuacagaagcgguacgcgauugcuuaaucgaaaugggguacgaugaagucggaagcuacaaagaagugggauuuauggccaaagcugucccacuauacuucgaaagggcuuguaaagaccguguucagccauucuaugauuacccauuuaauguuggaaauagccuaaaacccaagaaaggaagauuuuuauccaaagagaaaagagccgaagaaugggaaucagguaaagaaagauuucgucucgccaaauugaagaaagaaauccucgaagcuaaagaacacccauauuuagacuuuaaaucauggcaaaaauuugaaagggaauuaagauuaguuaaaaaccaagauauaauaacuuggaugaugugucgagaccuaauggaagaaaacaaaguagaagggcuagacacgggcacuuuauaucuuaaagauauaagaacagaugugcacgaacaaggaaguuuaaacgugcuaaacagaguaaaaccaaugagacucccaguugucguguaucgagcagauagccgaggacauguacacaaagaacaagcaccacuagcaacaguauauauugaagaacgagacaccaaauuauuaaaacaaggaaauuuuaaaaguuucgucaaagauagaagacuuaacggacuauucaguuucguagacaccggagcccuagcaauggagcaauacccuaucagcaaacuucgaguagaauacgaauuagcuaaauaucaaaccgcccgaguuugcgcauuugaacaaacccucgaacuugaagaaucacuauuaacaagauauccacauuuaccugauaaaaauuuuaggaaaauguuagaauccuggucagacccacuacuagauaaauggccugaccuacauaggaaaguaagacugcuaauagcuguaaggaacgccuucucacauaaccaauauccaauguaugacgaagcuguuuucucgucaauaagaaaauacgacccaaguuccccugaugcgaucgaagaaagaaugggccuaaauauagcacaucgccugagugaggaagugaaacaggcuaaagaaauggccgaaagaauaauacaaguauaa

SEQ ID NO: 11910 - RNA, 3528 nt, Artificial Sequence
  Cas13b variant__Porphyromonas gingivalis__EOA10535.1__Cas13b
augacagaacaaaaugaaaaaccauauaaugguaccuacuauacucuagaagauaaacauuucugggcugcauucuucaaccucgcuagacauaacgcauacauaacauuaacacauaucgaccgacaauuagcuuacagcaaagcugacauaacaaacgaugaggauauacuauuuuucaagggucaauggaaaaaucuagauaacgauuuagaaagaaaagcuagacuacggucauuaauacuaaaacacuuuucauuucuagaaggcgccgcauaugguaagaaacucuuugaaagccaaucaucuggaaauaaaaguagcaaaaagaaagaauuaacaaagaaagaaaaagaagaauuacaagcuaacgcguuaucauuagauaaccuaaaaagcauauuauuugauuuucuacaaaaacuuaaagacuuuagaaacuacuauucacacuaccgacauccugaaaguucagaauugccacuauuugauggcaacaugcuccagcgauuauauaauguauucgacguaucaguucaaagaguaaaacgagaucacgaacauaaugauaaaguggauccacauaggcauuuuaaccaccuaguaagaaaagggaagaaagaucgcuguggaaacaaugacaacccauucuuuaaacaucauuucguagauagagaagaaaaaguuacagaagcuggacuccuuuucuuuguuagccuauuuuuagagaaaagagaugcaaucuggaugcaaaagaaaauuagaggauuuaaagguggaacagaaacauaucaacagaugacaaacgaaguauuuuguagauccagaauaucacuuccgaaacuaaaacuugaaagucuacguacagacgacuggaugcuucuagacaugcuuaacgaauuaguuagauguccaaaaucgcuauaugauagacucagagaagaagaccgcgcaagauuucgaguaccaguagauauacucagcgaugaagaugacacagauggaacagaagaagacccuuucaaaaacacucugguucgacaucaagaucguuucccauauuuugcacuaagauauuuugacuugaagaaaguuuuuacaucacuacgcuuccauauagauuuaggaacauaucauuuugcuauauauaagaaaaauaucggagagcaacccgaagauagacauuuaacacgaaaucuuuacgguuuuggucgaauacaggacuuugcagaagaacauagacccgaagaauggaaaagacuuguucgcgaucuagauuauuuugaaaccggagauaaaccauacauuacccaaacaacaccacauuaucauauugaaaaaggaaaaauuggguugagguucguaccggaaggacaacucuuauggccaucaccugaaguuggugcaacaagaacgggucgaaguaaauacgcgcaagauaaaagauuuacagcugaggcuuuucuuucuguacaugaauugaugccaaugauguuuuauuacuuucuauuaagagaaaaauacucagaagaagcaucagcagaaagaguucaaggacgaaucaaaagaguuauagaagacguauaugcugucuaugacgcuuuugccaggggagaaauagacacacuugaucgucuagaugcaugccuagcggauaaaggaauaagaagaggacauuuacccagacaaaugauagcaauauuaucucaagaacauaaagacauggaagaaaaagugaggaagaaacuacaagaaaugauagcagauacagaccauagauuagacaugcuugaucgucaaaccgaucgaaaaauaagaauaggacguaaaaacgccggauuacccaaaucuggcguaauagccgacuggcuaguaagagacaugaugagauuucagccagucgccaaagacacaagugggaaaccacugaacaauucaaaagcaaauaguacugaauaccgaaugcuucaacgagcgcuagcacuuuucggaggagaaaaagaacgacucaccccauauuuuagacaaaugaacuugacuggagggaacaauccacauccuuuucuccacgaaacacggugggagucacacacaaauauauuaaguuuuuauaggucuuauuuaaaagcacgaaaagcauuuuugcaauccauagggagaucugaucgaguugaaaaccacagauuuuuacuucuaaaagaaccaaaaaccgacagacagacguuaguagccgguuggaaaggugaauuucaucuaccaagagggaucuucacagaagcgguccgugauuguuuaauugaaaugggguuagaugaaguaggaagcuacaaagaaguaggauuuauggcuaaagcaguacccuuauauuuugaaagggcuuguaaagacagaguacaaccauucuacgauuauccauuuaacguaggcaacucauuaaaaccaaagaaaggaagauuccuuucaaaagaaaaacgcgcagaagaaugggaaucaggaaaagaaagauucagagaccuagaagcauggucccauucugcagcaagacgaauugaagaugcuuucgcaggaauagaaaacgccagccgagagaauaagaagaaaauagaacaacuucuacaagaccuaucccucugggaaacguucgaaaguaaauuaaaaguaaaagcagauaaaauaaauauagcaaaacuuaagaaagaaauauuagaagcuaaagaacauccauaccuagauuuuaaauccuggcaaaaauucgaaagagagcuaagacucgucaaaaaucaggauauuauaacguggaugauguguagagaucuaauggaagaaaacaaaguagagggccuagauacagguacuuuauauuugaaagacauucgaacagacguccaugaacaagguucacuaaaugucuuaaacagagucaaaccaaugaggcuuccuguagucgucuacagagcugauucccgaggccauguucacaaagaacaagcgccacucgccacaguauauauagaggaaagagauacaaaauuacugaaacaagguaacuuuaagagcuucgugaaagaccggagacuuaauggucucuuuucauuuguagauacaggagcuuuagcaauggaacaauacccaauaucgaaacuacgaguagaauacgaauuagcaaaauaucaaacugcuagagucugugcauucgaacagacauuagaguuagaggaaucacugcuaacaagauauccacacuuaccagauaaaaacuuucgaaaaaugcuugagucauggucagauccauuguuagauaaauggcccgaucuucauggcaauguaaggcuacuaauagcgguaagaaacgcauucucacauaaucaauauccuauguacgaugaaacacucuuuucaagcauuagaaaauaugauccaagcucacccgacgcaauagaagaaagaaugggauuaaacauagcacacagacuuuccgaagaaguaaaacaagcaaaagaaaugguagaaagaauaauacaggcuuag

SEQ ID NO: 11911 - RNA, 3360 nt, Artificial Sequence
  Cas13b variant__Porphyromonas gingivalis__WP_061156470.1__Cas13b
augaccgaacaaaaugaacgacccuacaauggaacuuauuacacccuagaagauaaacacuuuugggcagcauucuucaauuuagcgagacauaaugcuuacauaacuuuaacucauaucgauaggcaauuagcuuauucuaaagcggauauaacaaaugacgaagacauacuauuuuucaaaggacaauggaaaaaucuugacaacgacuuagaaagaaaggccagacuaagaucccuuauauuaaaacauuucucauucuuagagggagcagcauacggaaaaaaacuuuucgaaaauaaaucuucugguaauaaaucaucaaaaaaaaaagaacuaacaaaaaaggaaaaagaagaacuacaagcaaaugcacuaaguuuagauaaucuuaaaucaauacuguuugauuuucuacaaaaacuuaaagacuucagaaauuauuacucacauuacagacaucccgagaguagcgaauuaccuuuauuugacggaaacauguuacaacgcuuauacaacgucuuugacguaucgguccaaaggguaaaaagagaccaugaacacaaugauaaaguagacccacacaggcacuucaaucaucugguacgcaaaggcaaaaaagacagguguggaaauaaugauaauccauuuuuuaaacaccauuuugucgauagggaaggaaaaguaacagaggcuggccuuuuauuuuuuguaagucuauuccuugaaaaacgagaugcaauauggaugcagaaaaaaauaagaggauuuaaaggagguacagaagcauaccaacaaaugacaaaugagguauucugucguucucgaauuucacuuccaaaauuaaaacucgagagccuuagaacagacgauuggaugcuguuagauauguuaaaugaauuagugagaugccccaaaucuuuauaugaccgguuacgagaagaagauagagcgagauuucguguccccguagauauauuaucugaugaagaugacacagacggaacagaagaagacccauucaaaaauacacuaguacgacaucaagacagauuuccguauuuugcacuaagauacuuugaucuaaaaaaaguauuuaccagucuucgauuccauaucgaucuaggaacauaccacuucgcuauuuauaaaaaaaauauaggagaacagccugaagauagacaucuaacaagaaauuuauauggguucggacgaauccaagauuuugcugaagaacaucguccugaagaguggaaaagauuagucagagacuuagacuacuuugaaaccggagacaaaccuuacauaacacaaacaacuccccauuaccauauugagaagggaaaaauagguuuacgauuuguaccggaagggcaacacuuauggcccaguccagaggugggugcaacaagaaccggacgaucaaaauacgcacaggauaaaagacuaaccgccgaggcguuuuuaagcguucaugaauuaaugccaaugauguuuuauuauuuucugcuuagagaaaaauauucagaagagguaagugccgaaaaaguccaagggcgcaucaaaagaguuauagaagauguuuacgcaguauacgacgcauuugcaagaggugagauagacacauuagaucgacuggaugccugccuagcagacaaagguauuagaagaggccauuuaccaagacaaaugauugcuauacucucacaagaacacaaagacauggaagaaaaaguuagaaaaaaacuucaagaaaugauagcugacacagaccauagauuagauauguuagaucgacaaacagacagaaaaauccgaaucggacgcaaaaacgcaggauugccaaaaagugguguaauagcugacuggcuugucagggacaugaugcgauuccaaccagucgcuaaagacacaucaggaaaaccacuuaacaauagcaaagcaaacuccaccgaauaucguaugcugcaaagagcacuagcacuauuuggaggagagaaagaacguuuaaccccauacuuuaggcaaaugaacuuaacagguggaaauaauccccauccauuucuacacgagacaagaugggaaagccauaccaauauccuaaguuucuauagaucuuaucuaaaagcaaggaaagccuuuuuacaaaguauaggaagaucagauagagaagagaaucaucgauucuuacuacuaaaagaaccaaaaacugaucgccaaacauuaguugcgggauggaaaagugaauuucaccucccacgagguauauuuacggaagccguaagagauugcuuaaucgaaaugggauacgaugaaguagguucauauaaagagguaggguucauggcuaaagcaguaccuuuauauuuugaaagagcaugcaaagacagaguacaaccauuuuaugacuaccccuuuaacgugggaaacuccuuaaaacccaaaaaaggcagauuuuuaaguaaagaaaaaagagcagaggaaugggaaucgggaaaagaaagauuuagauuagcaaaacuuaaaaaagaaauacucgaagccaaagagcauccguaucuagacuucaaaaguuggcaaaaauuugaacgagaauuaagacucguuaaaaaccaagauauaaucacuuggaugauguguagggacuuaauggaagaaaauaaaguagaaggucuagauacaggaacacuauaucucaaggacauccgaacagaaguacaagaacaaggcaguuuaaacguuuuaaaccgcguaaaaccuaugcgacuacccguaguaguauauagagcagauagccgugggcauguacauaaagaacaggcuccguuagccaccguauauauagaagagagagauacaaaacugcuaaaacaagggaauuuuaaaagcuucguaaaagacagaagauuaaauggauuauuuaguuuuguugauaccggcggauuagcaauggaacaauaccccauaucaaaguuacgaguggaauacgaauuagcuaaauaccaaacggcgagagucugcgccuuugagcagacacucgaauuagaagaaagccuccuuacacgauguccucaccuaccugauaaaaacuuucgcaaaauguuagaaagcuggucagacccacuacuugacaaauggccagaucuacaaagagaaguauggcuacuuauagccguaagaaaugccuuuagccauaaucaguaucccauguacgacgaagcaguuuuuagcagcauaagaaaauaugacccaucaaguccagaugccauugaagaacgaauggggcuaaacauugcgcacagacuguccgaagaaguaaaacaagcuaaagagauggcagaacguauaauacaagcauaa

SEQ ID NO: 11912 - RNA, 3360 nt, Artificial Sequence
  Cas13b variant__Porphyromonas gingivalis__WP_013816155.1__Cas13b
augaccgaacaaaaugaaaaaccauauaacggaacauacuacacauuagaagacaaacauuucugggcagcuuucuuuaaccuagcaagacacaaugcguacauaacauuagcucauauagaucgccagcuugcauauucuaaggcagacauaacuaaugaugaagauauauuguuuuucaaagggcaauggaaaaauuuagauaaugauuuagaaagaaaagcgagacuaagaaguuugauucuaaaacauuucagcuuuuuagaaggagcugcauacggaaagaaauuauucgaaagccaaucuagugguaacaaauccuccaaaaauaaagaauuaaccaagaaagaaaaagaggaacuacaagcuaaugcucuaucacuagauaaucuaaaaucgauacucuuugacuuuuuacagaaauuaaaagauuuucgaaauuauuauucccacuacagacauccagagagcucagaauuaccacuauuugaugguaauaugcuccaacggcuuuacaacguauucgauguaaguguccaaagaguuaaaagggaucacgaacacaaugacaaaguagauccccauaggcacuucaaccaucuuguaaggaaagguaaaaaggaccguuacggaaauaaugauaacccauuuuucaaacaucauuuugucgauagagaaggaacaguaacagaagcuggacuccuuuucuuuguuagcuuauuccuagaaaaacgcgacgcuaucuggaugcaaaagaaaauaagaggauuuaaaggaggaacagaaacauaccaacaaaugacaaaugaaguauucugcagaucaagaauauccuuaccaaaauuaaaacuugaguccuuacgaaccgacgacuggaugcuacucgacauguuaaaugagcuaguacgaugucccaaaucacuauaugacagauuacgagaagaagacagagcuagauuucgaguaccaguagauauacuuucagaugaagaagacacggauggagcagaagaggaccccuuuaaaaacacuuuaguaagacaucaagacagauuucccuauuuugcacuaagauacuuugaucucaagaaaguauucacaucacuacguuuccaaauagauuuaggcaccuaucacuuugcaauauacaagaaaaauauaggagaacaaccagaagacagacacuuaacacgaaaucuauauggauucggaagaauacaagauuuugcagaagaacacagaccagaagaauggaaaaggcuuguaagagauuuagauuauuucgagacaggggacaaaccuuauaucacucaaacuacaccacauuaucauauagaaaaaggcaaaaucggacuuagauuugucccugaaggacaacaucuauggccgucuccggaaguaggagcaaccaggacagggagaucgaaauaugcccaagacaaacgauucacagcugaagcguuuuuaucagcccacgaacuaaugcccaugauguucuauuacuuuuuacuaagagaaaaauacagugaagaagcaucggcagaaagaguucaaggcagaauuaaaagaguuaucgaagacguauaugcaguauaugaugcauuugcacgagaugaaaucaacacccgcgacgaauuagaugcaugcuuagcagauaaaggcauacgcagagggcauuuaccccgucaaaugauuggaauccucucacaagaacacaaagauauggaagagaaaauaagaaagaaacugcaagaaaugauggcagauaccgaucaucgcuuagauauguuagaccgucaaacugaccguaaaauaagaauagggagaaagaaugcagguuuaccgaaaucaggagucauagcagacugguugguucgagacaugaugcgguuucagccuguagcaaaagauacaagcggaaaaccacuaaacaacucaaaagcaaauucaacggaauauagaaugcuacaaagggcguuagcucuauuuggaggugaaaaagaacgauuaacaccauauuuucgacaaaugaaucuuacaggcggaaauaacccacacccauuucuacaugagacaagaugggaaucccacacgaauaucuugucauucuauagaucauacuuaaaagcuagaaaagcauuccuucaaagcauaggacguucagacaggguagaaaaucaucgauuccuccuguugaaagaaccaaaaaccgacagacaaacauuagucgcuggauggaaaggugaauuucauuuaccaagaggaaucuuuaccgaagcaguuagagauugccuaaucgaaaugggacucgaugaaguggguucuuauaaagaaguugguuuuauggccaaagcgguaccacuauacuucgaaagagcaugcaaagauuggguucaacccuucuauaacuacccauuuaaugucggaaauagccuaaaaccuaagaaaggaagauucuugucuaaagagaaaagagcagaagaaugggaaagcggaaaagagcgauuuagguuggccaaacuuaagaaagaaauucucgaagcaaaagaacacccauauuuagauuuuaaaaguuggcaaaaauuugaaagagaauugagguuaguuaaaaaccaagacauaaucacauggaugauauguggagaccucauggaagagaacaaaguagaaggauuagauacaggaacauuauaccuuaaagacauaagaaccgauguccaggagcaaggaagucuaaauguauuaaaccgaguaaaaccaaugagauuaccaguaguaguauaucgagcugauucaagaggacauguacacaaagaacaagcuccccuagcaacaguauauauagaagaaagagacacgaaauuacuaaaacagggaaauuuuaaaucauucguaaaagacagacguuuaaacggauuauuuucuuuuguugacaccggagcccucgcaauggaacaauauccuauuagcaaacuaagaguagaauacgaacuagccaaauaucaaacagcucgaguuugugcauucgaacagacauuagaacuagaagaaagucuacuaacuagguguccacaucuaccagacaaaaauuuccguaaaaugcuagaaucuuggagugacccgcuacuagauaaguggccagauuuacauagaaaaguaagguuauuaauugccguaagaaaugcauuuucacauaaccaauacccaauguaugaugaagcaguauuuucaucaauuagaaaauacgauccuaguuuccccgaugcaaucgaagaacgaaugggacuaaauauagcucaccgacugucagaagaaguaaaacaagcaaaagaaaccgucgaaagaauaauucaagccuaa

SEQ ID NO: 11913 - RNA, 3528 nt, Artificial Sequence
  Cas13b variant__Porphyromonas gingivalis__WP_005874195.1__Cas13b
augacugaacaaaacgagaagcccuacaaugguacauacuauacacuugaagacaaacauuuuugggcugccuuuuucaacuuagcaagacauaaugccuacauaacucucgcucauaucgacagacaacuugcuuauuccaaagcagauauaacaaacgacgaagauauacuauuuuuuaaaggucaauggaaaaaccuggacaacgauuuggaaagaaaagcuagguuacgaagccuaauccuaaaacauuucagcuuuuuagaaggcgcugcauaugguaaaaaacuauuugaaucacaaucaaguggaaacaaaucaaguaaaaaaaaagaacuuacuaaaaaagaaaaagaggaacuacaagcaaaugcauuaucucucgacaauuugaaaucuauucuauuugacuuccuccaaaaacucaaagauuuuagaaacuacuauagccacuacagacauccggaguccucagaacugccucuguuugacggaaacaugcuacaaagauuauacaauguuuuugacgucaguguccagaggguaaaaagagaccacgaacauaaugacaaagucgauccacauagacacuuuaaccauuuaguacguaaagguaaaaaagauaaauacggaaacaaugauaauccuuucuuuaaacaucauuucguagaccgggaagaaaaaguaacggaagcugguuugcucuucuucguaagucuuuuucuagagaaacgagaugcaauauggaugcagaagaaaauacgaggauuuaaagggggaacagaagcauaccaacaaaugacgaacgaaguauucugcagaaguagaauaagcuuaccgaaacuaaaacuugaaucguugagaacagaugauuggaugcuacuagauaugcuaaacgaauuaguaagauguccaaaaaguuuauaugauagacuccgagaagaagauagggcccgauuuagagugccaguugacauauuaagugacgaagaugacacagacggaacagaagaagauccauucaaaaauacauuagucagacaccaagauagguuuccauauuucgcauuacgguacuuugacuuaaaaaaaguguucacuucacuuagauuucauauagauuuaggaacauaccauuucgcuauuuauaaaaaaaauaucggcgaacaaccugaagaccgacaccugaccagaaaucuuuauggguucggaagaauccaagauuucgcagaagagcacagaccugaagaauggaaaagacuaguucgagaucuagacuacuucgaaacaggugauaaaccauacauuacacaaaccacuccacauuaucauaucgagaaaggaaaaauagguuuacgcuuuguaccugaaggucaauuauuauggccaagcccagaaguuggggcaacuagaacagguagaucuaaauacgcgcaagauaaaagauucacagcggaagcguuucuuuccguacaugaacuaaugccaaugauguuuuacuauuuuuuauugagagaaaaauauagugaagaagcaagugcagagaaaguacaaggaagaauaaaaagaguuauagaagauguauacgcaguauaugacgcauucgcuagagaugaaauaaauacaagagacgaacuugaugcauguuuagccgacaaagggauaagacgaggacauuuaccacgacaaaugaucgccauacuaucccaagaacacaaggauauggaagaaaaaguacgcaaaaaauugcaagaaaugauagcugacacagaccaccgauuagacaugcuagacagacaaacagaucguaaaauaaggauaggcagaaaaaacgcaggacucccaaaaagcggugucauugcggacugguuaguaagagacaugaugagauuucaaccaguugccaaagauacauccggaaaaccacucaauaauaguaaggcaaauucuacagaauauagaaugcuacagcgagcucuagcacuauuugguggagaaaaagagaggcuaacuccauauuuuagacaaaugaaucuaacaggaggaaauaacccacaucccuuuuuacaugaaacuagaugggaaagccacacaaauauuuuauccuucuauagaucauaucuaaaagcaagaaaagcguucuuacaauccauaggaagauccgauagggaagaaaaucauagauucuuauuacuaaaagaaccgaaaacugaccgacaaacgcucguagcgggauggaaaucagaauuucaccuaccgagagggaucuucacagaagcuguaagagauugccuuauagaaaugggauaugaugaaguaggaaguuacaaggaagucggauuuauggcaaaggccgucccuuuauacuuugaaagagcauguaaagacaggguccagccauuuuaugauuauccauuuaauguuggaaacagucuaaagccaaaaaaaggaagauuucuuaguaaggaaaagcgcgcagaagaaugggaaucaggaaaagaacgcuuccgagaucuugaggccuggagucacucagcagcaagaagaauagaagaugccuuuguaggaauagaguaugcaucuugggaaaacaagaaaaaaauagaacagcuauuacaagaucucucauuaugggagaccuucgaaucaaagcuaaaagucaaagccgacaagauaaauauugcaaaacuuaaaaaagaaauacuagaagcaaaagaacauccauaccaugauuucaagaguuggcaaaaguuugaaagggaacuccgauuagugaagaaccaagauauaaucacuuggaugauguguagagauuuaauggaagaaaauaaaguagaaggauuagauacaggaaccuuguauuuaaaagacauacgcacugauguacaagaacaggguagucuaaaugugcuaaaucacguaaaaccaaugaggcucccaguuguaguauacagagcugacuccagaggucauguacauaaagaagaggcaccauuagcaacaguauacaucgaagaacgagauacaaaacuacuaaaacaagggaacuuuaaaagcuuuguaaaagauagaagacuaaacggacuauucaguuucgucgauacaggagcccucgcaauggaacaauacccaaucucaaaacuaagaguugaguaugagcuggcaaaauaccaaacagcuagaguaugugcguuugaacaaacguuagaauuggaagagucacuacuuacacgauauccucaucucccagaugaaucauucagagaaauguuggaaagcuggucagauccauuauuagacaaguggccugaucuacaaagagaagucagacuguuaauagcaguaaggaaugccuuuagccauaaccaauauccuauguacgaugaaacaauauucagcuccauaagaaaauacgauccuagcucauuagacgcaauagaagaaagaaugggacucaauauagcacauagauuaagcgaagaagugaaacuggcaaaagaaaugguugaacgaauaauacaagcuuga

SEQ ID NO: 11914 - RNA, 3360 nt, Artificial Sequence
  Cas13b variant__Porphyromonas gulae__WP_039437199.1__Cas13b
augacagaacaaagcgaaagaccuuauaacggaacauacuauacauuagaagauaaacacuuuugggcugccuuuuuaaaccuugcacgacauaacgcauauauaaccuuaacucacauagacagacaacuagcauauucuaaagcagauauaaccaaugaugaagacauacucuucuucaaagggcaauggaaaaaccuggauaaugaucuagaaagaaaaagccgacuacgaucacuuauacuaaaacacuuuucauuucuagaaggugcagcuuacggaaaaaaauucuuugaaucgaaaucgaguggaaacaaaagcaguaaaaauaaagaauuaaccaaaaaagaaaaagaagaacuccaagcaaaugcauuaucauuagauaaucuuaaaaguauacuguuugacuuucuacaaaaauuaaaagauuucagaaauuacuauucacacuaccgucauucuggaucaucagaacucccauuauuugacgguaauauguuacagcgacucuauaauguauuugacguaaguguacaaagaguaaaacgagaccacgaacacaacgaugagguagacccgcacuaucauuuuaaccacuugguuagaaagggaaaaaaagaucgauauggucacaaugacaauccuucuuucaagcaucauuucguugauggagaaggcaugguuacggaagcaggucuucucuuuuucguuagccuauuuuuagaaaaacgagaugcaauuuggaugcaaaaaaaaauacgagguuucaaaggaggaacagaaccguacgaacaaaugaccaacgaagucuuuugucgcucaaggauaucccuaccaaaacuaaaacuugaaucucuaagaaccgacgacuggaugcuauuagacauguuaaacgagcugguuagauguccaaaaccucucuaugacagauuaagagagaaagacagagccuguuuuaggguaccaguagacauauuacccgacgaggacgacacagacggcggaggugaggauccauucaaaaacacuuugguacgacaccaagacagguuuccuuauuuugcucuacgauacuuugacuugaaaaagguauuuacaagucuuagguuccacauagaucuaggaacauaucauuucgcgauuuauaaaaaaaugauaggagaacaaccagaagaucggcauuuaacacguaaucuauauggguucggucggauacaagauuuugcagaagaacacagaccagaagaauggaagagauuaguuagagacuuagacuauuuugaaacuggagacaaaccauacauaagccaaaccacuccccauuaccauauugaaaaaggaaaaauaggacuaagauuuguaccagaaggucaacauuuauggccaagcccagaaguaggaacaaccagaaccgggagaucuaaauaugcgcaagacaaaagacugacugcugaggcauuucuaagcgugcacgaauuaaugccaaugauguucuauuauuuccuacugcgcgaaaaauauagugaagaaguguccgcagaaaaaguacaagguagaauaaaaagagugauugaagacguauaugccauauaugacgcguucgcuagagacgaaauaaacacauuaaaagaacucgaugcaugucuagccgauaaaggcauacgaagaggacauuuacccaaacaaaugauaggaauuuuaagccaagaaagaaaagauauggaagaaaagguuagaaaaaaauuacaagaaaugauagcagauacagaucauagacucgacauguuagaucgacaaaccgauagaaaaauacgaauaggaagaaaaaaugcuggauuaccaaaaaguggagucaucgcagauuggcuaguaagagauaugaugcgauuccaaccaguagcaaaagacacaucugguaaaccauuaaacaacucaaaagcaaacucaacagaauaucguaugcuccaacgcgcauuggcacuauucggaggagaaaaggaacggcuaaccccauauuuuagacaaaugaaucuuacaggugggaacaauccacauccauuuuuacacgaaacacgcugggaaucccacacaaauaucuuaucauuuuacagaaguuaccuaagagcaaggaaagcauuucucgaaagaauagggagaagcgacagaguagagaauugccccuuuuuacucuuaaaagaaccaaaaacugauagacaaacauuaguagcuggauggaaaggugaauuccacuuaccaagaggcauuuuuacugaagcaguuagagauugucuaauagaaaugggcuacgaugaaguagguucauauagagaaguugguuucauggcaaaagcaguuccccuauauuucgaaagagcuugcgaagauagaguucaaccauuuuacgauucacccuuuaauguuggaaacuccuuaaaaccaaaaaaaggacgguuuuuaucuaaagaaaaaagagcagaagaaugggaaucaggaaaggaacgauuccguuuagccaaacuuaaaaaagaaaucuuagaagcacaagaacacccuuaccaugauuuuaaauccuggcagaaauuugaaagagaacuccgauuaguuaaaaaucaagauauuaucacauggaugauguguagggaccuaauggaagaaaacaaaguagaagguuuggacacuggaacguuauaucuaaaagacauaagaccaaacguccaagaacaaggaagccuaaacguacuaaauaggguaaaaccaaugcgucuccccguuguaguauacagagcagacuccagaggacauguccacaaggaagaagcuccacuagcaaccguuuauauagaagaacgagacaccaagcuauugaaacaagguaacuucaaaucauuuguaaaagaucgaaggcuaaacgggcuauuuucuuuuguugauaccggagcacucgccauggaacaauacccaauaucaaaauuaaggguggaauaugaacuugccaaauaccaaacugcaagaguaugcgcguuugagcaaacauuagaacuugaagaaucacuucuaaccagauacccacacuuaccagaugaaagcuuucgugaaauguuagaaagcuggagugacccacuauugaccaaauggccagaacuacauggaaaaguaagauuauuaauagcaguacgaaaugcuuuuucacauaaucaauauccaauguaugacgaagcaguguuuagcucuauauggaaauaugacccaaguaguccugaugcgauagaagaaagaaugggacuuaauauagcucauagauuaagcgaagaagugaaacaagcaaaggaaacaauugaaagaauaauacaagcauaa

SEQ ID NO: 11915 - RNA, 3360 nt, Artificial Sequence
  Cas13b variant__Porphyromonas gulae__WP_039419792.1__Cas13b
augacugaacaaagugaaagaccuuauaaugguacauacuacacacuagaggauaaacacuuuugggcagccuucuugaacuuagcacgucacaaugcauacauaacauuaacucauaucgauaggcaauuagcuuacagcaaagcagacauaacuaacgaucaagauguacugucuuucaaggcauuauggaaaaacuuggauaaugauuuagaacgaaaauccagacuaagaagccuaauacuuaagcauuuuucuuuccuagaaggagcugcauacgguaagaaauuauuugagaguaaaucuucaggaaauaaaaguaguaaaaauaaagaacucacaaagaaagagaaagaggaacuacaagcaaacgcacuuuccuuagacaauuuaaaaucaauuuuauuugacuuucuacaaaaauuaaaagauuuccgaaauuacuauucccauuauaggcauucagguaguucagaacuuccauuauucgaugggaacauguuacagcgccuauacaauguuuucgacgugagcguacaacgaguuaagcgagaucaugaacacaacgauaaaguugacccacacagacacuuuaaucaucuaguaaggaaaggcaagaaagacagauauggucacaaugacaauccuaguuuuaaacaccauuuuguugacggagaaggaaugguaacagaagcgggucuacuauuuuucgugucucuauuuuuagagaaaagagaugcaauuuggaugcaaaagaaaauaagaggcuucaaaggaggaaccgaaacauaccaacaaaugaccaaugaaguauuuuguagaucaagaauauccuuaccaaaacuaaaacuugaaucuuugagaacugaugauuggauguuacuagacauguuaaacgaauugguacgaugcccuaaaccccuauacgauagacuaagggaaaaagaucgugcccguuucagaguaccaguagacauauuaccugacgaagaugauacagaugguggaggagaagacccauucaaaaauacauugguaagacaucaagauagguucccauacuuugcauuaagauacuuugaucuaaagaaaguauuuacaucucuccgcuuccauauagaccuaggaacauaccauuuugcgauuuauaagaaaguuaucggagaacaaccugaagaucgacaucucacaagaaauuuauacggauucggaagaauccaagacuucgcugaagaacacagaccagaagaauggaaacgucuuguaagagacuuagauuauuuugaaacuggcgacaaaccauauauaagucaaacgacaccacauuaccauauagaaaaaggaaaaauaggucuacgcuuugucccagaaggccaacauuuauggccuaguccagaaguuggaacaacacguacagggagguccaaauacgcacaagacaaacgacuaacagcugaggcauuccuaaguguacacgaacuuaugcccaugauguucuauuauuuccuauugagagagaaauacagcgaagaaguaagcgccgaaaaaguccaaggaagaauuaaaagaguaauagaggaugucuacgcaaucuaugaugcauuugcaagagaugaaauaaacacaagagaugaauuggacgcaugucuagcagauaaaggcaucagaagaggucacuuaccaaaacagaugauagguauauuaagucaagaacacaaaaauauggaagaaaaaguacgaaagaaacuacaagaaaugauagcagauacugaccaccggcuagauaugcucgaccgacaaacugaucgcaaaauacggauaggaaggaaaaacgcgggacugccaaaaucuggaguaaucgcagauugguuaguaagagauaugaugagauuucaaccugucgcuaaagauaccagugguaaaccauuaaacaauucaaaagcuaauaguacagaauauagaaugcugcaaagagcacuggcgcuuuucggaggcgaaaaagaaagacuaacaccauauuucagacaaaugaauuuaacaggcgguaauaacccacacccauuucuggaugaaacacgaugggaaagccacacgaacauuuuaaguuuuuacagaucuuaucuuagagcaagaaaagcauucuuagaaagaauaggcagaucagauagaguggaaaaccgacccuucuuacuacuaaaagaacccaaaacagauagacaaacacucguagcugguuggaaauccgaguuucacuuaccuaggggaaucuucacugaagcagugagggacugucuuauugaaauggguuaugacgaagugggauccuauaaagaagugggcuuuauggcaaaagcuguuccucucuacuuugaaagagcauguaaagacagaguacaaccauuuuaugacucaccauucaaugucgguaauucauuaaaaccaaagaaaggacguuuucuuucaaaagagaaaagagcugaagaaugggaaucaggcaaagaacguuuuagacuggcaaaacuaaagaaagaaauccucgaagcgcaagaacauccauaccacgacuuuaaaaguuggcagaaauuugaaagagaauuacgacucguuaaaaaucaagauauaauaaccuggaugaugugcagagaucuaauggaagaaaacaaaguagagggauuagauaccgggacuuuauaccuaaaggacauaagaccaaacguacaagaacaaggaucacuaaauguauuaaauagaguuaaaccuaugcgacuaccaguugucguauauagggcagauagucguggucaugugcacaaagaagaagcuccauuagcaacagucuauauagaagaaagggauacuaaacuauugaaacaaggaaacuuuaaaaguuuugucaaagauagacgacuuaacggucuauucucauucguugacacaggaggauuagcaauggaacaauacccaaucucuaaacuuagaguagaauacgaacuagcuaaauaucaaacagcacgaguuugcguuuucgaacuaacauuaagacuagaagaaagccuauuaaguagauacccacaucuacccgaugaaaguuuucgagaaaugcuugaaucauggucagaccccuugcucgcaaaauggccagaauuacauggaaaaguaagacuacuuaucgcaguaagaaacgccuuuagccacaaucaauaccccauguaugacgaagccguauuuucaucaauacgaaaauaugaccccagcucuccagaugcaauagaagaacgaaugggguuaaauaucgcacauagauuaucagaagaaguaaaacaagcaaaagaaacaguagaacgaauaauucaagcauga

SEQ ID NO: 11916 - RNA, 3528 nt, Artificial Sequence
  Cas13b variant__Porphyromonas gulae__WP_039431778.1__Cas13b
augaccgaacaaucagaaagacccuauaaugguacauacuauacacuagaggauaaacauuuuugggccgcguuccuaaaccuagcaagacacaaugcuuacauuacacuaacgcauauugauagacaacuagcuuauagcaaagcagacauaacaaaugaccaggauguucuuucuuuuaaggccuuauggaaaaauuuugauaacgaucuagaacgaaaaagucgcuugcgcagcuuaauacuuaaacauuuuagcuuuuuagaaggagcugcauaugggaagaaauuauucgaaucaaaaaguuccggaaacaaaaguaguaaaaauaaagaacuaacaaagaaagaaaaagaagaguuacaagccaaugcacuuagucuagacaauuuaaaaagcauauuauuugacuuuuuacaaaaacuuaaagacuuccgaaauuauuauagucacuauagacacuccgaaucaucagaacuaccauuauucgacggaaauauguuacaaagauuauauaauguauucgacguaucaguacaacggguaaaaagagaucaugaacauaacgauaaaguagacccccauagacacuuuaaccauuuaguacgaaaaggaaagaaagaucgcuacggccauaaugauaaucccaguuuuaaacaucauuuuguagacggugaagguaugguaacugaagcgggauugcuauuuuucguaucuuuauucuuggaaaaacgagaugcaauuuggaugcaaaagaaaauccgcggauucaaaggaggaacagaaacauaccaacaaaugacuaacgagguguuuuguagaagucgaaucucauuaccaaaauuaaaauuagaaucgcucagaaccgaugauuggauguuauuagacaugcuuaacgagcuaguacguuguccuaaaccauuauaugauagacuaagggaggaugauagagcauguuuucgaguaccgguugauauacuacccgaugaagaugauacagacggaggaggagaagacccauuuaaaaacacgcuaguaagacaccaagaucgauuucccuauuucgcacuacgauauuucgauuugaagaaaguauucaccucucuucgauuucauauagauuuaggcacauaucacuucgcuauauacaagaaaaugauaggcgaacaaccggaagauagacaccuaacgagaaacuuauauggcuucggaagaauccaagauuuugcagaggaacacagacccgaagaauggaaaagauuaguacgagauuuagacuacuuugaaacaggcgauaaaccuuauauaucacaaacaucaccucauuaucacauagaaaaaggaaaaauaggccuacguuucaugccagaaggacaacauuuauggccaucgccagaaguaggcacuacucgaaccggaagaucuaaauaugcacaagauaaaagacuaacggcagaagcauuuuuaucuguucacgaauuaaugcccaugauguucuauuacuuuuuauuacgagaaaaauauucagaagaagucucugcugaaaaaguacaaggaagaauaaaacgaguaauugaagauguauaugcaauuuaugaugccuuugcaagagaugaaauaaauacguugaaagaauuagacgcauguuuagcagacaaagguauuagacguggacaucuuccaaaacaaaugauagcaauacucagccaagaacauaaagauauggaagaaaagauacgaaagaaacuacaggaaaugauugcagauacagaccauagacuugauaugcuagauagacagacagacagaaaaauaagaaucggccguaaaaacgccggguugccgaaaaguggugugaucgcagauugguuaguacgagauaugaugcgauuucaaccugucgcaaaagacacaucuggcaaaccauuaaacaacucaaaggcaaauaguacugaauacagaauguuacaacgagccuuagcauuauuuggcggagaaaagaaacgauugacaccguauuucagacaaaugaaucuaacuggagguaacaacccacauccauucuuacaugaaacacgaugggaaucacauaccaacauauuauccuucuaccgaucauacuuacgggcuagaaaggcuuuucuagaaagaauaggcagaucagauagaauggaaaacagaccauuuuuguuacugaaagaaccaaaaacugacagacagacucuuguggcaggguggaaaucagaguuccaucugcccagggguauuuuuacagaagcaguuagggacugcuugauagaaaugggauaugacgaaguaggaucauauagagaaguaggauucauggcuaaagcuguaccuuuauacuucgaaagagcaugugaagauagaguucaaccauucuaugacaguccauuuaacguaggaaauucguuaaaaccaaagaaagggagauuuuugucaaaagaagaacgggccgaagaaugggaaagagggaaagaacgcuuuagggaucucgaagcauggucacauagcgcugccaggagaaucgaagaugcauucgcagguauugaguaugcaagcccagguaauaaaaagaaaauagaacaacuguuaagggaccuaagucuuugggaagcauuugaaucuaaauuaaaagucagagcagauaaaauaaaucuagcuaaacuaaagaaagaaauuuuagaagcacaagaacacccauaucaugacuuuaaaaguuggcaaaaauucgaaagagaauuaagauuaguuaaaaaccaagacauaauaacuuggaugauguguagagaccugauggaggaaaacaaaguagaaggucuagacacaggaacauuauauuuaaaagacauaagacccaauguccaagaacaagguagcuuaaacguacuaaauagagucaaaccaaugcgacuuccaguaguuguauaucgagcagauucccgaggacauguacauaaagaagaggcuccauuagcaacuguauauauagaagaaagagauacuaaacucuuaaaacaagguaacuucaagagcuucguaaaagacagacgucuuaauggcuuauuuucauuuguagauaccggagguuuagcaauggaacaauaccccauuucaaaauuacgcgucgaauaugaauuagcaaaauaucaaaccgcaagaguaugcguauuugaacuaacucuuagacuugaagagagcuuacugacaagauacccccaccuaccagacgaaucuuuuaggaaaaugcucgaaagcuggucagacccauuguuagcaaaauggccagaacuacacgguaaaguacggcuccucauagccguaagaaacgcauucagccauaaucaauauccaauguaugaugaagccgucuuuagcucuaucagaaaauacgauccuucaucgccugacgcuauagaagaaagaaugggcuuaaauaucgcacauagauugagcgaagaagugaaacaagcaaaagaaacaguggaaagaauaauacaaguauaa

SEQ ID NO: 11917 - RNA, 3528 nt, Artificial Sequence
  Cas13b variant__Porphyromonas gulae__WP_046201018.1__Cas13b
augacagaacagagcgaacggccuuacaacggaacuuacuacaccuuggaggacaaacauuuuugggcagccuuuuuaaaucuggcuaggcauaaugcauauauaacucuuacacauauagaucgacaauuagcauacuccaaagcagauauaacaaacgaucaagacguguuaucauuuaaagcacuauggaaaaacuucgacaaugaccuugaaagaaaaucuagacuacgaucacuaauacuaaaacauuucuccuuuuuagagggagcagcauauggaaagaaacuuuucgaaagcaaaucaagcgggaacaaaucaaguaaaaauaaagaauuaacuaaaaaggaaaaggaagaguuacaagcuaacgcauuaucacuugauaaucucaaaucaauccuauucgacuuucuccaaaaacuaaaagacuuccgaaacuauuacucccauuaucgacauucagaaucuagugaauuaccauuauucgauggaaacaugcuacaacgacuauacaacgucuuugacguuagcguccagaggguaaaacgcgaucacgaacacaaugauaaaguagauccgcaucgucacuuuaaccaccugguacgaaaaggaaagaaagacagguacggacauaaugacaacccaaguuuuaaacaucauuucgucgauagcgaggggaugguaacagaggccgguuuacuauuuuucguaagccuauuccucgaaaaacgagacgcaauuuggaugcaaaagaaaauccgaggauuuaaaggaggaacagaaacuuaccaacaaaugacaaaugaaguauucuguagaucgagaauaaguuuaccuaaacuaaaauuagagagcuuaagaacagacgauuggauguuacuagauaugcugaacgaauuaguucgauguccaaaaccuuuguacgauagauuaagagaaaaagaucgagcgagauuucgagucccuguggauauauuaccagacgaagaugauacagacggaggcggugaagacccuuucaaaaacacacucguacgccaucaagauagauuuccauacuuugcacuuagauacuuugacuuaaagaaagucuucacaucauuaagauuucacaucgauuuaggaacauaucauuucgccauauauaagaaaaugauaggagaacaaccagaagacaggcaucuaacccgaaaccuguacggauuuggacgcauacaagauuucgccgaagaacaucgaccugaagaauggaaaagacuuguccgugacuuagacuacuuugaaacaggagacaaaccauauauaucacaaacaaccccacacuaccacaucgaaaaaggcaaaauaggccuccgauuuaugccagaaggccaacaccucuggccgucaccagaaguaggcacuacacgaacaggaagaucaaaauaugcucaagauaaaagauuaacugcagaagccuuuuuaucuguccacgaauuaaugccaaugauguuuuacuacuuucuguuaagagaaaaauauucagaagaaguaucugcugaaaaaguccaaggucgaaucaaacgcguaauugaagacguauacgcuauuuaugacgccuucgcaagagacgaaauaaauacauuaaaagaauuggacgcaugccuagcagauaaaggaauuagacgaggacauuuaccuaaacaaaugauugcaauccuuucacaagaacauaaagacauggaagagaaaaucagaaagaaauuacaagaaaugauagccgauacugaucauagguuagauaugcuagaccgacaaacagauaggaaaaucagaauuggaaggaaaaacgcaggauuaccaaaaucaggcguaauagccgauugguuaguaagagauaugaugagauuccaacccguagcaaaagauacaagcggaaaaccuuuaaauaauucaaaagcaaacuccacugaauauagaaugcuacaaagagccuuagcacuauucggaggagaaaagaaacgacuaacuccauauuuccgccaaaugaaccuaacgggaggaaauaauccacauccauucuuacaugaaacaagaugggaaucgcacacuaacauauuguccuuuuauagaucauaucuuagagcuagaaaagccuucuuagaaaggauaggaagaagugauagaauggaaaaccgaccauucuuguuauuaaaagaaccaaaaacagacagacaaacauuaguagcggguuggaaauccgaauuucauuuaccacgagguauauuuacagaggcggugagagauugcuuaaucgaaaugggauacgacgaaguagguagcuaccgcgaaguagguuucauggcaaaagccguaccacuauauuucgaacgcgcaugugaagauagaguacaaccauuuuacgacagucccuucaacguuggaaacaguuuaaaaccaaagaaaggaagauucuuaagcaaagaagaaagagcagaagaaugggaacguggcaaagaaagauuucgcgacuuagaggcauggucacacuccgcagcaagaagaauagaagaugcauuugcagguauugaguacgcaagcccagguaacaaaaagaaaauagaacaacuauuaagagaucugucacuuugggaagcauuugaaagcaaacuuaaaguacgagcagauaaaauaaacuuagccaaauuaaagaaagaaauauuagaagcgcaggaacaccccuaccaugacuuuaaaagcuggcaaaaauucgaaagggaauuaagauugguuaaaaaccaggauauaauuacuuggaugaugugucgcgauuuaauggaagaaaacaaaguagaaggacuagauaccggaacacuuuaucugaaagacauuagaccuaauguacaagaacaagguuccuuaaauguguugaaccgaguaaaaccaaugagacuuccagucguaguauaccgagcugacucaagggggcacguacacaaagaagaagcuccacuagcuacagucuacauagaggaacgagacacaaaauuacuaaaacaaggcaauuuuaagagcuucgucaaagacagaagacucaacggacuuuucagcuucguagauacuggaggucucgcaauggaacaauacccaauaucaaaauuaagagucgaauaugagcuagcaaaauaccaaacagcacguguauguguauuugaauuaacauuaagacucgaagagucauuacuaaccagauauccacaucuuccugacgagagcuucagaaaaauguuagaaucauggucagacccacuccucgcuaaguggccugaacuacaugguaaagugagauuacuaaucgcuguucgcaaugcuuucagucacaaccaauauccaauguacgacgaagcagucuucaguucaauacguaaauacgauccaucuaguccugacgcuaucgaagaaaggauggguuuaaauauugcacauagacuuucugaagaagucaaacaagcaaaagaaacaguugaacguaucauacaaguauaa

SEQ ID NO: 11918 - RNA, 3525 nt, Artificial Sequence
  Cas13b variant__Porphyromonas gulae__WP_039442171.1__Cas13b
augacugaacaaucagaaagaccuuacaacggaacguacuauacacuagaggacaaacacuucugggcugcguuuuuaaauuuagcaagacauaaugcauauaucacccucacgcauauugaccgucaacucgccuacaguaaagcagauauuacuaaugaucaggacguguuaucguuuaaggcucucuggaaaaaccuagacaacgauuuagaacgaaaaaguagacuucgaucacuuauacuaaaacauuuuagcuuucuagaaggugcagccuacggcaagaaauuauucgaaaguaagucgucagguaacaaauccagcaaaaacaaagaacuaacuaagaaagaaaaagaagaauugcaagcuaacgcacuuaguuuagauaacuuaaaaagcauacuauuugacuuuuuacaaaaauuaaaagauuuuagaaacuacuacagccacuauagacauucuggcucaucugaacuacccuuguuugaugggaauauguuacagcgccuauacaacguuuuugauguaucaguacaaagaguuaaacgagaccacgagcauaacgacaaagucgacccucauuaucauuuuaaucauuuaguaagaaaaggcaagaaagacagauacggacacaaugauaauccuaguuuuaaacaucacuuuguagauucagaaggaaugguaacugaagcgggccuguuauucuuuguaagccuuuuccuagaaaaacgggaugcaauuuggaugcaaaagaaaauaagaggauuuaaagggggaacuggaccuuaugaacaaaugacaaacgaaguauuuuguagauccagaauaucacuaccaaaacuaaaauuagaaagccuaagaaccgacgauuggaugcuacuagacaugcuuaaugaauuaguuagauguccgaaaccuuuauaugaccgauuaagagagaaagacagagccuguuuuagaguaccaguagauauuuuaccugacgaagacgacacugaugguggaggagaagacccauuuaaaaacacccuaguuagacaucaagaccgcuucccuuauuuugcacuacgcuacuuugauuuaaagaaaguauuuacaucccuaagauuucacaucgaucuagguacauaucauuucgcgauauauaagaaaaugauuggcgagcaaccagaggacagacauuuaacaagaaaucuauacggauucggcaggauucaagacuucgccgaagaacacagacccgaagaauggaaaagauuagucagagauuuggacuacuuggaaacaggagacaaaccauauaucucacaaacuacgccacauuaucauaucgaaaaaggcaaaaucggacucagauuuguaccagaagggcaacaccuuuggccaucuccugaaguaggaacaacaagaaccgguagaucaaaaugugcucaagacaaaagauuaacagcagaagcauuuuugaguguucaugaacugaugccgaugauguuuuacuauuuccuauuaagagaaaaauacagcgaagaagugagcgcagaaaaaguucagggacguauaaaacgaguaauugaagauguuuacgcaauauacgaugccuuugcgcgagacgaaauuaauacgcuaaaagaacuagacacaugcuuggccgauaaaggaauuagaagaggucauuuaccaaaacagaugauaacuauuuugucucaagaaagaaaagauaugaaagagaaaauacggaagaaacuacaagaaaugauugcagauacggaucacagacuagauauguuagacagacaaacagauagaaaaaucagaauuggacgcaaaaaugccggauuaccaaaaucaggaguaauugccgauuggcuaguaagagauaugaugagauuucaaccagucgccaaagaugcgucaggaaaaccacuaaacaacucaaaagcaaauagcacagaauacagaaugcuacaaagagccuuagcauuauuuggaggugaaaaagaaagacugacuccauacuuuaggcaaaugaauuuaaccggugguaauaauccucauccauucuuacacgaaacuaggugggaaucacauacuaauauauuaucauucuacagaaguuaccuaagagcaagaaaagccuuucuugaaagaauuggccguagcgauagaguagaaaacuguccauuccuacuacuaaaagaaccaaaaacagacagacaaacacucguagccggauggaaagacgaauuucaucucccacgcggaauauucacugaagcugucagagauugcuuaauagaaauggguuaugacgaaguuggaucauaucgugaaguuggcuuuauggcaaaagcaguaccacuuuacuucgaacgagcaugugaagauagaguacaaccuuuuuaugacucacccuuuaacgugggcaacucacuuaagccaaagaaaggcagauucuuaucaaaagaggacagggcagaagaaugggaaagaggcauggaacgcuuucgagauuuagaagcguggucacauucagcagcgagaagaauaaaagaugcguucgcuggaauagaauacgcaaguccagguaacaaaaagaaaauagaacaacuauuacgagaccuaucccuaugggaagcguuugaaagcaaauuaaaaguacgcgcugauaaaauaaaucuagccaaacugaagaaagaaauacuagaagcccaagaacacccguaucacgacuucaaaucuuggcaaaaauucgaaagagaauuaagauuagucaaaaaucaagauauaauaacuuggaugauguguagagaccucauggaagaaaauaaaguagaagguuuagauacaggaacuuuauaccucaaagacauccgcccaaauguacaagagcaaggaucguuaaauguauuaaaucgaguaaaaccaaugcgacuuccugucguaguuuauagagcagauagcagaggacacguccauaaagaagcacccuuagcuacuguauauaucgaagaacguaauaccaaauuacuaaaacaaggcaauuucaaaaguuucguaaaagaccgacgacuaaauggauuauuuaguuuuguagauacugggggauuagcuauggaacaguacccaaucuccaaauuaagaguagaguaugaacuagcaaaauaccaaacagccagaguaugcguuuucgaauuaacauuaagguuagaagagucuuuacugagcagauauccccaucucccagacgaaaguuuccgcgagaugcuagaaucauggucagauccauuacuagcuaaauggccagaauuacacggaaaaguuagacuacuaauagcaguuagaaacgcuuuuucacacaaucaauauccaauguacgaugaagcuguauucaguuccauacguaaguaugauccgaguuccccugacgcgauagaagaaagaaugggacuaaauaucgcucaccgguuaagugaagaaguuaaacaagccaaagaaacaguugagagaauuauacaagcauaa

SEQ ID NO: 11919 - RNA, 3360 nt, Artificial Sequence
  Cas13b variant__Porphyromonas gulae__WP_039426176.1__Cas13b
augaccgaacagagugaaagaccuuacaauggcacauacuacacacuagaagacaaacacuuuugggcagcauuucuuaauuuggcccgacacaacgcauauauuacauuaacacacauagaccgucaacuagcauauucuaaagcagacauuacaaacgaccaagacguacuaucauucaaagcgcuuuggaaaaauuucgacaacgaccuagaacggaaaaguagauuaagaagucuuauacuaaaacauuucucuuucuuagaaggagcagcauaugggaaaaaguuauuugaaucaaaaucgucaggaaauaaaagcuccaaaaauaaggaacuaacuaagaaagaaaaagaggaacuucaagcaaacgccuugucccuagauaaucuuaagucaauauuauuugacuuccuacaaaaauuaaaagacuuuagaaacuauuauucccauuaucgacauucuggaagcuccgaauuaccucuauuugauggcaauaugcuacaacggcuuuacaacguauucgacguaagcguacaacgugucaaaagagaccacgaacauaaugauaaagucgauccacauuaccauuucaaucacuuaguacgaaagggaaagaaagacagguacggccauaacgauaacccuaguuuuaaacaucauuucguagacucagagggcauggucacagaagcgggcuuacuauucuucguaucacuuuucuuagagaaaagagaugcaauauggaugcagaagaaaauaagaggcuucaaagguggaacaggaccauaugaacaaaugacaaaugaagucuucugucgcagccguaucucgcuaccuaaauugaaacuagaaagucuacguacagaugacuggaugcuucuugauaugcuaaacgagcuaguucguugucccaaaccauuauacgauagacuccgugaaaaagacagagcauguuuuagaguucccgucgacauacucccagacgaagacgacacagacggcgguggagaagauccauuuaaaaauacccuuguaagacaccaagaccgauuuccauauuuugcuuuaagguauuucgaucuaaagaaaguauucacuucacuaagauuucacauugacuuaggaacauaucacuuugcgauauauaagaaaaugauuggcgaacaaccugaagacagacaucuuaccagaaaucuuuacggcuucggaaggauacaagauuuugccgaagaacauagaccagaagaauggaaaagacuuguacgagaucuagauuauuucgaaacaggcgauaaaccauauauuagucagacaacaccccacuaucauaucgaaaaaggcaaaauaggcuuacguuuuaugcccgaaggacaacaucuauggccaucuccugaaguaggaacaacuagaacaggaagaagcaaauacgcacaagacaaaagacuuacagcagaagcguuuuuaucugugcaugaauuaaugccaaugauguucuauuacuuucuuuuacgugaaaaauauuccgaagaaguaucugccgaaaaaguacaaggaagaauaaaaaggguaauaaaagacguuuaugcaauauacgacgcauucgccagggaugaaauaaauacacuuaaagaauuagacgcauguucugccgauaaaggaauaagaagaggucaucuacccaaacaaaugauagguauacuaucgcaagaacacaaaaacauggaagaaaaaguaagaaagaaacuucaagaaaugauugcagacacggaucaucgucuagacaugcuagacagacaaacagaucguaaaauuagaauaggaagaaagaaugcaggacuaccuaaaaguggaguaauagcagauugguuaguacgagauaugaugagauuccaaccaguagccaaagacacaucggguaaaccuuuaaauaauucuaaagcuaacaguacugaauauagaauguuacagcgagcuuuagcuuuauuuggaggagaaaaagaaagacuaacaccuuacuuucgucaaaugaaucuaacaggcggaaauaauccacacccuuucuuagaugaaacaagaugggaaagucacacaaauauucuaucguuuuacagaagcuacuuaagagcaagaaaggcauuuuuggagagaauaggaagaagugacagaguagaaaacagaccauuuuuacuacuaaaagaacccaaaaaugaucgacaaacccuaguugcagguuggaagagugaauuucaccuacccagaggaaucuuuacugaggccguaagagacugccucauugaaauggguuaugaugaagucggaaguuauaaagaaguaggauucauggcgaaagcugucccauuauauuucgaaagagcuuguaaagacagaguacagccauucuaugauucucccuuuaacguaggaaauagccuaaaaccaaagaaaggaagguuccucaguaaagaaaaacgagcagaagaaugggaaucaggaaaagaaagauuuagacuagcaaaacuaaagaaagaaauacuagaggcaaaagaacauccuuaccacgacuuuaaaucauggcaaaaauucgaaagggaacucagacucgucaaaaaccaagauauaauuacauggaugaugugccgugaccuuauggaagagaauaaaguagaaggacuagauacagggacgcucuaccuaaaagacauaaggaccgacguacaugagcaagguagcuuaaacguguuaaacagaguaaaaccaaugagguuaccaguaguaguauauagagcagacucaagaggucacguucacaaagagcaagcaccacuagcaacuguuuacauugaagaacgagacacaaaauuauugaaacaaggaaauuucaaaucuuucgugaaagacagacgucucaauggauuauuuagcuuuguugacacaggaggucuagcaauggaacaguauccuauaagcaaauuaagaguugaauacgaacuugcgaaauaccaaacagccagaguaugcgccuucgaacaaacuuuagaacuagaagaaucgcuacuaacgagauauccacaccuaccagacgaaaauuucagagaaauguuagaaagcuggagugauccucucuuagggaaauggccugacuuacacggaaaaguaagacucuuaauagcgguacgaaaugcauucucucacaaucaauauccaauguaugacgaagcaguuuuuaguucaauaagaaaauaugacccuuccucaccggacgcaauagaagaaagaaugggauuaaacauagcacauagguugagcgaagaaguaaaacaagcaaaagagacuguagaacgaauaauucaagcguga

SEQ ID NO: 11920 - RNA, 3528 nt, Artificial Sequence
  Cas13b variant__Porphyromonas gulae__WP_039418912.1__Cas13b
augacggaacaauccgaaagaccuuauaaugggacauacuacacauuagaggacaaacacuucugggcagccuucuuaaacuuggcacgccacaaugcuuauauaacucuaacacacauugaccgccaacuugcauauagcaaagcagauaucacaaaugaccaagauguauuaucauucaaagcucuguggaaaaaucuggauaaugaccuugaacgaaaaucacgguuaagaucacugauucuaaaacacuucucauuccuugaaggagcagcuuacggaaagaaauuauuugaaaguaaaaguuccggaaauaaaucaaguaaaaauaaagaacuaacaaagaaagaaaaagaggaauuacaagccaacgcucucucacuagacaaccuaaaaucaauccucuuugacuuuuuacaaaaacuuaaagacuuucguaacuacuauucacacuauagacauucaggaucaucagaauuaccucuauuugacggcaauauguuacaaagacuauauaacguguuugauguaaguguccaacgaguaaaaagggaucacgaacauaacgacaaaguagacccacacagacauuuuaaucaccuaguuagaaagggcaagaaagacagauacggccacaaugauaacccauccuucaaacaucacuuuguagacucagaaggcaugguaacagaagcuggacuuuuauuuuucgugaguuuauuccuagagaaaagggaugcaaucuggaugcaaaagaaaauucgaggguucaaaggagguacggaaacauaucaacaaaugaccaaugaaguauuuugucguucaagaauaucauuaccaaaauuaaaauuagagucgcuuagaauggacgacuggauguuauuagauauguuaaacgaauuaguaagguguccuaaaccuuuauacgaccgguuaagagaagaugacagggcuuguuuccgaguaccaguagacaucuuaccagaugaagacgauacugacggcggaggggaagacccuuucaaaaacacauuaguaagacaucaagacagguucccauauuuugcuuuaagauacuuugaccuaaagaaaguauuuacaaguuuaagauuucauauugauuuagguacauaucacuuugcaauuuauaaaaagaugauaggagaacaaccagaagaucgccaccuaacuagaaauuuauacggauucggacgaauacaagauuuugcugaagaacauagaccagaggaauggaaaagacucgucagagaucuagacuacuuugaaacaggagauaaaccauacauuucccagacaaguccucacuaucacauagaaaaaggaaaaauaggauuacgauucaugccugaaggccagcacuuauggccauccccugaaguagguacuacaagaacagggcgaucuaaauacgcacaagacaaacgccuaacagccgaagcauuuuuaucuguacaugaacuuaugccuaugauguucuacuacuuuuuauuacgcgaaaaauauagugaagaaguaucugccgaaaagguacagggccgaauaaaaagaguaauagaagacguauaugcuauauaugacgcuuucgcgcgagaugaaauuaauacacuaaaagaauuagacgcgugucuagcagauaaagguauucgaagaggacaccuaccuaaacaaaugaucgccauacucagccaagaacauaaaaauauggaagaaaaaguaagaaagaaacuccaagaaaugauagcugacacagaccauagauuagauaugcucgacagacaaacagacagaaaaauacgaauaggaaggaaaaaugcagguuuaccaaaauccggaguaauagcggacuggcuaguaagagacaugaugagauuccaaccuguugccaaggaugcuaguggaaaaccauuaaacaacaguaaagcaaauucaacagaauaucgaaugcuacaacgcgcucuagcauuauuugguggagaaaaagaacgauuaacuccauauuuccgacagaugaaccuaacaggaggaaacaacccacaucccuuucuacaugacacacgaugggaaagccauacaaauauacuaaguuuuuauagaucauacuuacgagcaaggaaggcuuuucuagaaagaauaggaaggucagauagaauggaaaaucgaccauuucuauuauuaaaagaacccaaaacugauaggcaaaccuuagucgcaggauggaaaucugaauuucaucuaccuagaggaauauucacagaagccguaagagauugccuaauugaaaugggcuacgacgaagucggaucauacagagaaguuggauucauggccaaagcaguuccccuauacuuugaaagagcaugugaagauagaguacaaccauuuuacgauucacccuucaacguagguaauagcuuaaaaccaaagaaaggaagauucuuaagcaaagaagaaagagcugaagaaugggaaagaggaaaagaacgguuuagagaccuagaagcauggucucauagugcggcaaggcgaauagaagaugcguucgcuggaauagaauaugccucgccaggaaacaaaaagaaaaucgaacaacuacuaagagauuuaucacuaugggaggccuuugaaagcaaauuaaaagugcgagcagacaaaauaaacuuagcaaaauuaaagaaagaaauacuagaagcacaagaacauccauaccaugacuucaaaucauggcaaaaauucgaaagagaauuacgacucguuaaaaaccaagauauaauuacauggaugauguguagagaccuaauggaggagaacaaaguagaaggccuagauaccgggacuuuauauuuaaaagauauacguacaaauguacaagaacaaggaucuuuaaacguauuaaaucacgugaaaccuaugagauugccuguaguuguuuaccgagccgauucaagaggacauguacacaaagaagaagccccacuggcuacaguauacauagaagaaagagauaccaaacuauuaaaacagggaaacuucaaaucauuugucaaagaucgcagguuaaauggacuauucucauuuguagacaccggcggguuagcuauggagcaauacccaauaucaaaauuaagaguagaauacgaguuagccaaauaccaaacggcccggguaugugcauuugaacaaacuuuagaacuagaagaaaguuuauuaacaagauauccacaucuuccagacaaaaauuucagaaaaauguuagaauccuggagcgauccacuacuugcaaaauggccagaacuucauggaaaaguacguuuguuaaucgcaguacguaaugcuuucucccauaaccaauacccaauguaugaugaagccguauucaguagcaucagaaaauacgacccauccucaccagacgccauugaagaacgaaugggguuaaauauagcacauagacuguccgaagaaguaaaacaagccaaagagacaguagagcgaauuauccaggcuuaa

SEQ ID NO: 11921 - RNA, 3528 nt, Artificial Sequence
  Cas13b variant__Porphyromonas gulae__WP_039434803.1__Cas13b
augacagaacaaucagaaagaccuuacaacggaacguauuauacauuggaagacaaacacuuuugggcagcauuccuuaaucuagcuagacacaaugcauauauaacguuaacccacauagauaggcaguuggccuauucuaaagcggauauaacaaacgaccaagaugucuuauccuuuaaagcacuuuggaaaaacuucgauaacgauuuagaaagaaagucuagacucaggucacugauccuaaaacacuucuccuuuuuggaaggagccgccuauggcaaaaagcuauuugaaagcaagagcucuggaaauaaaaguaguaagaauaaagaacuaacaaagaaagaaaaagaggaauuacaagcaaacgcgcucucgcuagauaauuuaaaaucaauauuauuugacuuuuuacaaaaacuaaaagauuucagaaauuauuacucacauuauagacacaguggaaguagcgaacucccauuauuugauggaaauaugcuacagagacuauacaacguauucgaugucucaguacaacgagucaaaauugaccacgaacauaaugaugaaguagauccacacuaccauuuuaaccaccuaguaagaaaaggaaagaaagauagauauggacauaacgauaacccaucauuuaaacaucacuuuguagacggagaagggaugguaacagaagccgguuuacuauucuuugucagcuuauuuuuagagaaaagagaugcuauauggaugcagaagaaaaucaggggauucaaaggaggaacagaaacauaccaacaaaugacuaaugaagucuuuugcagaucaagaauuucauugccuaaauuaaaauuagaaucauugaggauggaugauuggaugcuuuuagacaugcucaaugagcuaguuagauguccaaaaccauuauacgaccgacuucgcgaagaugauagggcaugcuuuagaguaccaguugauauauuaccagaugaagacgacacagacggaggaggcgaagauccuuuuaaaaacacauuaguacgacaccaggaucgauucccuuauuuugcucuacgcuauuuugaucuaaagaaaguuuuuacgagcuuaagguuucauaucgaucuuggaacuuaucauuuugcaaucuauaagaaaaugauuggagaacaaccagaagacaggcacuuaacaagaaacuuauauggauuuggacgcauucaagauuucgcagaagaacacagaccagaagaauggaaacgccuaguuagagaucuugacuacuuugaaacaggagauaaaccauacauaagucaaacauccccacauuaucauaucgaaaaaggaaaaauaggauuaagauuuaugccagaaggacaacacuuauggccauccccagaaguaggaacaacaagaacaggcagaucaaaauaugcacaagauaaaagacuaacagcggaagccuuuuuaucgguacacgaacuuaugccuaugauguucuauuauuuucuacuucgcgaaaaauauagcgaagaaguaagugcugaaagaguacaaggaagaauaaaaaggguaauugaagauguuuacgcuguuuaugaugcauuugcaagggacgagauaaacacccgagaugaauuagacgcaugcuuagcugacaaagguauacgacgaggacacuuacccaggcaaaugauagcgauacuaucacaagaacauaaagauauggaagagaaaauaagaaagaaacuacaagaaaugauggccgacacggaccacagacuagacaugcuugaucgacaaacugaccguaaaaucagaaucggacgcaaaaacgcaggacucccuaaaucaggggucauugcagacugguuaguaagagacaugaugagauuccaaccaguagcaaaagaugcaaguggaaaaccgcugaacaacucaaaagcaaacagcacagaauacagaauguuacaaagagcgcuagcacuauucgguggugaaaaagaacguuuaacaccauacuucagacaaaugaaccuaacgggaggcaacaauccacacccauuuuuacaugaaacaagaugggaaagucacacaaauauacuaucauuuuauagaagcuaucuaagagcaaggaaggcuuuccuugaacgcauuggucgcucagacagagucgaaaaucgaccauuucuucugcuuaaagagccaaaaacagacagacaaacacucguggcgggguggaaaggagaguuccauuuaccacgaggaaucuucacggaagccgucagggauuguuuaaucgaaaugggucaugaugaaguugcaucauauaaagaaguuggauucauggcaaaagcaguaccuuuguacuuugaaagagcaugcgaagaucggguacaacccuucuaugauaguccauucaauguaggaaauucacuaaaaccaaagaaaggaagauucuuaucuaaagaagaacgugcagaagaaugggaaagggguaaagaaagguuucgcgauuuggaggcuuggagcuauucugcagcacgcagaauugaggaugcauuugcagguauugaauaugccagcccaggaaauaaaaagaaaauugaacaauuacucagggauuuaagccuaugggaagcauuugaauccaaacuaaaaguaagggcggaucguauuaaccuggcaaaacuaaagaaagaaauauuagaagcacaagaacauccguaccacgacuuuaaauccuggcaaaaauuugagagagaacuacguuuagugaaaaaccaagacauaauaacuuggaugaugugcagagauuuaauggaagagaauaaaguagaagguuuagauacagguacguuauauuuaaaagacauaagaccgaacguacaggaacaaggaucuuuaaauguccuaaauagaguaaaaccaaugagauuacccguaguggucuauagagcagacuccaggggacacguucauaaagaagaagcacccuuggcuacugucuauauugaagaaagagacacaaaacuuuuaaaacaaggaaacuuuaaaaguuucguuaaagaccgccgauuaaauggucuauuuaguuuuguagauacaggugguuuagcuauggaacaguacccgauaagcaaauuaagagucgaauacgaacuagcuaaauaucaaaccgcaagaguauguguauucgaacuaacauuacgacucgaagaaucucucuuaacuagauacccacacuuaccagacgagagcuuuagagaaaugcuugaaaguuggucugacccacuauuggcaaaauggcccgaacuacauggaaaaguaagauuauuaauagcaguacgaaaugcauucagucauaaucaauauccuauguaugacgaagcaguuuucucaucuauacguaaauaugauccuucaaguccagaugcaauagaagaaagaauggguuuaaauauugcacaucgguugagcgaagaaguaaagcaagcuaaagaaacaguggaaagaaucauacaagcauag

SEQ ID NO: 11922 - RNA, 3528 nt, Artificial Sequence
  Cas13b variant__Porphyromonas sp.__WP_039428968.1__Cas13b
augacagaacaaucugaaaggccauauaauggaacguauuauacacuagaagauaaacauuuuugggcagcauuucuaaauuuggcgaggcacaaugcauacaucacacuaacucauauagaucgacaauuagcauacucaaaagcagacauaacaaacgaccaggauguacuauccuuuaaggcacucuggaaaaauuuugacaacgaucuagaaaggaaaucaagauuaagaucauuaauccuaaaacauuuuagcuuuuuggaaggcgcagcauacggaaagaaauuauucgaaaguaaaaguaguggaaauaaaucaaguaaaaacaaagaacuaacuaagaaagaaaaagaagaacuacaagcuaaugcauuaucuuuagauaaucuuaaaagcauacuuuuugacuuuuugcaaaaauuaaaagauuucagaaacuauuacucacacuacagacauucagagagcagcgaauuaccauuauuugauggaaauaugcuacaacgauuauacaauguauuugauguaucaguacaacgaguuaaaagagaucacgaacacaacgauaaagucgacccacauaggcauuuuaaccaucuuguccguaaagggaagaaagacagauauggacauaaugauaauccuucauuuaaacaccauuuuguggacucggaaggaaugguuacagaagccggacucuuauuuuucguaagccuauuuuuagagaaaagagaugcaauuuggaugcagaaaaagauuagagguuuuaaagguggaacagaaacauaucaacaaaugaccaacgaagucuuuugccguaguagaauaaguuuaccaaaauuaaaacuagaaucacuuaggacagaugauuggauguugcuagauaugcucaacgaacuuguaagauguccaaaaccauuauaugauagguuaagagaagacgaccgcgcgugcuuuagaguacccguagauauauuaccggaugaagaugauacagauggaggaggagaagauccuuuuaaaaauacauuaguuagacaucaagauagguuuccuuauuucgcgcuaagauacuuugauuuaaagaaagucuuuacaagucugcguuuccacauagaucuagguacauaccacuucgcaauauauaagaaaaugauaggugagcaaccagaagaucgacaucucacccguaaucuauauggauuuggccggauucaagacuuugcagaagaacauagacccgaagaguggaaacgucuaguuagagaccucgacuauuuugaaacgggagacaaaccauacauaagccaaacaacaccucacuaccauauagaaaaagggaaaauaggauuaagauuuguaccagaaggucaacaccuauggccaucaccggaagucggaacaacaagaacuggacggagcaaauacgcacaggacaaaagauuaacugcagaggcauuccuaucaguacacgaguuaaugccuaugauguuuuauuauuuccucuugcgggaaaaauacucagaggaaguuagcgcagaaaaaguacaaggccguaucaaaaggguaaucgaagacgucuaugcaauauaugaugcauucgcacgugaugaaauuaacacacuaaaagaacucgaugcgugucuagcugauaaagguauucgaagaggacacuuaccaaaacaaaugaucggaaucuugagucaggaacgcaaagauauggaagaaaaaguaagaaagaaacuccaagagaugauagccgacacagaccacagacuagacauguuagaccgacaaacggacagaaaaauaaggauaggaaggaaaaacgcaggacuaccuaaauccggaguuauugcagauuggcuuguacgcgacaugaugcgauuucaacccguagccaaagauacaucaggaaagccacuaaauaacucgaaagcuaauaguacagaauauagaauguugcagagggcauuagcauuguuugguggcgaaaaagaacguuugaccccguauuuuagacagaugaaucucacaggaggaaauaacccucauccuuuucuucaugaaacaagaugggaaucacauacgaauauauugaguuucuauagaucauaccuccgugcuagaaaggcuuuccuugaaaggauaggaagaagcgauagaguagaaaacugcccauuucuucuuuuaaaagaacccaaaacugauagacaaacauuagucgcaggguggaaaggugaauuucacuuaccaaggggcauuuuuacagaagcaguaagagacugccuaauagaaauggguuacgaugaaguaggcagcuaucgagaaguuggcuucauggcuaaagcgguaccauuauauuuugaaagagcaugcgaagaccgaguacagccguucuacgauaguccauuuaauguaggaaacaguuuaaaaccgaagaaagguagauuccuauccaaagaagauagagcagaagaaugggaaagagguaaagaaagauuucgagauuuggaggcuuggucacacucggccgcacgaagaauaaaagacgcuuucgcagguaucgaauaugcgucacccgggaauaaaaagaaaauagaacaguuauuaagagaccuaucauuaugggaggcuuuugaaagcaaacuaaaagugagagcagacaaaauaaauuuggcuaaacuuaagaaagaaauauuggaagcacaagaacacccauaucaugauuucaaaaguuggcaaaaauuugaaagagaacucagauuagugaaaaaucaagauauaauaaccuggaugaugugccgcgaucuuauggaagagaauaaaguagaaggacuagacaccggcacacuuuacuuaaaagacauuagaccaaacguacaagaacaagggagccuaaauguauuaaauagaguaaaaccaaugagacuaccaguaguaguauacagagcugauucacguggacauguacacaaagaagaagcaccauuggcaacgguauauauugaagaacgagacacaaaauuacuaaaacaaggaaacuuuaaaaguuucguaaaagacaggagacuaaaugguuuauuuagcuucguagacacaggaggacuagcaauggaacaauauccgauauccaaauuaagaguugaauaugaacuagcuaaguaucaaacagcacgagucugcguuuucgaauugacguuacgacuugaagaaagucucuuaucaagauauccacaucucccugaugaaaguuuucgcgaaaugcuagaaucuuggucagauccguuauuagcaaaauggccagaauuacacggcaaaguaagacucuuaaucgcaguuagaaacgcauucagccauaaucaauacccuauguaugaugaagcaguauuuucaucuauaaggaaauaugauccaucguccccggaugcaauagaagaacgaaugggucugaacauagcacauagacuaucugaagaaguuaaacaagcgaaagagacaguggaaagaauaauccaagcauga

SEQ ID NO: 11923 - RNA, 3375 nt, Artificial Sequence
  Cas13b variant__Prevotella aurantiaca__WP_025000926.1__Cas13b
auggaagacgacaagaaaacaacugguucaauuucauacgaauuaaaagauaaacauuucugggcagcauucuuaaaccuagcaagacacaacguauacauaacuauaaaccacauaaacaaacuacuagaaauacgagaaauagauaaugaugaaaaaguacuagacauaaaaacucuauggcagaaaggaaacaaagaucuaaaucagaaagcacgucucagagaacuaaugacaaaacacuucccauucuuagaaacagcaauauacaccaaaaacaaagaagauaagaaagaaguaaaacaagaaaaacaagcagaggcccaaucacuagaaucgcucaaagacugccuauuuuuauuccuagauaaauuacaagaagcccgcaauuacuauucucacuauaaauauucagaauuuagcaaagaaccggaguucgaagaaggacugcuagagaaaauguauaacauuuuuggaaacaauauacagcuaguuauaaaugauuaucaacauaacaaagacauaaaccccgacgaagacuucaaacaccucgauagaaaaggccaauucaaauauaguuuugcagacaaugaaggaaauauaacagagagcggacuauuauuuuucgucucucuuuucuuagaaaagaaagacgcaauauggaugcaacaaaaacuaaauggguuuaaagauaauuuagaaaacaaaaagaaaaugacacacgaaguauuuugucgaucaagaauccuaaugccaaaacugagauuggaaagcacacaaacacaagacuggauccuauuagacaugcuaaaugaauuaauaagaugcccuaaaucccucuacgaaagauuacaaggugacgaccgagagaaauucaaaguuccuuuugauccugcagaugaagacuauaacgcagaacaagaacccuucaaaaauacauuaaucagacaucaagacagauucccuuacuuuguacugcgauacuuugacuauaacgaaauuuuuaaaaaccuacgauuccaaauagaccuuggcaccuaccacuucucaaucuacaagaaauuaauaggcggucaaaaagaagaucgacaucugacgcacaaacuauauggauuugaaagaauacaggaauuugcuaaacaaaacaggccagaugaauggaaagcaauaguaaaagaucucgauacauacgagacgagcaacaaacgauacauuucagaaaccaccccgcacuaccaccuugaaaaccagaaaaucgguaucagauuccgaaacggaaacaaagaaauauggccaucccuaaaaacuaaugacgaaaacaaugaaaaaucaaaauacaaacuugacaaacaauaucaagcagaagcauuccugaguguccacgaacuacuaccaaugauguucuacuaucuacuacucaagaaagaaaaaccaaacaacgaugaaaucaaugcaagcaucguagaggguuuuaucaaacgcgaaauacgaaacaucuucaaacuauaugacgccuucgccaauggagaaauaaacaacauagacgacuuagaaaaauacugcgcagacaaaggcauuccaaaacgacacuuaccaaaacaaaugguagcuauacuauacgacgaacacaaagacaugguaaaagaagcaaaaagaaaacaaaaagaaaugguuaaagacacuaaaaagcuauuagcaacacuagaaaaacaaacacaaaaagaaaaagaagacgacggacgcaacguaaaacuucuaaaauccggagaaauagcaagauggcuaguuaacgacaugaugagguuucaaccuguacaaaaagacaacgagggaaaacccuuaaacaacucaaaagcaaacagcacagaauaucagaugcugcaaagaagccucgcccucuacaauaacgaagaaaaaccgacaagguacuuccgccaaguaaaccuaaucgaaagcaauaauccucacccauuccuaaaauggacgaaaugggaagaauguaauaacauacuaacuuucuacuauucauacuugacaaagaaaaucgaguuucucaacaaacuaaaaccagaggacuggaagaaaaaccaauauuuccuaaaauuaaaagagccaaaaacgaacagagaaacucucguacaaggauggaaaaauggguucaauuuaccaagaggaauuuuuacagaaccaaucagagaaugguucaaacgccaucaaaacaacagcaaagaauacgaaaaaguugaagcacuagaccgcgucggcuuagugacuaaaguuauaccacuauuuuucaaagaagaauacuuuaaagacaaagaagaaaauuuuaaagaagauacgcaaaaagaaaucaaugauuguguacaaccauuuuacaauuucccauacaacguaggaaacauacacaaaccaaaagagaaagauuucuuacaucgagaagaaagaauagaauuaugggauaaaaagaaagauaaauuuaaaggauacaaagagaaaauaaaaucgaagaaauuaacggaaaaagacaaagaagaguuccggagcuaccucgaauuucaaucauggaacaaauucgaacgagaauuacgcuuaguuagaaaucaagacauagucaccuggcuacuauguaaagaacuaauagacaaacuaaaaauagaugaacucaacauagaagaauuaaagaaacuucggcucaacaacaucgacaccgacaccgcaaagaaagagaaaaauaacauucuaaaucgcguaaugcccauggaacuacccguaacugucuacgaaauagaugacucccauaaaaucguaaaagauaaaccauuacacacaaucuacauaaaagaagcagaaacaaaacuacuaaaacaaggaaacuuuaaagcccuaguaaaagaccgaaggcugaauggauuauuuagcuuuguuaaaacaaacucagaagcugaaagcaaacgaaacccaauaucaaaacuccgaguagaauacgaacucggugaauaucaagaagccagaauagaaauaauacaagauaugcuagccuuagaagaaaaauugaucaauaaauauaaagaccucccaacuaauaaauuuucagaaaugcucaacucgugguuagaaggaaaagacgaagccgauaaagcacgcuuucaaaaugacguagauuuucuuauagcaguuagaaacgcauucucccauaaccaauauccaaugcauaauaaaaucgaguucgcaaacauaaaacccuucagcuuauauacagccaauaauucugaagaaaaaggacuaggaauagcaaaucaauuaaaagacaaaaccaaagaaacgacagacaaaaucaagaaaauagaaaaaccaauugaaacuaaagaauag

SEQ ID NO: 11924 - RNA, 3384 nt, Artificial Sequence
  Cas13b variant__Prevotella buccae__EFU31981.1__Cas13b
augcaaaaacaagauaaauuauuuguugaccgcaagaaaaaugcaauauuugcauucccaaaauauauuacaauaauggaaaacaaagaaaaacccgaaccuauauacuacgaacuaacagacaaacauuucugggcagccuuccuaaacuuagcaagacacaacguauacaccacaauaaaccacauuaaucgaagauuagaaaucgcagaacucaaagacgacggauauaugaugggcaucaaaggcucauggaacgagcaagcaaagaaacuagauaagaaaguaagacuucgagaccuuaucaugaaacacuuuccauuucuagaagcagcugcauacgagaugacaaacucaaaaucacccaauaacaaagagcaacgcgaaaaagaacaaagugaggcccuuucgcuaaacaaccuuaaaaacguacuauuuauuuuucuagaaaaauuacaaguccuacgcaacuauuacucacauuauaaauacucagaagaaucuccuaaacccauauucgaaacgucucuacucaaaaacauguauaaagucuucgacgcaaacgucagauuagucaaaagagauuacaugcaucacgaaaacauagacaugcaaagagauuucacacaccuaaaucgaaagaaacaagucgggagaaccaaaaacaucauagacaguccgaauuuucacuaucacuuugcugacaaagaaggcaacaugaccauugcaggcuuacuauucuuugucucccuauuccuggacaagaaagacgcuauauggaugcaaaagaaacuaaaaggcuucaaagacggacgaaaccucagggaacaaaugaccaacgaaguauuuuguagaaguagaauaucacuuccaaaacucaaacuggaaaacguccaaacaaaagauuggaugcaacucgauaugcuaaaugaauugguaagauguccuaaaucauuauaugaaagauuacgagaaaaagacagggaaucauuuaaaguaccuuucgauauuuucucagacgacuauaaugcagaggaagaaccuuucaaaaacacucuagugagacaccaagaccgauuuccauacuucguauuaagauauuuugaccuuaacgaaauauucgaacaacuuagauuccaaauagaccuaggcacauaccacuuuucuaucuacaauaaaagaauaggugacgaagaugaaguaagacaucugacacaucaccucuauggauucgcaagaauacaagauuuugccccacaaaaucaacccgaagaauggcgcaaauuagucaaagaccuugaccauuucgaaacaucacaagaaccauauauaucuaaaacugcuccacauuaccaucuagaaaaugagaaaauaggaaucaaauuuuguucggcucacaacaaccuauuuccaucauugcagacagauaaaacauguaauggaagaucuaaauucaaucuugguacacaauucacagcagaggcuuuucuaucagugcacgaacuucuacccaugauguuuuauuaccuacuacuuacaaaagacuacaguagaaaagaauccgccgacaaaguagaaggaauaaucagaaaagaaauaaguaacauauaugcaauuuacgaugcauucgccaauaaugaaauaaacuccauagcagauuuaacacgaagacuccagaauaccaauauacuccaaggacaccuaccaaaacaaaugauuagcauacucaaaggccgacaaaaagauaugggcaaagaagcagaacgaaaaauaggcgaaaugauagacgacacacaaagacgacucgaucuacuauguaaacaaacaaaucagaaaauacgcauaggcaaaagaaaugccggacuccuaaaaucaggaaaaauugcagauuggcuaguaaacgacaugaugcgauuccaacccguacaaaaagaucaaaacaauauaccaauuaacaacucaaaagcuaacucaacagaauacagaauguuacaacgggcucuagcauuauuuggguccgaaaauuucagacucaaagcauacuucaaccaaaugaaccucguaggaaaugauaacccacacccauuuuuagccgaaacucaaugggaacaccaaacaaacauacuuucauuuuaccgcaacuauuuagaagcgcguaagaaauauuuaaaaggucuaaaaccacaaaauuggaaacaauaucaacacuuucuuauacuaaaaguacagaaaaccaauagaaacacccuaguaaccggcuggaaaaauuccuucaaccugccacgaggcauuuucacacaacccauucgugaaugguucgaaaaacauaacaacuccaaacguauauaugaucaaauauugagcuucgauagaguaggcuucguagcaaaagcaauuccauuauauuucgcagaagaauauaaagacaauguucaaccauucuacgacuacccauucaacauaggaaaccgucuuaaacccaagaaacggcaauuucucgauaagaaagaaagaguugaauuauggcagaaaaacaaagaguuauucaaaaacuaccccucugagaaaaagaaaaccgaccuagcauaccuagauuuucucucauggaagaaauucgaaagagaauuacguuuaauuaaaaaccaagacauagucacaugguuaauguucaaagaacuuuucaacauggccaccguugaaggacucaaaaucggcgaaauccaccuaagagauauagauacaaacacagcaaacgaagaauccaauaauaucuuaaacagaauaaugccaaugaaacuuccuguuaaaacuuaugaaacagacaacaaagguaacauacucaaagaaagacccuuagcaacauuuuauauugaagaaacagaaaccaaaguccuaaaacaaggaaacuucaaagcucuagugaaagacagaagacuaaacggccuuuucuccuucgcagaaaccacagaucucaaccuagaagaacacccaaucucaaaacuuagcgucgaucuagaacucauaaaauaucaaaccacaagaauaucuaucuucgaaaugacgcucggguuagaaaagaaacucaucgacaaauauucaacucucccaacugacagcuuucgaaacaugcuagaaagauggcuucaaugcaaagcaaauagaccagaacucaaaaacuacguaaacucauuaauagcaguucgaaacgcuuuuucacacaaucaauauccaauguacgaugcaacacuauucgcugaaguaaagaaauucacucuuuucccgagcguugacacaaagaaaauagaacuaaacauagccccucaauuauuggaaauaguuggaaaagcaaucaaagaaauagaaaaaucagaaaacaaaaacuaa

SEQ ID NO: 11925 - RNA, 3384 nt, Artificial Sequence
  Cas13b variant__Prevotella buccae__WP_004343581.1__Cas13b
augcaaaaacaggauaaacuauucguagacagaaaaaaaaaugccauuuuugccuucccaaaguacauaacaauaauggaaaaucaagaaaaaccugaaccaauauauuacgaauuaacagacaaacacuuuugggcagcuuuuuuaaaccuagcacgacacaauguauauacaacaauaaaucauauaaauagaagacucgaaauagcagaauuaaaagaugauggcuacaugauggauauuaaaggcagcuggaaugaacaagcaaaaaaauuggacaaaaaaguuagguuacgcgauuuaauuaugaaacacuucccauuuuuagaagcugccgcauacgaaauaacaaacuccaaaucaccaaauaacaaagaacaaagggaaaaagagcaaagcgaagccuuaucacuaaacaacuuaaaaaacguacuauuuauuuuccuagaaaaauuacaaguuuuaagaaacuauuauucacacuacaaguauagugaagaaucgccaaaacccauauucgaaacaucauuacuaaaaaauauguacaaagucuucgaugcaaacguccgauuaguuaaaagagacuauaugcaccacgaaaauauagauaugcaaagagacuucacacaccuaaacagaaaaaaacaaguuggaagaacaaaaaacaucauagauucuccaaauuuucacuaccacuuugccgauaaagaaggcaacaugacaauagcaggacuacuauucuucguaucacuauuuuuagacaaaaaagacgccauauggaugcaaaaaaaacucaaagguuuuaaagauggaagaaaccuacgcgaacaaaugacaaaugaaguauuuugucguucacgcauuuccuuacccaaauuaaaacuagaaaauguucagacaaaagacuggaugcaacucgacaugcucaaugaauuaguucguugcccaaaaucacuauacgaaagauuaagagagaaagaccgagaaaguuuuaaaguaccguucgacauuuuuucagacgauuaugacgcagaagaagaaccguucaaaaacacauuaguuagacaucaagauagauucccauacuuuguauugcgauacuucgaccuaaaugaaauauucgaacaauugagauuucaaauagaccuugggaccuaucacuuuuccaucuacaauaaaagaauaggagacgaagacgaaguaagacaccuuacacaccaccuauacgguuucgcucgaauacaagacuucgcacaacaaaaccaacccgaaguauggagaaaacuaguuaaggauuuagauuauuucgaagcaagccaagaaccauauauuccgaaaacagcaccccacuaucaccuagaaaaugagaaaauagguauuaaauucugcagcacacauaacaaccuuuucccgucccuaaaaacagaaaaaaccuguaauggacguagcaaauucaaucugggaacacaauucaccgcagaagccuuuuuaagcgugcacgaacuacucccuaugauguuuuacuauuuacuacuaaccaaagauuauucgcgaaaagaauccgcagauaaaguagaaggcauaauuagaaaagaaauaucaaauauauacgccauauacgacgccuuugcaaacggcgagauaaacucaaucgcggacuuaacaugcagauuacagaaaaccaauaucuuacaaggacaucucccaaaacaaaugaucuccaucuuggaagguagacaaaaagacauggaaaaggaagcugaaagaaaaauaggagaaaugauugaugacacacaaagacgacuagauuugcuuugcaaacaaacaaaccaaaaaauacgaauaggaaagcggaacgcuggacuauuaaagucugguaaaauagccgacugguuaguuaacgacaugaugagauuccaaccuguccaaaaagaccaaaacaauauaccaauaaauaacucaaaagccaauucgacagaauaccgaaugcuacaaagagcauuggcacucuucggcucagaaaacuuuagauuaaaagcuuacuuuaaccaaaugaauuuaguuggaaacgacaauccucaccccuucuuagcagaaacccaaugggaacaccaaacuaauauacuaucuuucuacaggaacuacuuagaagcgcgaaaaaaauaccuuaaaggucuaaaaccacaaaauuggaaacaauaucaacauuucuugauacugaaaguacaaaaaaccaacagaaauacauuagucacaggcuggaaaaauucuuuuaaccuuccaagaggcaucuuuacccaaccaauacgcgaaugguuugaaaaacauaacaauaguaaacgaaucuacgaucaaauauuaagcuucgacaggguugguuucguagcgaaagccaucccacuuuacuuugcagaagaauacaaagauaacguccaaccauucuaugauuacccguucaauauuggcaauaaacuaaaaccccagaaaggacaauucuuagacaaaaaagaaagaguagaauuauggcagaaaaauaaagaauuauucaaaaauuauccuucugaaaaaaaaaagacagaccucgcauaccuagacuuucuauccuggaaaaaauucgaacgcgaacuacgcuuaaucaaaaaccaggauaucgugacauggcuaauguucaaagaauuauuuaauauggcuacuguagaaggauuaaaaauaggcgagauacacuuaagagacaucgacacaaauacagccaacgaggaaucaaauaauauuuuaaauagaauaaugccaaugaagcuccccguaaaaacauacgaaacugauaauaagggaaacauacucaaagaacgaccucuagcaacguucuacauagaagaaaccgaaacaaaaguucuaaaacaaggaaauuuuaaaguacuagcuaaagacagaagguuaaacggacuacuuucauucgcagaaaccacagauauagauuuagaaaaaaaccccaucaccaaacucaguguagaccaugaacuaauuaaauaccaaaccacccgcauaucaauauucgaaaugacacuuggcuuagaaaaaaaguugauaaauaaauacccaacacuuccaacagacucguucagaaacaugcucgaaagauggcuucaaugcaaagcaaaccgacccgaacucaaaaacuacguuaacagucucauagcuguccgcaaugcauucucacacaaucaauauccaauguaugacgcuacguuauuugcagaaguaaaaaaauucacauuauuuccaucgguagauacuaaaaagauagaauuaaauauagcaccucaacuguuagagaucguugguaaggcaauuaaagaaaucgaaaaaagcgaaaacaaaaauuaa

SEQ ID NO: 11926 - RNA, 3402 nt, Artificial Sequence
  Cas13b variant__Prevotella falsenii__WP_036884929.1__Cas13b
augaaaaacgacaacaacucaaccaaaucuacugacuauacacucggagacaaacauuuuugggcagcuuuuuuaaacuuagcuagacauaacguauauaucaccguaaaccauauaaauaaagucuuagaauuaaaaaacaaaaaagaccaagagauaauaauagacaaugaucaagauauacucgcaauaaaaacacuaugggguaaagucgauacagauauuaacaaaaaagaccgauuacgagaacuaaucaugaaacauuuccccuucuuagaagcugccacauaucaacaaagcucaacaaacaacacaaaacaaaaggaagaagaacaagcaaaagcccaaucauucgaaagcuuaaaagauuguuuauucuuauuucucgagaaauuaagagaagcacguaauuacuauucccacuacaaacacagcaaaucacuagaagaaccaaaacucgaggaaaaacuccucgagaauauguacaauauauucgauacaaauguacaacuaguaaucaaagacuacgaacacaacaaagacauaaacccagaagaagacuuuaaacacuuagggagggccgaaggagaauucaauuauuacuucacgagaaacaaaaaagguaacauaacagaaucaggucuacuauucuucguauccuuauuucuagaaaagaaagaugcaauuugggcacaaacaaaaauaaaaggauucaaagauaacagagaaaauaaacaaaaaaugacacaugaaguauucugccgcagcagaaugcucuuaccaaaauuaagacucgaaucaacucaaacccaagacuggauacuguuagacaugcuaaaugaacucauuagauguccaaaaagccuauacaaaagacuacagggagaaaaaagagaaaaauuucgagucccauucgauccggcagacgaagacuaugaugcagaacaggaaccauuuaaaaacacucuaguccggcaucaagauagauucccauacuucgcauugcgauacuuugauuacaaugagauauucacaaaccuaagauuccagaucgaccuaggaacauaccacuucucaauauacaaaaagcaaaucggugacaaaaaagaagacagacauuuaacucauaaauuguaugguuucgaacgaauucaagaauucgcgaaggaaaaccgaccagacgaauggaaagcacucguaaaagaucucgacacauucgaagaaucaaacgaacccuacauauccgaaaccacaccacacuaccaccuagaaaaccaaaaaauaggaauuagaaacaaaaacaaaaaaaaaaaaaagaccaucuggccaucguuagaaaccaaaaccacaguaaacgaaagaaguaaauacaaucuagggaaaagcuuuaaagcagaagcuuuucugucuguacacgaguuauuaccaaugauguucuauuaucuauuacuuaacaaagaagaaccaaauaacgggaaaauuaacgcauccaaaguugaaggcauaauagaaaaaaaaauccgagacauauauaaauuauacggagccuucgcaaaugaagaaauaaauaacgaagaagaauugaaagaauauugcgaaggaaaagacauagcaauacgacaccuaccaaaacaaaugauagcaauuuuaaaaaacgaauauaaagauauggcaaagaaagcagaagauaaacaaaaaaaaaugauuaaagacacuaaaaaaagacucgcagcacuggacaaacaaguaaaaggcgaaguugaagacggcggaagaaacauaaaaccccuuaaaagcgggaggauugcuagcuggcuagucaaugauaugaugagauuucaaccaguccagagagacagggauggauaccccuuaaauaacucaaaagcaaacucaacagaauaccaauuauuacaaaggacccucgccuuauuugggucggaaagagaaaggcuugcacccuacuucagacaaaugaaccuaauuggaaaagacaauccacauccauuucucaaagauaccaaguggaaagaacacaauaauauacuaaguuucuauaggagcuaucuagaggcaaaaaaaaacuuucucggaagucuaaaaccugaagacuggaaaaagaaccaauauuuucuaaaguugaaggaaccuaaaacaaaccgagaaacauuagugcaaggcuggaaaaauggcuuuaacuuaccccgcggaauuuucacagaaccaauaagagaaugguuuauacgacaccagaaugagagcgaagaauauaaaaaagucaaagauuuugauagaauaggcuuggucgccaaaguuaucccacuauucuuuaaagaagauuaccaaaaagaaauagaagauuauguucaaccuuuuuauggauacccauucaaugucggcaacauucacaacagccaggaaggaacguuccugaacaaaaaggagcgcgaagaguuauggaaaggaaacaaaacaaaguucaaagauuacaaaacaaaagaaaaaaauaaagaaaaaacgaauaaggacaaauucaaaaaaaaaacagacgaagaaaaagaggaauucagaucuuacuuggauuuccaaaguuggaaaaaauucgagagagaauuaagacuaguccgaaaccaagacauaguaacauggcuauuaugcauggaauuaaucgacaaacuaaaaauugaugagcucaacauagaagaacuucaaaaacuaagauuaaaagacauagacacggauacugcaaaaaaagaaaaaaauaauauacucaaccgaauuaugccaauggaauuaccagugaccguauacgagacagacgacucaaauaacaucauaaaagacaaaccacuacacacaaucuacauaaaagaagcagaaacaaaacuauuaaagcaagguaauuucaaggcauuaguaaaagacagacgacucaauggcuuauuuagcuucguagaaaccucaucagaagcagaacuaaaaagcaaaccaaucucaaagucacuaguggaauacgaacugggugaauaccaacgggcaagaguggagaucauaaaagauaugcuaagguuagaagaaaccuuaauagguaaugaugaaaaacuaccaacaaacaaauuccgacaaaugcuggacaaaugguuagaacauaaaaaagaaacagaugacacagaccuuaaaaaugacguaaaacugcuuacugaagucagaaaugcauucucccauaaccaauaccccaugagagacagaauagcauucgccaacauuaaaccauucaguuuauccucagcaaauacaagcaacgaagaaggacuaggaauagcaaaaaaacuaaaagauaaaacaaaagaaaccauagauagaauaauagaaauagaagagcaaaccgcuacaaaaagguga

SEQ ID NO: 11927 - RNA, 3402 nt, Artificial Sequence
  Cas13b variant__Prevotella intermedia__BAU18623.1__Cas13b
auggaagaugacaagaaaacgacggacucaauaaguuacgaauuaaaagacaaacacuuuugggcagcuuuccuaaaccuugcucgacacaacguuuacauaacuguaaaucacaucaauaaaguacuugaauuaaagaacaagaaagaucaagacauaauuaucgacaacgaccaagauauccuagccauuaaaacacauugggaaaaagugaauggggacuuaaacaaaacagaaaggcuuagggaauuaaugacaaaacauuuuccauuucuagaaacagcuauauauuccaaaaacaaagaagauaaagaagaagucaaacaagaaaaacaagcaaaagcacaaucauuugauucucuaaaacauugucuguucuuauuccuggaaaaauuacaagaaaccagaaacuacuacucacauuauaaauacagugaaucaaccaaagaaccaaugcuagaaaaagaauuacucaagaaaauguauaauauauucgaugacaauauucaguuaguuauuaaagauuaccaacacaacaaagacauaaacccggaugaagauuucaaacaucuagaucguacagaagaagacuucaacuacuauuuuacacgaaacaagaaaggaaauauaacagaaucaggccuauuauuuuucguaagccuguuuuuagagaagaaagacgcuauauggaugcaacaaaaauuaagaggauucaaagacaaucgagaauccaaaaagaaaaugacucaugaaguauuuuguagaucgagaaugcuccuaccaaaauuacgucuagaaaguacccaaacacaagacuggauauuacuugauaugcucaaugaacuuauacgguguccuaaaagccuauacgaacgccuacaaggcgaagacagagaaaaauucaaagucccauucgacccagcugaugaagacuacgacgcugaacaagaaccuuucaaaaacacauuaguccggcaucaagaucgcuuuccauacuucgcacuacgauauuucgauuacaacgaaauauuuaccaaucuaagguuccagauugaccuaggcaccuuccauuucucaaucuauaagaaacuaauaggcggacaaaaagaagaucgacaucuaacacauaaacuuuacggauucgaaagaauccaagaguucgccaaacaaaaccgcccagacgaauggaaagcaauaguaaaagauuuagauaccuacgaaaccucaaaugaaagauacauaucagaaacuacaccacacuaucauuuagaaaaccagaaaauaggaauacgauuuagaaaugauaacgacgaaauauggccaucacuaaaaacaaacggagaaaauaaugaaaaaucuaaauacaaacuugacaaacaauaccaagcagaagcauucuuaucaguccacgaacugcucccuaugauguucuauuaccuauuacuaaagaaagaagaaccaaauaacgauaagaaaaacgcaucuauagucgaaggauucauaaaaagagaaauccgagauauguacaaacuauacgacgccuucgcuaauggagaaauuaauaacauagacgaucuagaaaaauauugugaagacaaaggaaucccaaaaagacacuuacccaaacaaaugguugcaauacucuacgaugaacacaaagauaugguuaaagaagcaaaacgaaaacaacguaaaaugguaaaagauacagaaaaacuacucgccgcauuagaaaaacaaacgcaagagaaaacagaagauggcggacgaaauaucagacuauuaaaaaguggcgaaauagccagauggcugguaaacgauaugaugagauuccaaccaguccaaaaagacaacgaaggaaacccauuaaacaacagcaaagcaaauaguacagaauaucaaaugcuacaaagaucauuagcacuauauaauaaagaagaaaaaccaacacgauauuuccgacaagucaaccuuauaaacagcucaaacccccacccauuccuuaaauggacaaaaugggaagaaugcaacaacauauuaucuuucuaucgcaguuaccucaccaagaaaauagaauuucucaacaaauuaaaaccagaagacugggagaaaaaucaauauuucuuaaaacuuaaagaaccaaaaacaaacagagaaacccuaguacaagguuggaaaaauggauucaaucuuccuagagguauauuuacggaacccauaagggaaugguucaaacgccaccaaaacgauucaaaagaauacgaaaaaguagaagcacuagacagaguuggauuagucacuaaaguaauaccacucuucuuuaagaaagaagauuccaaagauaaagaagaagaccuuaagaaagacgcucaaaaagaaauaaauaacuguguacaaccguuuuauucuuucccauacaauguaggaaacauacauaaacccgacgaaaaagacuuucuacacagagaagaaagaauagaacuaugggacaaaaagaaagacaaauuuaaaggguacaaagccaaaguaaaaagcaagaaacucaccgacaaagaaaaagaagaauacaggucguaucucgaguuccaaaguuggaauaaauucgagagggaauuaagacuugucagaaaccaagacauagucacauggcuacuuugcacggaauuaauagacaaguuaaaaguagaaggacuuaauguugaagaacuaaagaaauuaagauuaaaagauauugacaccgacaccgcaaaacaagaaaagaauaauauauuaaacagaguaaugcccaugcaacuucccguaacuguauacgaaauagaugacagccauaauaucguaaaagacagaccacugcauacuguguauaucgaagaaacaaaaaccaaauuacucaagcaaggaaauuucaaagcauuaguaaaagaucgaagauuaaacggacuauucucauucguagacacaaguucagaagcagaacuaaaaaguaaccccaucuccaaaagccuaguagaauacgaacuaggugaauaccaaaacgcacgcauagaaacaauuaaagauauguuauuguuagaggaaacccuuauagaaaaauauaaaaaccugcccaccgacaauuuuagcgacaugcuaaacgguugguuagaaggaaaagaugaagcugauaaagcacgauuucaaaaugacgucaaauuacugguagcaguuagaaaugcuuuuucucauaaucaguauccaaugagaaaccguauagccuuugcuaauauaaacccguuuagucuaucaucagcagacacuucagaggagaagaaacuagacaucgcaaaccaacuaaaagacaaaacacauaaaauuauaaaaaggauaauagaaauagaaaaaccaauagaaaccaaagaauag

SEQ ID NO: 11928 - RNA, 3405 nt, Artificial Sequence
  Cas13b variant__Prevotella intermedia__AFJ07523.1__Cas13b
augaaaauggaagacgauaaaaaaacaaaagaaucaacaaauaugcucgacaacaaacacuuuugggccgcauucuuaaaucuagcuagacacaaugucuauaucacagucaaucacauaaauaaaguacuagaacuaaaaaauaagaaggaccaagauauaaucauagauaacgaucaagauauacuagcaauaaaaacucacugggaaaaagucaacggcgaccucaacaaaaccgaacgauuacgagaacuuaugacuaaacacuuccccuuuuuagagacugcaauuuacacaaaaaacaaggaagauaaagaagagguaaaacaagaaaaacaagcaaaagcacaaucauuugacucccuuaagcauugccuauucuuauuccuagaaaaauuacaagaagcaagaaauuacuauucacauuacaaauacucugaaucgacaaaagaaccaaugcuagaaaaagaacuauuaaaaaaaauguacaacauauuugacgauaauauacaacuagucauaaaagacuaccaacauaacaaagauauaaaucccgacgaagacuucaaacacuuagacagaaccgaagaagaauucaauuacuauuuuacaacaaauaaaaaaggaaacauaacagcaaguggcuuauuauucuucguaucacucuuucuagaaaaaaaggacgccauauggaugcaacaaaaacucagaggauuuaaagauaacagagaaucaaaaaaaaagaugacucaugaaguuuuuugccgaaguaggauguuacugcccaaauuacgccuugaaagcacacagacacaagauuggauccugcuagacaugcucaacgagcuuauacgauguccaaaaaguuuauacgaaagacuccaaggagaauacagaaaaaaauucaacguaccauucgauagugcagaugaagacuacgaugcagaacaagaaccauuuaaaaacacccuaguacgacaucaagauagauuccccuacuucgcacugagauacuucgauuacaacgaaauuuuuacuaacuuaagauuucaaauugacuuaggaaccuaccacuuuucaauuuauaaaaaauugauaggcggucaaaaagaagaucgacaccuaacucacaaacucuauggauucgaaagaauacaagaauucgcuaaacaaaaucgcaccgacgaauggaaagcaaucguaaaagacuuugacaccuaugaaaccucagaagaacccuauauaucugaaacagcuccacauuaucaucuugaaaaccaaaagaucgguauacguuuuagaaaugauaaugaugaaauauggccaucguuaaagaccaauggagaaaauaacgaaaaaagaaaauauaaacucgacaaacaauaccaagcagaagcauuuuuauccguccaugaguuauuaccaaugauguuuuacuacuuacuccuuaagaaagaggaaccgaauaacgauaaaaaaaacgcgucuauaguagaaggauucauaaaaagagaaauacgagacaucuacaaacucuacgacgcauucgcaaauggcgaaaucaacaauaucgacgaccuugaaaaauacugugaagacaaaggaauacccaaaaggcaccuuccaaaacaaaugguagcaauacuauacgaugagcauaaagacauggcagaggaagccaaaagaaaacaaaaagaaaugguuaaagacacuaaaaagcuacuagcaacccuagaaaaacagacacaaggagagaucgaagacggcggacgcaacauacgacuauuaaaaucuggagaaauugcccguuggcuaguaaaugacaugaugagauuccaaccuguacaaaaagauaacgaaggcaacccauuaaauaacagcaaagcaaacagcacagaauaccaaauguugcaaagaucucucgcacuauauaauaaggaagaaaaaccgacucgcuauuuucgccaagucaaccuuauaaauucuucuaauccacacccauuucucaaguggacaaaaugggaagaaugcaauaauaucuuaucauucuaccgaaguuacuuaaccaaaaaaaucgaauuucuuaacaaacucaaaccggaagacugggaaaaaaaccaauacuucuuaaaauuaaaagaaccuaaaacaaaucgagaaacccuuguacaaggauggaaaaacggauuuaaccucccgagaggaauuuuuacagaaccaauacgagaaugguuuaaaagacaucaaaacgauagcgaagaauacgaaaaaguagaaacucucgauagaguaggacuaguaacaaaaguaaucccauuauuuuucaaaaaagaagacucuaaagacaaagaagaauaccuaaaaaaagacgcccaaaaagaaaucaauaauugcguacaacccuuuuacggcuucccuuacaacguaggcaacauacauaaaccagaugaaaaagacuuccuuccaucagaagaaagaaaaaaauuauggggagacaaaaaauacaaauucaaaggguacaaagcaaaagucaaaaguaaaaaacucacagauaaagaaaaagaagaauaccgcuccuaucuagaauuccaaagcuggaacaaauucgaacgagaauuacgacuaguaaggaaucaagacauaguaacuuggcuacucugcaccgaacucauugauaaauuaaaaguagaaggacucaauguagaagaauuaaaaaaauuaaggcuuaaggacaucgauacagacacagcuaaacaagaaaaaaacaauauacuuaaccguguaaugccaaugcaacucccaguaacagucuacgaaauagacgacucacacaacauugucaaagauagaccacuccacacuguauacauagaagaaacaaaaaccaaacuuuuaaaacaaggaaacuucaaagcccuaguaaaagaucgacgucuaaauggacuauuuucauuuguagacacauccagcgaaacggaacugaaaaguaaucccauaucuaaaucauuagucgaauaugaacucggugaauaccaaaacgcaagaauagaaaccauuaaagauaugcuacuacucgaagaaacgcuaauagaaaaauauaaaacauuaccaacagacaacuucuccgauauguuaaacgguuggcuugaaggaaaagacgaggcugauaaagcuagauuccaaaaugacguaaaacugcuaguugccgugagaaaugcuuucagucacaaccaauaccccaugagaaaccgcaucgccuucgccaacaucaauccuuucucacuaucaucagcagauacaagugaagaaaaaaaacucgauauagcaaaccaacugaaagauaaaacgcauaaaauaauuaaaagaauuauugaaauagaaaaaccaauagaaacaaaagaauga

SEQ ID NO: 11929 - RNA, 3399 nt, Artificial Sequence
  Cas13b variant__Prevotella intermedia__WP_014708441.1__Cas13b
auggaagacgacaaaaaaacuaaggagagcacaaauaugcuagacaauaaacauuuuugggcggcauuccuaaaucuagcuagacacaauguauauaucacgguaaaucauauaaacaaaguauuagaacugaaaaacaaaaaagaccaagauauaauaaucgauaacgaccaagauauacuggcaaucaaaacacacugggaaaaaguaaauggagauuugaauaaaacugaaagauuacgagaacuaaugacaaagcauuucccauuccuagaaaccgccauuuauacgaaaaauaaagaagauaaagaagaagucaaacaagaaaagcaagcuaaagcccaaucauuugacagccuaaaacacugcuuauuccuauuccucgaaaaacuucaagaagcgaggaauuacuacagccacuauaaauacucagaaaguaccaaagaaccuauguuagaaaaagagcuacuaaaaaaaauguacaacaucuuugacgacaacauacaacuaguaauaaaagacuaccaacacaacaaagauauaaacccagaugaagacuucaaacacuuggaccguacagaagaagaauucaauuauuauuucaccacaaacaaaaaaggcaacauaacagcaagcggacuacucuucuucgugagcuuauuucucgaaaaaaaagaugcuaucuggaugcaacaaaaacuccgaggcuuuaaagacaacagagaauccaaaaaaaaaaugacacaugaagucuucugccgaagcaggaugcucuuaccaaaauuacgacucgaauccacucaaacacaagacuggauacuacucgacaugcuaaacgaacucauaagaugcccgaaaucauuguacgaaagauuacaaggagaauaccgaaaaaaauuuaauguuccuuuugacagcgcagacgaggauuacgacgcggaacaggaaccauucaaaaauacguuaguaagacaucaagaccguuucccauauuucgcauuacgauacuucgauuacaacgaaauauucacaaaucucagguuucaaauugacuuaggcaccuaucacuuuaguauuuacaagaaauuaaucggcggacaaaaagaagaucggcaccuaacgcacaaacuauacggauuugaaagaauacaagaauucgcaaaacaaaaucgaacagaugaauggaaggcuauaguaaaagacuucgacacauacgaaacaagugaagaaccuuacauaucagaaacagcaccacauuaucacuuagagaaucaaaaaauaggaauucguuuucgaaaugauaacgaugaaauuuggccaucacucaagacaaacggagaaaauaacgaaaaaagaaaauacaaauuagacaaacaauaucaagcagaagccuucuuaucuguacacgaauuauuaccaaugauguucuacuaucuucuucucaaaaaagaagaaccuaacaacgacaaaaaaaaugcuagcauaguagaaggauucaucaaacgagaaaucagagauauauacaaacuauacgaugcuuuugcgaacggagaaauaaacaacauagacgaccuugaaaaauauugugaagacaaagguauaccgaaacgacaccuuccgaaacaaaugguggcaauccuuuacgaugaacacaaagauauggcugaagaagcaaaaagaaaacaaaaggaaaugguaaaagauaccaaaaaacuucucgcaaccuuagaaaaacaaacacaaggggaaauugaagauggggguagaaacauaagauuacuaaaaucaggcgaaauagcacgaugguuaguaaacgacaugaugagauuccaaccaguucaaaaggauaacgaaggaaacccauuaaacaacucaaaagcaaacucaacugaauaccaaauguuacaaagaagucuugcauuauauaauaaagaagaaaaaccuacacgauauuuuagacaaguuaaccuuauaaauaguucuaacccacaucccuuccuaaaauggacaaaaugggaagaauguaacaacauacuaucauuuuauagauccuaucuaacgaaaaaaauagaauuucuuaacaaacuaaaacccgaagauugggaaaaaaaucaauauuuccuaaaacuaaaagaacccaaaacaaaccgagaaacauuaguacaagguuggaaaaacggcuucaaucucccuagaggaauauucacagaaccaaucagagagugguucaaacgacaccaaaaugauagcgaagaauaugaaaaaguagaaacauuggaucgaguaggacuaguaacaaaaguaauaccacucuuuuucaaaaaagaagauucaaaagacaaagaagaauaccuaaaaaaagaugcacaaaaagaaaucaacaauugcguacagcccuucuacggauuuccauauaacguuggaaacauacacaaaccagaugagaaagacuuucucccaucugaggaaaggaaaaaacuauggggagacaaaaaauacaaauucaagggauauaaggcgaaaguaaaaagcaaaaaacucacggacaaagaaaaggaggaauauagaagcuaccucgaauuucaaagcuggaacaaguucgaaagggaacuaagauuaguucguaaucaagauaucguaacuuggcuccucugcacugaacuuaucgacaaacuuaaaguagaaggccuaaacguagaagaacuaaaaaaacuucgacuaaaagauaucgacacagauaccgccaaacaagaaaaaaauaacauccuaaacaggguaaugccgaugcaacuaccaguaaccguauacgaaaucgacgauucacauaauauaguaaaagacagaccauuacacacaguauacauagaagaaaccaaaacaaaguuacuaaaacaaggaaauuucaaagcucuagugaaagacagacggcuaaacggacucuuuuccuuuguagauacaaguucugagacagaacuaaaaucaaacccaauuucaaaaucuuuaguagaauacgaacugggcgaauaccaaaacgcgcggauugagacaauaaaagauaugcuacuuuuagaggaaacuuuaauagaaaaauauaaaaccuuaccaacagauaacuuuucagacaugcuaaauggauggcuugaaggaaaagacgaagcagacaaagcuagauuccaaaaugacguaaaacuccuaguagcggucagaaaugccuucucacacaaccaauacccaaugaggaacagaauagcauucgcaaacaucaacccauuuucacuauccagcgcagacacuagcgaagaaaaaaaacuggauauagcaaaccaacuaaaggacaaaacucauaaaauaauaaaacgaauaauugagauagaaaagccaauugaaacaaaagaauaa

SEQ ID NO: 11930 - RNA, 3381 nt, Artificial Sequence
  Cas13b variant__Prevotella intermedia__WP_036860899.1__Cas13b
auggaagacgacaagaaaaccacagacucaauaagguacgaauuaaaagacaaacauuucugggcagccuucuuaaaucuugcaagacauaacguauacaucacagugaaucacauaaauaaaauacuggaagaaggcgaaauaaauagagacggauaugaaacuacacucaaaaacacauggaacgaaaucaaagacauaaauaagaaagaucgccuaaguaaauugaucauaaaacauuuucccuuccucgaagcugcuacauaucguuuaaauccuacagacacuacaaaacaaaaagaagaaaaacaagcagaagcucaaucacucgaaucccuuagaaaauccuucuuuguauucauauacaaacuaagggaucugcgcaaccauuacucacacuacaaacacucuaaaucauuagaaagaccaaaauucgaagaaggacuacucgaaaagauguacaauauauucaaugcaucuauaagauuaguuaaagaagacuaucaauauaauaaagacauaaacccagaugaagauuuuaaacaucucgauaggacugaagaagaauuuaacuacuacuucacaaaagauaaugaaggaaauaucacggaaucagguuuauuauucuucguuucauuauuccuagagaagaaagacgccaucuggaugcaacaaaaacuaagagguuuuaaagacaacagagaaaauaaaaagaaaaugacaaacgaaguauucugccgauccaggaugcuacuacccaaauuaagauuacaaucaacgcaaacccaagauuggauacuauuagauauguuaaaugaacuaauaagaugucccaaaucauuauaugaaagacuaagagaagaagacagggaaaaauuccgcguuccuauugaaauugcugacgaagacuacgacgcagaacaagaaccauuuaaaaauacauuaguaagacaucaagaccgauuuccauacuuugcacuacgguacuuugacuauaaugaaauauuuacaaaccuaagauuucaaauugaccucggaacauaccacuucagcaucuacaagaaacaaauaggagauuacaaagaaucacaucaucucacacacaaacuauauggauucgaaagaauacaagaguucacaaaacaaaacagaccagacgaauggaggaaauucgucaaaacuuucaauucauuugaaaccaguaaagaaccauauauaccagaaacaacgccacacuaucaccuagaaaaccagaaaaucggcaucagauucagaaacgacaacgauaaaauuuggccuagccuaaaaacgaacucagagaaaaacgaaaaauccaaauacaaauuagacaaaucauuccaagccgaagcauuucucucuguacaugaauuauuacccaugauguucuacuacuuauuacucaaaaccgaaaacacagauaaugacaacgaaauagaaaccaaaaagaaagaaaacaaaaacgacaaacaggaaaaacauaaaauagaagaaaucauagaaaacaaaauaacagaaaucuaugcacuauacgacaccuuugcgaacggugaaauaaaaaguauagaugaacuggaagaauacuguaaaggaaaagauauagaaauaggacaccuacccaaacaaaugauagcaauucucaaagacgaacauaaaguaauggcaacugaagcagaaagaaaacaagaagaaaugcucguagacguacaaaaauccuuagaaucacuugauaaccaaauaaacgaagaaaucgaaaacguagaacguaaaaauucauccuuaaaaagugguaaaaucgcaaguuggcucgucaaugacaugaugagauuccaacccguacaaaaagacaacgaaggaaaaccgcuuaacaauucaaaagcuaauagcaccgaauaccaacuauuacaaagaacauuagcauucuucggguccgaacacgaaagauuagcaccuuauuucaaacaaacuaaacuuaucgaaaguucaaauccacauccauuccuuaaagacacagaaugggaaaaauguaacaauauacuaucauucuaccguagcuacuuagaagccaagaaaaacuuucuugaaagccuuaagccagaagauugggagaaaaaucaauacuuuuuaaaacuaaaagaaccaaaaacaaaaccaaaaacccuaguacaaggauggaaaaauggauucaaccuaccccggggaauauuuacagagccaauacggaaaugguucaugaaacaccgcgaaaacaucacuguagccgagcuaaaacgcguaggguuagucgcaaaaguaauaccacucuucuucuccgaggaauauaaagauagcguccaaccauuuuauaauuaccauuuuaacguaggcaauauuaacaaacccgacgagaaaaauuucuuaaauugcgaggaaagacgagaacuacucaggaagaagaaagaugaguucaagaaaaugacagauaaagaaaaagaagaaaacccuucauaucucgaguucaaaucauggaacaaauucgaaagagaacuccgccugguaagaaaucaagacauuguaacuuggcuacuaugcauggaacuauuuaacaagaagaaaauaaaagaacucaacguagagaaaaucuaccugaaaaauauaaauacaaacacuaccaagaaagagaaaaauacagaagagaaaaauggagaagagaaaaauauaaaagagaaaaacaacauucuaaaucgaauaaugccuaugagacuucccauaaaaguuuacgggagagaaaauuucuccaaaaacaagaagaagaaaauccggcgaaacacauuuuucacgguuuacauagaagagaaaggaacaaaacuccuaaaacaaggaaacuucaaagccuuagaacgcgacagacgguuaggcggacucuucagcuuuguaaaaacaccuucaaaagccgaaucaaaaucaaauacaauaagcaaauuaagaguagaauaugaacucggugaauaucaaaaagcaagaauagaaauuauaaaagacaugcucgcacuagaaaagacuuuaauagacaaauacaauagccucgauacagacaacuuuaacaaaauguuaacagacuggcuugaacuaaaaggagaaccggauaaagcauccuuccagaaugauguugacuuauuaauugccguacgcaacgccuucucacauaaccaauacccaaugcgaaacagaaucgcuuuugccaauauaaacccauuuucacuauccuccgcuaacacuucagaagaaaaaggauuaggaauagcaaaccagcuaaaagauaaaacacauaaaacaauagagaaaaucauagaaauugaaaaaccaaucgaaacaaaagaauaa

SEQ ID NO: 11931 - RNA, 3363 nt, Artificial Sequence
  Cas13b variant__Prevotella intermedia__WP_061868553.1__Cas13b
auggaagaugauaaaaaaacaaccgacagcaucagguaugaacuaaaagacaaacacuucugggccgcauuccuaaauuuggcacgccauaacguuuacaucaccgucaaccacauaaauaaaauacucgaagaagacgaaauuaacagagacggauaugaaaacacgcuagaaaauucauggaaugaaauuaaagacaucaacaaaaaagauagauuauccaaauugauaauaaagcauuucccauuccucgaggcuaccaccuacagacagaacccaaccgauacaacuaaacaaaaagaagaaaaacaagcagaagcacaauccuuagaaagucuuaaaaaaucauucuuuguauucauauauaaacuaagagaccuacgaaaucauuauucacacuacaaacacucaaagucacuagaaaggccaaaauuugaagaagacuuacaaaauaaaauguacaauaucuucgacgucucaauacaauuuguaaaagaagacuacaaacacaauaccgauauuaauccgaaaaaagauuuuaaacaccuagacagaaaacgaaaaggaaaauuccacuacagcuucgcagacaaugaagggaacauaacagaaagcggauuauuauucuucgucaguuuauucuuagaaaaaaaagacgcgaucuggguacaaaaaaaacucgaaggcuuuaaaugcucuaacaaaagcuaucaaaaaaugacaaacgaaguauuuugucgcucacgaauguuacuacccaaauugcgauuagaaucuacacaaacgcaagacuggauacuauuagauaugcuuaacgaacuaaucagaugccccaaaagccuuuaugaaagacuccaaggaguaaacagaaaaaaauuuuacguuucauucgaccccgcagacgaagauuaugacgcagaacaggaaccauucaaaaacacacuaguucgacaccaagacagauucccguauuuugcucuacgcuacuuugauuauaaugagguguuugcaaaucuaagguuucaaauugaccuaggaaccuaccauuucucgauauauaaaaaauuaaucggaggucaaaaagaagacagacaucuaacacacaaauuauacggauuugaacgaauacaggaauucgauaaacaaaacagaccagaugaauggaaagcaauaguaaaagauucagacacauuuaaaaaaaaggaagaaaaggaagaagaaaaaccauacaucagugaaacuaccccacacuaccaccuugaaaauaaaaaaauaggcauagccuucaaaaaccacaauaucuggccaaguacacaaaccgaguuaaccaauaauaaacgcaaaaaauacaacuuagguacgagcaucaaggccgaagcuuucuuaagcguucacgaguuauuaccaaugauguucuacuacuuacucuuaaaaaccgaaaacaccaaaaacgacaacaaagucgguggcaaaaaagaaacaaaaaaacagggcaaacauaaaauagaagcgaucauagaaagcaagauaaaagauaucuaugcauuauacgaugcauuugcaaacggagaaaucaauagugaagaugaacucaaagaauaucuaaaaggaaaagacauaaagauuguccauuuaccuaagcaaaugaucgcuauauuaaaaaacgaacauaaagauauggcagagaaagcagaagccaaacaagaaaaaaugaaauuagcaacagaaaacagacucaaaacacucgauaaacaacuaaaaggcaaaauccaaaacgggaaacgauacaacucagcaccaaagagcggagaaauugcaagcuggcuuguuaaugauaugaugcgcuuucaaccaguacaaaaggaugaaaacggagaaucccucaacaauagcaaagccaacagcacagaauaccaacuccugcaacgaacacuagccuucuucggaucagaacacgaaagauuggcacccuacuuuaaacaaaccaaauuaauagagucauccaauccucacccauuucuaaaugauacagaaugggaaaaaugcuccaacauccucucuuucuaccgcucuuauuuaaaagcuagaaaaaacuuccuugaaucauuaaaaccagaagauugggaaaaaaaccaauacuucuuaauguuaaaagaaccuaaaaccaaucgagaaacccuaguucaaggguggaaaaauggauucaauuuaccccgaggcuuuuuuacagaaccgauacgaaaaugguucauggaacacuggaaaucaauaaaaguagaugaucuaaaaagagucggccuaguugcaaaaguaaccccccuauuuuuuucagagaaauauaaagauucgguacaacccuucuauaauuaccccuucaauguaggagacguuaacaaacccaaagaagaagacuuccuucaucgagaagagagaauagaauugugggacaagaaaaaagacaaauuuaaagguuacaaagccaaaaaaaaauuuaaagaaaugacagacaaagaaaaagaagaacaccgaucauaccucgaauuccaaagcuggaauaaauuugaacgagaguuaagauuaguucgaaaccaagauaucguaaccuggcuacugugcacagaacuaauagacaaauuaaaaauagaugaacuaaauauuaaagaacuaaaaaaacuaaggcuaaaagacauaaacaccgacacggcaaaaaaagaaaaaaacaacaucuuaaauagagucaugccuauggaacuaccaguaacaguauacaaaguuaauaaaggcggauauauaaucaaaaacaaaccauuacauacaaucuauauaaaagaagccgaaacaaaacuacucaaacaaggaaauuuuaaagcacucguaaaagacagaagacucaacggccucuucucauucguaaaaacaccaucagaagcugaaagugaaucaaacccgauaucaaaauuaaggguagaauacgaacuugguaaauaccagaaugcaagacuagacauaauagaagacaugcuugcacuagaaaaaaaacuuauagauaaauacaauucacuagacacagacaacuuccacaacauguugacaggauggcuagaauugaaaggagaagcaaaaaaagcccgauuucaaaacgacgugaagcuuuuaacagcaguuagaaacgcauucagucacaaucaauauccuauguacgacgagaacuuauucggaaauaucgaaagauucucacucuccagcucaaacauuauagaaaguaaaggucuagacauagcagcaaaacuuaaagaggaaguaucaaaagcagccaaaaaaauacaaaacgaagaggacaacaaaaaagaaaaagaaacauaa

SEQ ID NO: 11932 - RNA, 3378 nt, Artificial Sequence
  Cas13b variant__Prevotella intermedia__KJJ86756.1__Cas13b
augaaaauggaagacgacaaaaaaaccacugaaagcacaaauauguuagacaauaaacacuucugggccgcauucuuaaacuuagcaagacacaacguauacaucacagugaaucacauaaacaaaguauuagaacuuaaaaacaaaaaagaccaagacauaauuauagacaacgaccaagauaucuuagcuaucaaaacacauugggagaaaguaaacggagaccuaaauaaaacagaaagguugcgagaauugaugaccaagcacuuuccauuuuuagaaaccgccaucuauacaaaaaacaaagaagacaaagaagagguaaaacaagagaaacaagccgaagcccaaucauuagaaagccuaaaagauugccuguuccuuuuccuagaaaaacugcaagaagcccgcaacuauuauucacacuauaaauacucagagucuaccaaagaaccaauguuagaggaagggcuucucgaaaaaauguauaacauauuugaugauaacauacagcucguaauaaaagacuaucaacauaacaaagacauaaacccagacgaagacuucaaacaccuagacagaaaaggacaauuuaaauacucauucgcagauaacgaaggaaauauaacagaaagcggccuauuauuuuuuguuucucuauucuuagaaaaaaaagaugcgauauggaugcagcaaaagcucacaggcuuuaaagacaauagagaaagcaaaaaaaaaaugacacaugagguauucugucguagacgaaugcuacuaccuaaauuaagacuagaguccacccaaacacaagauuggauccuacucgacaugcuaaaugaacuuauacgcuguccaaaaucucucuacgaaagauuacaaggggaauaccgaaaaaaauuuaacguaccauucgacagugccgacgaagauuacgacgcagaacaagagccauuuaaaaacacccuaguaagacaucaagauagauucccauacuucgcauuaagauacuuugacuauaacgaaaucuucacaaacuuaagauuucaaauagaccuaggaaccuaucacuuuagcauauacaagaaacuuauaggaggacaaaaagaagacagacauuugacucauaagcucuacggguucgaaagaauacaagaauucgcaaaacaaaacagaccagaugaauggaaagcacuagugaaagaucuagacacauaugaaaccuccaacgaaagauacauaagugaaacaacgccucauuaucaccuugaaaaucaaaaaauuggaauaagguuuagaaacggcaauaaagaaauauggccaagccucaagacaaacggcgagaauaacgaaaaaagcaaauacaaacuagacaaaccauaucaagcggaagcauuucucagcguacaugaauugcuuccaaugauguucuacuaucuacuacuaaaaaaagaagaaccuaacaaugauaaaaagaacgcuaguaucguagagggauuuaucaaacgagaaauuagagauauguauaaauuauacgaugcauucgcaaacggagaaauuaacaacauaggggacuuagaaaaauacugcgaagacaaagguauaccgaaacgacauuuaccaaagcaaauggucgcaauauuguaugacgaaccaaaagacaugguaaaagaagccaaacgaaaacaaaaagaaaugguaaaagauacaaaaaagcuauuagcaacucuagaaaaacaaacccaagaagaaaucgaagauggaggaagaaacauaaggcucuuaaaaagcggcgaaauugcccgauggcuaguaaacgauaugaugagauuccaacccguccaaaaagacaacgaggguaauccuuuaaacaacucaaaagcuaauucgaccgaauaucaaaugcuucaaaggucacuagcauuauacaacaaagaagaaaaaccuacccgauacuuuagacaaguuaaccuaauaaacaguucaaacccccacccuuucuuaaaauggacaaaaugggaagaauguaacaacauacuaucauucuacagaaauuauuugacaaaaaaaauagaauuucugaacaagcugaagccggaagacugggaaaaaaaccaauauuuccuaaaacuaaaagaaccaaaaaccaaccgcgaaacauuaguacaagguuggaaaaaugguuuuaaccuaccacgcggaauauucacagaaccaaucagagaaugguuuaaacgacaucaaaaugacucaaaggaauacgagaaagucgaagcacucaaacgcguuggauuaguuacaaaagucauuccacucuucuucaaagaagaauacuucaaagaagaugcccagaaagaaauaaacaauuguguacaaccguucuacucauucccauauaacguaggaaacauccauaaaccagacgaaaaagacuuccucccaagugaagaacgaaaaaaacuuuggggugauaaaaaagacaaauucaaaggcuauaaagcaaaagucaaauccaaaaaacuaaccgacaaagaaaaagaagaauacagaagcuaccucgaauuccaguccuggaacaaauucgaacgagaacuacgacuaguaagaaaccaagacauaguaacauggcugcuauguacugaauuaauagacaaaaugaaaguagaagguuugaacgucgaagaauuacaaaaacuaagacuuaaagacauagacacagacacugccaaacaagaaaaaaacaacauacuaaacagaauaaugccaaugcaauuaccuguuacaguauacgaaauagacgacucucauaacaucguaaaagacagaccacuccacacaguauauauagaagaaacaaaaacaaaacuacucaaacaaggaaacuucaaagcacuaguaaaagaccgcagacucaauggauuauuuagcuuuguugauaccagcaguaaagcagaauuaaaagacaaaccuaucucaaaaucuguaguagaauaugaguuaggcgaauaucaaaacgcacggauagagacuauaaaagacaugcuauugcucgaaaaaacgcuaauaaagaaguacgaaaaauuaccuacagacaacuucucagacaugcuaaacgguuggcuagaaggcaaagacgaaagugauaaagcccguuuccaaaacgacguaaaacuacuuguagcaguaagaaaugcauucagucauaaucaauauccaaugcgaaaucgaauagccuucgccaacauaaacccuuuuucccucuccuccgcagauauaagugaagaaaaaaaauuagauauagcuaaccaacuaaaagacaaaacucauaaaauaauaaaaaaaauaaucgaaauagaaaaaccaauagagacgaaagaauga

SEQ ID NO: 11933 - RNA, 3378 nt, Artificial Sequence
  Cas13b variant__Prevotella pallens__EGQ18444.1__Cas13b
augaaagaagaagaaaaagggaaaacuccagugguaucaacauauaacaaagacgauaaacauuucugggcugcuuuccuaaaccuugcuagacauaauguauauaucacggugaaccacaucaacaaaauacuaggugaaggagaaauaaauagagacggauacgaaaacacacuagagaaaaguuggaacgaaauaaaagauaucaacaagaaagaccguuuaagcaaacuaaucauaaaacacuucccauucuuagaaguuacaacauaccaaagaaacagugcagauaccaccaaacaaaaagaagaaaaacaagcagaagcccaaucacucgaaagccuuaagaaaucuuucuucguauucauauacaaauuaagagaccucagaaaucacuauucgcauuacaaacacucaaaaaguuuagaacguccaaaauucgaagaagaucuccaagaaaagauguacaacauauucgaugccaguauacaauuagucaaagaagauuauaaacacaacacagacauaaaaaccgaagaagauuucaaacaccucgacagaaaaggacaguucaaauacucauucgccgauaaugaagguaauauaacggaaagcggacuacuauucuucgugagccuuuuccuagaaaagaaagacgcuauaugggugcaaaagaaacuugaaggauucaaaugcucaaacgaaagcuaccagaaaaugaccaacgaaguauucugcagaucaagaaugcuacuaccgaaauuaagacuacaaucaacccaaacccaggacuggauacugcucgauaugcuaaacgaauuaauacgaugcccuaaaagccuauaugaaagauuaagagaagaagacaggaagaaauuuagaguuccuauagaaauagccgacgaagauuacgacgcugaacaggaacccuuuaaaaaugcauuagucagacaccaggacagauuuccguacuucgcacuacgauauuucgauuauaacgaaaucuuuacaaaucuuagauuccagauagauuuaggaacguaccacuuuuccauauacaagaaacaaauaggugacuacaaagaaagccaccaucuaacacauaaacuauauggauucgaacggauucaggaauuuacuaaacaaaacagaccagacgaauggagaaaauuuguaaaaacuuuuaauaguuuugaaacaucaaaagaaccuuacauuccagaaacuacgccacauuaccaccuagaaaaccagaaaauaggaauaagauucagaaacgacaaugacaaaauauggccaucacuaaaaaccaacucggagaaaaacgagaaaucaaaauacaaacuagacaaaaguuuccaagcagaggcauuucucucaguucacgaacuauuacccaugauguuuuauuaccucuugcuaaaaacagaaaacacugauaacgacaacgaaauagaaacuaaaaagaaagaaaauaaaaacgauaaacaagaaaaacauaaaauagaagaaauaaucgaaaauaaaauaacagaaaucuacgcauuauacgaugcauuugccaauggaaaaaucaauaguauugauaaacuagaagaauacuguaaaggaaaagauauagaaauaggacacuuaccaaaacaaaugauugcaauauuaaaaucagaacacaaagauauggcaaccgaagcaaaacggaaacaagaagaaaugcuagcggacguacaaaaaucguuagaauccuuagauaaucaaauaaaugaagaaauagaaaauguggaaaggaaaaauucuucacucaaaaguggagaaauugcgucuuggcuaguaaacgacaugaugcgauuccaaccuguacaaaaagacaacgaaggaaacccacuaaauaacagcaaagcaaauagcaccgaauaucaaaugcuacaacguagccuagcauuguacaauaaagaagaaaaacccacgcgauacuucagacaaguaaaccuaauagaaagcucaaacccacauccauuccuaaacaauacugaaugggaaaaauguaauaauauauuaucguucuacagaucauacuuagaagccaagaaaaacuuccuagaaucacucaaacccgaagauugggagaaaaaccaauacuuuuuaaugcuuaaagaacccaaaacaaacugcgaaacgcuaguacaaggauggaaaaauggguucaaccuaccucgcggaauauucacugaaccaauaagaaaaugguucauggaacaccggaaaaacauaacaguagcugaauuaaaacgcguuggccuaguggcuaaaguuauaccuuuauucuucuccgaagaauauaaagauaguguacagccuuucuacaauuaucuuuucaauguaggaaacaucaauaaaccagacgagaaaaacuuccuaaacugugaagaaagaagagaacuucucaggaaaaagaaagacgaauuuaagaaaaugacggacaaagaaaaagaagaaaaucccagcuaucuagaauuucaaucauggaacaaauucgaaagagaacugagguuaguacgaaaccaagacauaguaacauggcuacuaugcauggaauuauucaauaaaaagaaaauaaaagaauuaaacgucgagaaaauauaucucaaaaauauuaacacaaacacaaccaagaaagagaaaaacaccgaagagaaaaacggcgaagagaaaaucauaaaagagaaaaauaauauacuaaacagaauaaugccgaugcgcuuaccaauaaaagucuauggaagggaaaauuucagcaaaaacaaaaagaagaaaaucagaagaaauacauucuuuacaguguacauagaagaaaaaggcacuaaacuccucaaacaaggcaauuucaaagcauuagaacgugacaggagacuagggggauuauucaguuuuguaaaaacacacucaaaagcagaaucuaaaaguaacacaauaaguaaaagucgcgucgaauacgaacucggagaauaucaaaaagcucgaaucgaaauaauuaaagauauguuagcauuggaagaaaccuuaauagacaaauacaacucccucgacacggacaacuuccacaauaugcuaacuggauggcugaaauuaaaagacgaaccugacaaagccagcuuccaaaacgacguggaccuauuaauagcaguccgaaacgcauucucccauaaccaguacccaaugagaaacagaauugcauucgcuaacauaaacccauucucacuaucaucagcaaauaccucagaagaaaaaggucuuggaauagcaaaccaauuaaaagacaaaacacauaaaacgauagaaaagauaauagaaauagaaaaaccaauugaaacuaaagaauaa

SEQ ID NO: 11934 - RNA, 3453 nt, Artificial Sequence
  Cas13b variant__Prevotella saccharolytica__EKY00089.1__Cas13b
augauggaaaaagaaaauguucaaggaucucacaucuacuaugaacccacagacaaaugcuucugggcagcauucuauaacuuagcuagacacaacgcauaccuaacaauagcccauauaaauagcuuuguaaauucaaaaaaagguauaaacaacgacgauaaaguucuagacaucaucgaugauugguccaaauuugauaacgaucuacuaaugggggcacgccugaacaagcuaauauuaaaacacuuuccauuucuaaaagcuccacucuaccaacuugccaaacgaaaaacuagaaaacaacaaggcaaagaacaacaagauuacgaaaagaaaggugaugaagacccagaaguaauucaagaagcgaucgcaaacgccuucaaaauggcgaauguacgaaaaacccuacaugccuucuuaaaacaauuggaagaucuacgcaaucauuuuucccacuacaauuauaauucaccagcaaaaaaaauggaaguaaaauuugacgauggauuuugcaacaaacucuacuacgucuucgacgcugcacuucaaaugguaaaagaugacaauaggaugaacccugaaauuaacaugcaaaccgauuucgagcaucuaguucgauuaggaagaaacagaaaaaucccaaauacauucaaauacaauuuuacuaacucagacgguaccaucaauaauaauggacuacuauucuucguaucacuauuccucgaaaagagagaugccauauggaugcaaaaaaaaauaaaaggauucaaaggcgggaccgaaaacuacaugagaaugacuaacgaaguauucugcagaaauaggaugguaauccccaaacuccgacucgaaacagauuaugacaaucaccaacuaauguuugacauguuaaacgaacuaguuagguguccucuaucauuauauaaacgacuuaaacaagaagaucaagacaaauuucguguaccgaucgaauuuuuagacgaggacaacgaggcugacaaccccuaccaagagaaugcaaauucugaugaaaauccaacagaagaaacggaucccuuaaaaaauacucuaguaaggcaucaacaccgauucccauauuucguacucagauauuucgaccucaaugaagucuucaaacaauuacgauuucaaauaaaucugggauguuaucauuucucaauauaugacaaaaccauaggggaacgaacagagaaacgacaccuaacaagaacauuauucgguuuugauagauuacaaaauuucucagucaaacuacaaccagaacauuggaaaaacaugguaaaacacuuggauacagaagaaucguccgacaaacccuaccuaagugaugcaaugccccacuaccaaaucgaaaacgaaaaaaucggaauacacuucuuaaaaacagacacagaaaaaaaagaaacaguauggccuucacuagaaguagaagaagucucaagcaauaggaacaaauacaaaagcgaaaaaaaccugacagcagaugcauuccuaucuacucaugaacuccucccaaugauguucuauuaccaacuccucucauccgaagaaaaaacgcgagcagcugcaggugauaaaguacaaggugucuuacaaucauauagaaaaaaaauuuucgauauuuacgacgauuucgccaacggaaccauaaacagcaugcagaaacuagacgaaagauuagcuaaagauaacuuauuaagaggaaacaugccccaacaaauguuagcaauacuagaacaccaagaaccagauauggaacaaaaagcaaaagaaaaguuagauagguuaauaaccgaaacaaaaaaacguauuggaaaauuagaagaucaauucaagcaaaaaguccgcauaggcaaaaggagagcagaucuaccaaaagugggaucaauagcagauuggcuaguaaaugauaugaugcgauuccaaccagcaaaaaggaacgcagacaauacaggagucccagacucaaaggcaaacucuacggaguaucgcuuacuccaagaagcauuagcauucuacucugccuauaaagacagacuagaaccguacuuuagacagguuaaucuaauaggaggaacgaauccacauccauuuuuacacagagucgacuggaaaaaauguaaucacuuacuauccuucuaccaugauuaccuagaagccaaagaacaguaucuaagucaccuuucuccagcagacuggcaaaaacaccaacauuuucugcuacucaaaguacgaaaagacauacaaaacgaaaaaaaagauuggaaaaaaucacucguagcaggcuggaaaaauggauucaaccuaccaaggggauuauucaccgaaucgauuaaaacuugguucucaacagacgcagacaagguucaaauaacugauacaaaauuauucgaaaaccgaguuggucuuauugccaaacuaauaccacucuauuacgauaaaguuuacaacgacaaaccacaaccauucuaccaauauccauucaauauaaaugaucgguauaaacccgaagauacaagaaaacgcuuuacugcggccucuuccaaauuauggaacgaaaaaaaaauguuauauaaaaaugcacaaccagauucgucagacaagauagaauauccacaauaucuagacuuuuuauccuggaaaaaguuagaaagagaacuuagaaugcuaagaaaccaggacaugaugguaugguuaauguguaaagaucuauucgcacaaugcacgguugaaggaguagaguuugccgaccuaaaacuaucacaacuugaaguugauguaaacguacaagacaaccucaacgucuuaaauaauguaucuucaaugauccucccacuuucuguauacccuuccgacgcccaagguaacguauuacgcaauucaaaaccacuccauacaguauacguucaagaaaauaacacaaaacuacuaaaacaaggaaacuuuaaaucauuacucaaagaccguagauuaaacggauuauuuucuuuuaucgcagccgaaggcgaagaccuccaacaacacccccuuacuaaaaauagacuagaauaugaacugucaauauaucaaacaaugcgcauaagcguauucgaacagacacuacaauuagaaaaagcaauucuaaccagaaauaaaacauuaugcgguaacaacuucaauaauuuacuaaacuccuggucagaacaccgaacugacaaaaaaacacuccaacccgauauagauuuuuuaauagcaguacgaaaugcauucucacacaaucaauacccgauguccacuaauacuguaaugcaagguauugaaaaauucaauauucaaaccccaaagcuagaagaaaaagacggacuuggaauagcaucucaacuagcaaaaaaaaccaaagacgcagcaucaagacuacaaaacauaauaaacggugguacaaauuaa

SEQ ID NO: 11935 - RNA, 3969 nt, Artificial Sequence
  Cas13b variant__Prevotella sp.__WP_036929175.1__Cas13b
augucaaaagaaugcaagaaacaacgccaagaaaagaaacgcagauugcaaaaagcaaauuuuuccauaaguuuaacgggaaaacacguauucggugcauauuuuaauauggccagaaccaauuucguaaaaaccauaaacuacauuuuaccgaucgcaggaguaagaggaaauuauagugaaaaucaaauaaauaaaaugcuacacgcgcuauuucuaauccaagccggucgaaacgaagaauuaacaacagaacaaaaacaaugggagaagaaacuccgacucaauccugaacaacaaacaaaauuucaaaaacuucuguucaagcacuuuccuguacuuggaccaaugauggcugauguagccgaccacaaagccuauuuaaauaaaaagaaaucaacaguacagaccgaggaugagacauucgcuaugcucaaaggaguaucucuagcagauugucuugauauuauaugccuaauggcagauacauuaacugaaugcagaaauuucuacacacacaaagaccccuacaacaaaccaucacaauuagcagaccaauauuuacaucaagaaaugauugcaaagaaacuugauaaaguuguuguugcuagcagaagaauacuaaaagauagagaaggucuuucugucaacgaaguagaguuccucacagguaucgaccaucuacaucaagaaguacucaaagaugaguucgguaacgcaaaaguaaaagacggaaaaguuaugaaaaccuucgucgaguacgacgacuucuauuuuaaaauaucagguaaaagauuaguuaacggauauacugugacuaccaaagacgacaaaccuguaaacguuaacacgaugcugccggcgcuaagcgacuucggucuacuauacuucuguguacuauuucuaucgaaaccuuacgccaaauuauuuaucgaugaagugcgcuuauuugaauauucaccauucgaugauaaagaaaacaugauaaugucggaaauguuaagcauuuaucgcauaagaacaccaagauuacauaaaaucgacucucacgauucaaaagcuacacuagccauggacauauucggugaacuaaggcgcugcccaauggaauuauauaacuuauuagacaaaaaugccggacaaccauucuuccacgaugaaguaaaacauccaaacagccacacaccagaugucucaaaacguuugagauacgaugaucgguuucccacacucgcauugagauacauagaugagacggaauuauucaaacggauccgguuucaacuacagcucgguagcuuucgcuauaaguucuaugacaaagaaaacugcauagacggacgcguaagaguacgccguauacaaaaagaaaucaacgguuauggcagaaugcaagagguagcugauaaaagaauggacaaauggggagaccuaauacagaaaagagaagaacgaucaguuaaacuagaacaugaagaacucuacauaaauuuagaucaauuuuuggaggacacugccgacucgaccccauauguaacagaccgacguccagcuuacaauauccaugcaaacagaaucgggcuguauugggaagauucccaaaacccaaaacaauacaaaguuuuugacgaaaacgguauguacauaccugagcuuguugucacugaagauaagaaagcuccuauaaaaaugccagcaccuagaugcgcacuuucaguauacgacuugccugcgaugcuauucuacgaauaccucagagagcaacaagacaacgaguucccuuccgcagaacaagucauaaucgaauaugaagaugauuacagaaaauucuucaaagcaguagccgaaggaaaauuaaaaccauucaaaagaccaaaagaauuuagagauuuccucaagaaagaauacccaaaauuacguauggccgauauaccuaagaaauuacaacucuuccuauguucacacggauuauguuauaacaacaaaccagaaaccguuuacgaaaggcuagaccgauuaacuuuacaacaccuagaagaaagagaauuacauauucaaaaucgucuagaacacuaucaaaaagacagagauaugaucggcaauaaagauaaccaauacgggaagaaaaguuuuagugaugucagacauggggccuuagcaagauaccuagcacaaagcaugauggaauggcaaccgaccaaacucaaagacaaagaaaaaggacaugacaaacuaaccggucugaacuacaacguucuaacugcauacuuagcuacauacggccacccgcaaguccccgaagaagguuucacaccaagaacacucgaacaaguccuuaucaaugcucauuuaauaggaggauccaacccacaucccuuuauuaauaaaguacuagccuuaggaaaucguaauauagaagaacuauaucuucauuacuuagaagaagaacucaaacauauacgaucccgcauacaaucacuuucauccaauccuagugacaaagcacuaucagcuuuaccuuuuauucaccaugauagaaugcgauaccacgagcgcaccucagaagagaugauggcauuagcagcaagauauacaacaauacaauuaccugacggguuauucacuccauacauuuuagaaauauuacaaaaacauuacacagaaaacucagauuuacagaaugcuuugagccaagaugucccgguaaaacucaacccgacaugcaaugccgcuuaucuuauaacauuauucuaucaaacaguacuuaaagauaaugcacaaccuuucuaccuaagugauaaaacauauacacgcaacaaagauggugaaaaagccgaaaguuuuagcuuuaaacgcgcuuacgaauuguucucaguacuaaauaacaacaagaaagauacauucccauuugaaaugauuccucuuuuucucacaucagacgaaauacaggagcgcuuaucagccaaauuacuggauggcgacggaaacccagugcccgaaguaggagaaaaaggaaaaccagcuaccgacucacaaggcaauaccaucuggaaacgaagaaucuacagugaaguagacgacuaugcugaaaaacuaacagauagagauaugaaaauuucauuuaaaggugaaugggaaaaacuucccagauggaaacaggacaaaauaauaaaacguagagacgaaacacgaagacagaugagagacgaacuauuacaaagaaugccuagauacauaagagacauaaaagacaacgaaagaacacuucgaagauacaaaacacaagacaugguacuuuucuuacucgcggagaaaauguucacaaacaucaucagugaacaaucgucagaauuuaauuggaaacaaaugagauuaucgaaagucuguaacgaagcauucuuacgccaaacacucacauuuagagucccuguuaccguaggagaaacuaccaucuacguugaacaagaaaacaugucacuuaaaaauuauggggaauuuuauagauuccugaccgaugauaggcuuaugagccuacuaaauaacaucguugaaacauuaaaaccgaaugaaaacggugaccuagucaucagacacaccgacuuaaugucagaacuagcugccuaugaccaguauaggucuacaauuuuuauguuaauccagucgauugaaaaucuuauuauaacuaauaacgcaguccuugaugacccugaugcugauggguuuuggguacgagaagaucugccgaaaagaaacaacuuugcuuccuuacuagaacuaaucaaccaacuaaacaauguagaacuaacagacgacgaaaggaaacuuuuaguagccauaagaaacgcguucucccacaauagcuauaacauagauuuuagucuaauuaaagacguuaaacaucuaccagaaguggcgaaaggaauacuucaacacuuacaauccauguuaggagucgaaauaacaaaauag

SEQ ID NO: 11936 - RNA, 3384 nt, Artificial Sequence
  Cas13b variant__Prevotella sp.__WP_007412163.1__Cas13b
augcaaaaacaagauaaacuauucguagaccggaaaaagaacgccauauuugcuuuuccaaaauauauaacaauuauggaaaaucaagagaaaccagaaccuauauauuaugaacuaacagauaaacauuucugggcagcauuucucaaccuagcacgacacaauguuuacacaaccauuaaucauauaaaccgccgacuagaaauagcagaacuaaaagacgauggauauaugauggguauaaaaggcucauggaacgaacaagcaaaaaaguuagauaaaaaggucagacuacgagaucucauaaugaaacacuucccauuucuagaagcagccgcauaugaaauaaccaauuccaaaagcccaaauaacaaagaacaaagagaaaaggaacaaucugaagcguuaucuuuaaauaaccuaaaaaacguccuauuuaucuuccuagaaaaacuacaaguauuaagaaacuauuacucucauuauaaauacucugaagaaucaccaaaaccaaucuucgaaacaucucucuuaaagaacauguauaagguauucgacgcaaacguaagguuaguaaaacgagauuauaugcaccaugaaaacauagacaugcaacgcgauuucacccaucuaaacaggaaaaaacaagucggaagaaccaaaaauaucauagauagccccaacuuccacuaccacuucgcugacaaagaaggaaacaugacaauugcaggauuacuauuuuucguaagucuauucuuagauaaaaaagacgcaaucuggaugcaaaaaaaacuuaaaggcuucaaagaugguaggaaucuucgagaacaaaugacaaacgaagucuucugccgaaguagaaucucuuuaccaaaacucaaacuagagaacguccagacuaaagauuggaugcaacucgacaugcuaaaugaacugguuagguguccuaaaagccuauacgaaagacuccgagaaaaggaucgcgaaucauuuaaaguucccuuugauauauucucagacgacuaugacgcagaagaggaaccauuuaagaacacacuugucagacaucaagaucgauuccccuauuuuguauuaagauauuuugaccuaaaugaaauauuugagcaacuaagauuucaaauagaccucggcaccuaccacuucucuauauauaacaaaagaaucggcgacgaggaugaaguccgacacuuaacccaucaccuuuacggauucgcgcgaauacaagacuuugcgccacaaaaucaacccgaagaauggcgaaaauuaguuaaagaccuugaccauuucgagacuucacaagaacccuauauaucuaaaacagccccccauuaucaucuagaaaaugaaaaaauaggcauaaaauucugcuccacgcauaacaauuuauucccaagcuuaaaaagagaaaaaacguguaacggacgcucaaaauucaauuuagguacacaauucaccgcugaagcauuuuuaucuguacacgaacuucucccuaugauguuuuauuaucucuuacucaccaaagacuacagcagaaaagaaucggcagacaaaguugaaggaauaaucagaaaagaaaucucaaauaucuaugcuauuuacgaugcauucgccaauaaugaaaucaacucuauugcagaccuaacauguagauuacaaaaaacaaauauacuccaaggccaccuacccaaacaaaugauaucuauacuagaaggacgccagaaagacauggaaaaagaagcagaaagaaaaaucggcgaaaugauagacgacacucaaagacgauuagauuuauuauguaaacaaacaaaucaaaaaauaagaauagggaaaaggaacgcaggacuacuuaaaucuggaaaaauagccgauuggcucguauccgacaugaugcgauuccaaccaguucaaaaagacacaaacaaugccccaauaaacaauuccaaagcuaacuccacagaauaccgaauguuacaacacgcccuugcacucuucggaucugaaagcuccagacucaaagccuauuucagacaaaugaaucucgucggcaacgccaacccgcacccauuucucgccgaaacccaaugggaacaccaaacuaauauauuaucauucuacagaaacuaccuugaagcaagaaaaaaauacuuaaaaggacuaaaaccacaaaacuggaaacaauaucaacacuuccuaauuuuaaaagugcaaaaaacaaaccguaauacauuaguaacaggguggaaaaacagcuuuaaucucccacgagguauauuuacacaaccaauacgcgaaugguucgaaaaacauaacaacuccaaaagaauauaugaccaaauauuaucuuuugauaggguaggauucgucgccaaagcuauaccacuauacuucgccgaagaauauaaagacaauguccaaccauuuuacgauuaccccuuuaauauaggaaauaaauuaaaaccccaaaaaggccaauucuuagauaaaaaagaacgcguagagcucuggcaaaaaaauaaagagcucuucaaaaauuauccaagcgaaaaaaacaaaacagacuuagcauaucuggacuuccuaaguuggaaaaaauucgaacgggaauuaagauuaauaaaaaaccaagacauuguaacauggcugauguucaaagaauuauuuaaaacaacuacaguagaaggauuaaaaaucggagaaauucaccucagagauauugauacaaacacagcaaacgaagaaucaaacaauauccucaaccgaauaaugccaaugaaacuaccagugaaaacguacgagaccgacaauaaaggcaacauacuaaaagagcgaccacucgcaacauucuauaucgaagaaacugaaacuaaagucuuaaaacaaggcaauuucaaaguacuagcaaaggauagacgacuaaacggccuacugucauuugccgaaacaaccgauauugaucuagaaaaaaacccaauuacaaaauuaagcgucgauuacgaacuuaucaaauaucaaaccacacgaauauccauuuuugaaaugacacuuggucuagagaaaaaauuaauagauaaauauucaacacuaccuaccgacagcuuccgcaauaugcuugaaagauggcuacaguguaaggcaaaucgaccagaauuaaaaaacuacguaaacucauuaauagccguucgaaaugcguucucacacaaccaauacccuauguaugacgccacacuguucgcugaaguaaaaaaauucacacuauucccuucaguagauacaaaaaaaaucgaguugaacaucgcaccacaguuacuagaaauaguaggcaaagccauuaaagaaauagaaaaaucagaaaacaaaaauuaa

SEQ ID NO: 11937 - RNA, 3273 nt, Artificial Sequence
  Cas13b variant__Prevotella sp.__WP_044072147.1__Cas13b
augaauauaccggcguugguugaaaaucagaaaaaguacuucggaacauacaguguaauggcaaugcuaaacgcacaaacgguacuagaccacauacaaaaaguugcagacauagaaggugaacaaaaugaaaauaaugaaaaucucugguuccaucccgucaugagccauuuauacaacgcaaagaacggcuaugacaaacaaccugagaaaacaauguuuauaauugaacgauuacaauccuacuucccauuucuuaagauaauggcugaaaaccaaagagaauauucaaacggaaaauacaaacaaaauagaguagaaguaaacucuaacgacauauucgaaguacuuaaaagagcauuugggguccuaaaaauguacagggaccaagcaagucauuauaaaaccuacgaugaaaaacuaauagacggaugcgaguuccuuacaaguacagaacaaccccuaagcggaaugauaaauaauuacuauacaguagcgcuucguaacaugaacgaacgauauggauauaaaacagaagaucuagcuuuuauacaagauaaaagguucaaauuuguuaaggaugccuacgggaaaaagaaaucccaaguaaacaccggauuuuuccuaucacuacaagacuauaacggggacacccagaagaaauuacaccucucgggaguagguauagcacuacuaauauguuuauuccuagauaaacaguacaucaacauauuccuaucaagacuaccaaucuucagcaguuauaacgcacaaucagaagaacguaggauaauaauacgcuccuuuggaaucaacagcauaaaacagccaaaagauagaauacauagugaaaaaucaaauaaaagcgucgccauggacaugcuaaaugaaauaaaaagauguccaaaugaacuauucgaaacauugucagcagaaaaacaaucuagguuucgaaucauauccaacgaccauaaugaaguauugaugaaacguucauccgaucgauuuguaccacuucuuuuacaauacaucgauuacgguaaacuauucgaccacauacgauuucacguaaacaugggcaaacuaagauacuuauuaaaagcugacaaaacauguauagacggacaaacacgaguaagaguaauagaacaaccucucaacggcuuugggaggcuagaagaaguggaaaccaugcgaaaacaagaaaacggcacguuuggaaacagcggaauacgaauaagagacuuugaaaauaugaaacgcgaugacgcaaacccugcuaacuauccauacauuguugacaccuauacacacuacauccuagaaaacaacaaaguugaaauguucaucucagacgaagaaaccccugcaccucuucuaccagucauagaagacgaccgauauguuguaaaaacaauaccuuccugucgaaugaguacgcuagaaaucccagcaauggcuuuucauauguuccuauucggcuccaaaaagacagaaaaacuaauaguugacguucauaauagauacaaaagguuauuuaaagcaaugcaaaaagaagaaguaacugccgaaaacauagcaucuuuuggcauagcagaaagugaccuaccucagaaaauuauagacuuaauaaguggcaaugcucacggcaaagacguagaugcauucauccgccuaacgguagacgacauguuagcagacacugaacgaagaauaaaaagauuuaaagacgacagaaaaaguauacguucggcagacaauaaaaugggcaaaagaggguuuaaacaaaucucaacuggcaaacuugcagacuuuuuagcaaaagauaucguacuauuucaaccaucaguaaacgauggagaaaacaaaauaacaggcuuaaacuacagaaucaugcaaucagcgaucgccguauauaacaguggagaugacuacgaagcaaaacaacaauuuaaacuaauguuugaaaaagcacgccucauaggaaaaggaacaacagaaccccacccauucuuauacaaaguauucguacgaucaauaccagcaaacgcagucgacuuuuacgaacgcuaccuaauagaaagaaaauuuuacuuaauaggcuugucaaaugaaauaaagaaaggaaaucgaguagauguucccuucauaagaagagaccaaaacaaauggaaaacgccagcuaugaaaacacuaggaagaauauacgaugaagauuuaccagucgaacuacccagacaaauguucgauaacgaaaucaaaucccaucuaaaaucucuaccucaaauggaagguauagacuuuaacaaugcuaauguaaccuaccugaucgcagaauauaugaaaagaguuuuaaacgacgauuuucaaaccuucuaucaauggaaaagaaacuacagauauauggacauguuacguggggaauacgacagaaaaggaaguuuacagagcugcuucacuucuguagaagaacgagaaggauuauggaaagaacgagcuuccagaaccgaaagauaucgcaaauuggccaguaauaagauaagauccaacagacaaaugcgaaaugcaucaagcgaagaaauagaaaccauauuagacaaaagauugaguaacucacgaaaugaauaccaaaaaucagaaaagguaaucagacgauaucgaguacaagaugccuuauuauuucuacuagcaaagaaaaccuuaacagaauuagcagauuucgauggcgaacgauucaaacuuaaagagauaaugccagacgcggaaaaagguauuuuaucagaaaucaugccaaugaguuucacauuugaaaaaggaggaaagaaauacacaauuacgagugaaggaaugaaacucaaaaauuacggcgacuuuuucguacuagccucggauaaacgaauaggcaacuuauuagagcuuguugguagugauacuguaucaaaagaggauauuauggaagaauuuaagaaauacgaucagugucgcccagaaauaucaucaauuguauucaaccuagaaaaaugggcauuugacacauacccugaacuaagcgcaaggguagacagagaagaaaagguagauuuuaaaucaauauuaaaaauacuucuaaauaauaaaaacauuaacaaagaacagucagauauccuuagaaaaauaagaaacgccuucgaccacaauaacuaucccgauaaaggcguaguagaaauccgagcauuaccagaaaucgccaugucaaucaaaaaggccuuuggagaauacgcaauaaugaaauaa

SEQ ID NO: 11938 - RNA, 3273 nt, Artificial Sequence
  Cas13b variant__Prevotella sp.__WP_042518169.1__Cas13b
augaacauuccagcuuuaguagaaaaccaaaaaaaauauuuugggacauauucaguaauggcgaugcuaaaugcccaaacuguacuagaucacauacaaaaaguagcagauauagaaggagaacaaaacgaaaacaacgaaaacuugugguuccacccagucaugucacaccucuauaacgcaaaaaauggauaugacaaacaaccagaaaaaacgauguucauuauagaacgauuacaaaguuauuuuccuuucuuaaaaauaauggcagaaaaccaaagggaauauucaaauggaaaauacaaacaaaacagaguagaaguuaauucuaacgacauauuugagguacuaaaaagagcauuuggaguacuuaaaauguaucgcgauuuaacaaaucacuauaaaacguaugaagagaagcuuauagacgguugugaauuccucaccucaacggaacaaccacuuucagguaugauauccaaauacuacacaguagcgcuaagaaauaccaaggaaagauacggauacaaaacagaagaucuagccuucauacaagacaauauaaaaaaaauaaccaaagaugcuuauggaaaaaggaaaagccaaguaaacaccggguucuuccucucacuacaagauuacaauggugacacacaaaaaaaauuacaucuaagcgguguaggaauagcacuacuaauaugccuauucuuggauaagcaauauauaaauauuuuucuaagcagacuaccaauauucucaucauacaacgcacaaagcgaggaacgucgaauaauaauacgauccuucgguauaaacucaauaaaauuaccaaaagauagaauccacagcgaaaaaucuaacaaaagcgucgccauggacauguuaaaugaaguuaaaaggugcccagacgaacuauuuacaacccuaucggcagaaaaacaaucacgguucagaauaaucucagacgaccacaaugaaguccuaaugaaaagaaguacggacagauucguaccccugcuacugcaauauauagauuacggaaaauuauucgaccauaucagauuucacguaaauaugggaaaacuuagguacuuacuaaaagcugauaagaccuguauagacggccaaacacguguuagagugauagaacaaccacuaaacggauuuggaagacuagaagaagcagaaacgaugcgaaaacaagaaaacggaacauuuggaaacucagggauaaggaucagagacuuugaaaacguaaaaagggaugaugccaacccggcuaacuacccauacauaguagauacauacacacauuacauacuagaaaauaauaaaguagaaauguuuauaucagacaagggaucaucagcuccacuauuaccauuaauagaagaugaucgauacguaguuaaaacuauaccauccugcagaaugagcacacuagaaauacccgcaauggcuuuccauauguuccuuuucggaaguaaaaaaacagaaaaacucaucgucgacguacacaacagauacaaaagacuauuucaagcuaugcaaaaggaagaaguaacggcagaaaauauagcaucauucggaauugcagaaucagaucucccacaaaaaauacucgauuuaaucuccgguaaugcacacgguaaagacgucgacgcuuucauaagacucacaguugaugacaugcuaacugacaccgaaaggaggauuaagagauucaaagaugacagaaaaucaauuagaucagcagacaacaaaaugggaaagcguggauucaaacaaauaucaacaggaaaacuagcagacuuccuggcaaaagacauaguacuauuccaaccaaguguaaacgacggcgaaaacaaaauaacaggacuaaauuacagaauaaugcaaagcgcaauagcaguauaugacagcggugacgauuacgaggcaaaacaacaauucaaauuaauguucgaaaaagcaagauuaauagguaaaggaacgaccgaaccccaucccuuucuauacaaagucuucgccagauccaucccggcuaacgcagucgauuucuacgagcguuauuugaucgaaagaaaauuuuauuugacggggcucuguaacgagauuaaaagaggaaaccgaguagacguccccuuuauaagacgagaucaaaauaaauggaaaacaccggcuaugaaaacccucggaagaauauacucagaagaccuaccggucgaacuaccccgacagauguucgacaaugaaaucaaaagucacuuaaaaucacucccacaaauggaaggaauagauuuuaauaacgcaaauguuacuuauuuaauugcugaauauaugaaacgaguacuaaacgaugauuuucaaaccuucuaucaauggaaaagaaacuaccauuacauggauaugcuaaaaggcgaauacgacagaaaagguucacuacaacauugcuucacaucuguagaagaaagagaaggauuauggaaagaaagagcaaguagaacagaacgcuacagaaaacucgcuucaaauaagauaagaagcaauagacaaaugagaaaugcguccucagaagaaauagaaacaauacuugauaaaagguuaucaaauugcaggaacgaguaccaaaaaagcgaaaaaguuauucgaagauaccgaguucaagacgcauugcuguuucuacucgcaaaaaaaacacucacagaacucgcagacuuugauggagaaagauuuaaacucaaagaaauaaugccagacgcagaaaaaggaaucuuaucggaaaucaugccgaugagcuucacauuugaaaaagguggaaaaaaguauacaaucacuagugaagggaugaaauuaaaaaacuauggcgauuuuuuugucuuagccagugacaaacgaauaggaaaccuacucgaacuaguaggaucagauaucguuucuaaagaagacauaauggaagaauuuaacaaauacgaccaaugcaggccagaaauuucaucuauaguauucaaucuagaaaaaugggcguucgacaccuaccccgagcuauccgcccgcguagaucgcgaagaaaaaguagacuucaaaaguauauuaaaaauacuucucaauaacaaaaacauaaauaaagaacaaucagauauacuucgcaaaauucgaaaugcuuuugaccauaacaacuaucccgauaagggaaucguagaaaucaaagcucuaccugaaaucgcuaugucaauaaaaaaggcuuuuggugaauaugcaauaaugaaauaa

SEQ ID NO: 11939 - RNA, 3273 nt, Artificial Sequence
  Cas13b variant__Prevotella sp.__WP_044074780.1__Cas13b
augaauaucccggcucuaguggaaaaucaaaaaaaauauuucggaacauauaguguaauggcaaugcuaaacgcacaaaccguacuagaccacauacaaaaaguagccgacauagaaggagagcaaaacgaaaacaaugaaaaccucugguuucacccaguaaugagucaccuauauaacgcaaaaaaugguuaugacaaacaaccagaaaaaacaauguuuauaauagaaaggcuccaaucguauuucccauuuuuaaaaauuauggcugaaaaccagcgugaauacuccaacggaaaauauaaacaaaaccgaguagaaguaaauagcaaugauauauucgaagucuuaaaaagagcauuugggguacuaaaaauguaccgagaucuuacaaaucacuacaagacuuaugaggaaaaauuaauagauggaugugaauuccuaacuagcacagaacagccauuuaguggaaugauuagcaaauacuacacuguagcucuccgcaacacaaaagaaagauacggauacaaagcagaagaucuugcauucauacaagauaauagguacaaauucacaaaagacgcuuacgggaaacgaaaaucacaaguaaauacaggaucguuucuaucauuacaagauuacaacggagauacaacaaaaaaauuacacuuaucgggaguaggaauagcacucuuaaucuguuuauuucuagauaaacaauacauaaaccuauuucuaucaagauuaccaaucuuuucaagcuacaacgcccaaucagaagaacgacgaaucaucauccguucauuuggaauuaauucuaucaaacaaccaaaagaccgcauacacagcgaaaagagcaauaaaaguguagcaauggauaugcuaaaugaaguaaaacgcugcccagacgaauuauucacaacacugucugccgaaaaacaaagcagguuccgaaucauaagcgaugaucacaacgaaguguuaaugaaaagaaguucugaccgguucguaccauuacucuugcaauacauugacuauggaaaacuauuugaccacauaagauuucacguaaauaugggaaaauuaagauaucuucuuaaagcggacaaaaccuguaucgauggucaaacaaggguacgaguuaucgaacagccauuaaacggauuuggaagacuagaagaaguagaaacaaugagaaaacaagaaaauggaacuuucggaaacucagguauuagaauaagagacuucgaaaacaugaaaagagaugacgcaaauccagcaaauuauccauauaucguugaaacauauacccacuacauauuagaaaacaauaagguagaaauguuuauaagcgaugaagaaaauccuacuccacuacuaccaguaauagaagacgacagauauguaguaaaaacaauaccuuccugcagaaugucaacucucgaaauuccagcgauggcauuccacauguuccuauuugggucagagaaaaccgagaaguugaucauagauguacacgaucgauauaaacgauuauuccaagcuaugcaaaaagaagaaguuacagcugaaaauauagccucauuuggaauagccgaaucagaucuaccacaaaaaaucauggaucuaauaucagguaacgcccacggaaaagauguagacgcauucauaagguuaacuguagaugacaugcuaaccgacaccgaaagaagaauaaaacguuuuaaagaugaccgcaaaucgauuagaucggcagauaacaaaaugggaaaaagaggauucaaacaaauaucuaccggaaaguuagcugacuuucuugcuaaagauauaguuuuauuccagccgucaguaaaugacggagagaauaaaauaacaggacugaauuacagaauuaugcaguccgcuauugccguuuacgacagcggagaugacuacgaagccaaacaacaauuuaaacuaauguucgaaaaagcaagauuaauaggaaaaggaacuacagagccgcauccauuccuauauaaaguauuuguuagaucuaucccagcuaacgcaguagauuuuuacgaaagguacuugauugaaagaaaauuuuaucucauaggcuuaucaaacgaaaucaaaaaaggaaauagaguagauguaccauucauaagaagagaucaaaacaaauggaagacuccagcaaugaaaacacuaggaagaauuuauucggaagaucuuccggucgaacuaccaagacaaauguucgacaaugaaaucaaaucgcaccuaaaaucccucccacaaauggaagguaucgauuuuaacaaugccaauguaacauaucucauagcagaauacaugaaaaggguauuaaacgaugacuuccaaacauuuuaccaauggaaacgaaauuacagguauauggauauguuaagaggcgaauaugaccgaaagggaucauuacagcauugcuuuacuaguaucgaagaaagagaaggauuauggaaagaaagagccucgagaaccgaaagauauagaaaacucgcaagcaacaaaauaaggagcaacagacaaaugcguaaugcaagcucagaagaaauugaaacaauacuggacaaaagauuaucaaacugccguaaugaauaccaaaaaagugaaaaaauaauacgccguuaucgaguacaagaugcauuacuauuuuuacuagccaaaaaaacauuaacagaacuagcagacuuugacggagaaagauucaaauuaaaagaaaucaugcccgaugcugaaaaaggcauacucuccgaaauuaugccaaugucauucacauucgagaaaggcggaaaaauauacacaauaacgagcggaggaaugaaacuaaagaacuauggagacuucuucgucuuagcaucagacaaacgaaucgguaacuuauuagaacuaguuggaaguaacacaguaaguaaagaagacauaauggaggaauuuaagaaauaugaucaaugucgaccagaaauauccuccauaguauuuaacuuagaaaaaugggcauuugauacauacccagaacucccagcacgagucgauagaaaagaaaagguagauuuuuggaguauuuuggacguguuaucuaacaacaaagauaucaauaaugagcaaagcuacauacugagaaaaauccgaaaugcauuugaccauaauaauuaccccgauaaaggaaucguagaaauuaaggcccuaccugaaauagccaugagcauaaagaaagcauuuggagaauacgcaauaaugaaguaa

SEQ ID NO: 11940 - RNA, 3438 nt, Artificial Sequence
  Cas13b variant__Psychroflexus torquis__WP_015024765.1__Cas13b
auggaaucaaucauuggacuaggacuaaguuucaaccccuacaaaacagccgauaaacacuauuucgguagcuucuuaaaucuaguugaaaacaaucucaacgcagucuucgcugaauuuaaagaacgcaucagcuacaaagcaaaagacgaaaauaucagcucacucaucgaaaaacauuucauagauaauaugagcauaguagauuacgaaaagaaaaucucaauccuaaacggauaccuaccgauaaucgauuuccucgaugaugagcuggaaaacaacuuaaacacacgagucaaaaacuucaagaaaaacuucauaauacucgcugaagccauagaaaaacucagagacuacuacacacauuucuaccaugacccaauaacauuugaagacaacaaagaaccauuacuugaacuuuuagacgaaguacuacuaaaaacaauauuagacguaaagaagaaauacuuaaaaaccgauaaaacuaaagaaauacucaaagacagccuacgagaagagauggaucuauuaguaauaagaaaaacagacgagcuacgagaaaagaagaaaacuaauccaaaaauucaacacacagacucaucacaaauuaaaaacagcauuuucaacgacgcuuuccaaggacuacuuuacgaagacaaagguaacaacaagaaaacacaaguaagccauagggcaaaaacaagacuaaacccuaaagacauccacaaacaagaagaaagagacuucgaaauaccacucucaacaucuggucuaguauuuuuaaugucacuauuccuuucaaagaaagaaaucgaagauuucaaaucaaacauaaaaggauucaaaggaaaaguuguuaaagaugagaaccacaauucauuaaaauauauggcaacccauagaguauacagcauauuagccuuuaaaggauuaaaauacaggauaaaaacagauacauucuccaaagaaacucuaaugaugcaaaugaucgaugaacucagcaaagucccagauugcguuuaccaaaaucuuagcgaaacaaaacaaaaagauuucauugaagacuggaaugaauacuucaaagacaacgaagaaaacacagaaaaucuugaaaacucaagaguuguacacccuguaauucgcaaacgauacgaagacaaauucaauuacuucgcaauuagauuccuagaugaguucgccaacuuuaaaacauuaaaauuucaagucuucaugggcuauuacauccaugaucaacgaacaaaaaccaucgguacaaccaacauuacaacagaacggacgguaaaagagaaaauaaacguauuuggaaaacuaucgaaaauggacaaccuaaagaaacacuuuuucucccaacucucagaugacgaaaacacagacugggaguucuuucccaacccauccuacaacuuccuaacacaagcagacaacucaccagccaacaacauucccauauaccuagaacugaaaaaccaacaaauaauaaaagaaaaagaugcaauaaaagcagaaguuaaccaaacacaaaacagaaacccaaacaaaccaaguaaaagggaccuucuaaacaaaauacuaaaaacauacgaagacuuucaccaaggggaucccacagccauucuaucacucaacgaaauuccagcgcuacuccaccuguuucuuguaaaacccaacaauaaaacaggucagcaaauagaaaauauaauacgcaucaaaauagaaaaacaauucaaagcaaucaaccacccaucgaaaaauaauaaaggaauacccaaaucacuauucgcagacaccaacguccguguaaacgcuauaaaacucaagaaagacuuagaagcagaauuagauaugcuaaacaagaaacacauagcauuuaaagaaaaccaaaaagccucaucaaacuacgacaaacuguuaaaagaacaccaauucacaccgaaaaacaaaagaccugaacuaagaaaauacgucuucuacaaaucagaaaaaggagaagaagcaaccugguuagcuaaugacauaaaacgauucaugccgaaagacuucaaaacaaaauggaaaggaugucagcacucagaguuacaacgcaaauuagcguuuuaugacaggcauacuaaacaggacaucaaagaacuacucucaggaugcgaauuugaccacagcuuauuagauaucaaugcauacuuccaaaaagauaacuuugaagacuucuucuccaaauaucuagaaaacaggauagaaacacucgaagguguucuaaagaaacuacacgauuuuaaaaacgaacccacaccccuaaaaggcguuuucaaaaacuguuucaaguucuuaaaacgccaaaacuacguaaccgaaucgcccgaaauuauuaagaaaagaauccuagcaaaaccaaccuucuuaccacgaggcguauuugacgaacgucccacuaugaagaaaggcaaaaacccacuaaaagauaaaaacgaauuugccgagugguucguugaguacuuagaaaacaaagacuaccaaaaauuuuauaaugcagaagaauacagaaugcgagacgccgacuucaagaaaaaugcaguaaucaagaaacaaaaauuaaaagacuuuuauacguuacaaauggucaauuacuuauuaaaagaaguauucggaaaagacgaaaugaacuugcaguuaucagaauuauuccaaacacgacaagaaagacucaaacuacaaggaauagccaagaaacaaaugaacaaagaaacuggagauuccagugaaaacacaagaaaccaaacguacaucuggaacaaagacguaccagugagcuuuuucaacgggaaaguaaccauagacaaaguuaaacuuaaaaacauugggaaauacaaacgauacgaaagggacgaacgaguaaaaacauuuauaggauaugaagucgacgaaaaauggaugauguaccugccccauaacuggaaagaccgcuauagcguaaaaccaauaaaugucauagaccuacaaauacaagaauaugaagaaauacggucucaugaacuacugaaagaaauacaaaauuuagaacaauacauauacgaucauacuacagacaaaaacaucuuacuacaagacggaaacccaaauuuuaaaauguacguauuaaacggccuucucaucggaauaaaacaaguuaacauacccgauuucaucguacuaaaacaaaauacaaacuuugacaagauagacuucacaggcauugcaucuugcucagaacucgaaaagaaaaccauaauacuaauagcaauaagaaacaaauuugcccacaaccaacuaccaaauaaaaugaucuacgauuuagccaaugaguuucuaaaaauagagaaaaaugaaacuuaugcaaauuauuacuuaaaaguacuaaagaaaaugauuagugaucucgcauaa

SEQ ID NO: 11941 - RNA, 2847 nt, Artificial Sequence
  Cas13b variant__Riemerella anatipestifer__WP_049354263.1__Cas13b
auguucuuuucuuuucauaacgcacaaagagucauauuuaaacacuuauauaaagcauucgacgccucuuuaagaaugguaaaagaagauuacaaagcacacuucacagugaaccuaacaagagauuucgcacaucuaaaccgcaaagguaaaaauaaacaagacaauccugacuuuaaucgcuaucguuuugaaaaagauggauuuuucacagaauccggacuauuauuuuucaccaacuuguuccucgacaaaagagacgcauauuggauguuaaagaaaguaucgggauuuaaagccucacauaaacaaagagagaaaaugacaaccgaaguauucugcagaagccguauccucuuacccaaacuaagacuugaauccagauacgaccauaaucaaaugcuacuugacauguuaucagaauuaagccguugucccaaacuacucuacgaaaaauugucugaagaaaacaagaaacacuuucaaguagaagcagacggcuuccuagaugaaauagaagaagaacaaaacccauucaaagacacuuuaauucgucaccaagacagauucccauacuucgcacuccgauaucuagaucuuaaugagucauucaaauccaucagauuucaaguagaucuugggacauaucacuacugcauauaugacaagaaaaucggagacgaacaagagaaaagacaccucacacgaacccuacuaucauucggacgauuacaagacuuuacugaaaucaaccgaccucaagaauggaaagcccucacaaaagaucuugacuauaaagaaacaucaaaccaaccuuucauauccaaaacaacaccacacuaccacauaacagacaauaaaauaggcuuccgacuuggcaccuccaaagaauuauacccaucauuagaaaucaaagacggcgcaaacagaauagccaaauaucccuauaacucuggauucguagcgcacgccuuuaucucaguacaugaacuuuuaccuuuaauguucuaucaacaucuaacagguaaaagugaagaccuucuaaaagaaacuguccgacacauacaaagaaucuauaaagacuuugaagaagaaagaauaaauaccaucgaagaucucgaaaaagcuaaucaagguagacuaccacucggagcuuucccuaaacaaauguuaggacuucuacaaaauaaacaaccagaccuaucagaaaaagcaaaaauaaaaauagaaaaauuaaucgcugaaacuaaacuacuaucccaucgacuaaacacaaaacuaaaaucauccccaaaacuaggaaaaagaagagaaaaauuaaucaaaaccgguguccuagcagacugguuagucaaagacuucaugagauuccaacccguagcauaugacgcacaaaaccagccaauaaaaagcucaaaagcaaauucgacagaguucugguuuaucagacgagcccuagcccuauaugguggcgagaaaaaucgccuugaagguuacuuuaaacaaacaaaucuaauaggaaacacuaauccacacccauuucuaaauaaauuuaauuggaaagcauguagaaaccuaguagauuucuaucaacaguacuuagaacaacgugaaaaauuuuuagaagccaucaaaaaccaaccuugggaaccauaucaauauugucuacuauuaaaaauacccaaagaaaaucgaaagaaccuaguuaaaggaugggaacaaggagguauaucccuaccaagaggauuauuuacagaagccauaagagaaacacugucagaagaucucauguuaaguaaacccauacgcaaagaaauaaagaaacacggucguguugguuucauaagcagagcaaucacucuauacuucaaagaaaaauaccaagacaaacaucaaucauuuuauaaccucucauacaaauuagaagccaaagcuccccuucuaaaaagagaagaacacuacgaauacuggcaacaaaauaaaccccaaucaccaacugaaucacaacgucuagaacuacacacaucugaccgcuggaaagacuaccuacuauauaaaagauggcagcacuuagaaaagaaauuaagacuauaccgaaaucaagacguaaugcuauggcuaaugaccuuagaauuaaccaaaaaucacuucaaagaacuaaaucucaacuaucaucaacuuaaacuugaaaaccuagccguaaauguacaagaagcagacgccaaacuaaauccauuaaaucaaacacuuccaaugguauuaccaguaaaaguuuaccccgccacagcuuucggagaaguacaauaccauaaaacaccaauaagaacaguauacauccgcgaggaacacacuaaggcauuaaaaaugggaaauuucaaagcucuaguaaaagauagacgacuaaacggauuauuuucuuuuauaaaagaagaaaacgacacacagaaacauccaauuucacaauuacgacuccgaagggaacuagaaauauaccaaucacuccgaguggaugccuucaaagaaacuuuaucacuugaagagaaauuacuaaauaaacauacuucacuauccucacuagaaaacgaauuuagagcuuuacucgaggaauggaagaaagaauaugcagccucauccaugguaacagacgagcacauagccuuuauagcaagcguucgaaacgccuuuugccacaaucaauauccuuuuuauaaagaagcacuacaugcucccauacccuuauucacaguagcccaaccuacuaccgaagaaaaagauggacuagggauagcggaagcucuccuaaaaguauuacgcgaguacugugaaauaguaaaaucccaaauauaa

SEQ ID NO: 11942 - RNA, 3288 nt, Artificial Sequence
  Cas13b variant__Riemerella anatipestifer__WP_004919755.1__Cas13b
auggaaaaaccccuccuaccaaauguuuacaccuugaaacacaaauuuuuuuggggcgcauuccuuaacauagcucgacauaacgccuucauaacaauaugccauauaaacgaacaacuaggccuaaaaacaccuucuaaugaugacaaaauaguugauguaguuugugaaacauggaacaacauauuaaacaaugaucacgaucuguuaaaaaaaucacaacuaacagaacuaauuuuaaaacauuucccuuuuuuaaccgcgauguguuaucacccuccaaaaaaagaagguaaaaaaaaagggcaccaaaaagaacaacaaaaagaaaaagaaagcgaagcacaaucacaagcagaagcgcuuaaucccucgaaauuaauugaagcguuggagauacuaguaaaccaacuccauagccuacgaaacuauuacucucacuacaaacacaaaaaaccagaugcagaaaaagauaucuucaaacaucuauacaaggcuuuugacgcaagcuuaagaaugguuaaagaagacuauaaagcacacuucacuguaaacuuaacgcgugacuucgcacaccuuaaucgaaaagggaaaaauaaacaagauaacccagauuucaauagauaccgauuugaaaaagacggauuuuucacugaaucaggauuacuauucuuuacaaauuuauuucuagacaaaagagacgcguacuggaugcuaaagaaaguaucagguuuuaaagccucacacaaacaaagagaaaagaugacaaccgaagucuucugucguucuagaauuuuacuccccaaacucagacucgaaucgagguacgaccacaaucagauguugcucgacauguuaucagaacuaaguagaugucccaaauuacuauaugaaaaacuaagcgaggagaacaagaagcauuuucaagucgaagcugauggguucuuagaugaaauagaggaagaacaaaacccauucaaagacacacuaauacgacaccaagaccgcuucccuuacuuugcauuaagauaucuagacuugaaugaaucauuuaaaagcauacgauuucaaguugaccuugggaccuaccacuauuguaucuaugauaaaaaaauaggcgacgaacaagaaaaacgccaucuaacaagaacauuacuaucuuuuggacggcuccaagacuuuaccgaaauuaacagaccacaagaauggaaagcccuaacaaaagaccuugauuauaaggaaacaucaaaccaaccauuuauaucgaaaacaacaccccacuaccauauaacagacaacaaaauaggcuuccgacuaggaacaaguaaagaacuauacccaucacucgaaauaaaagacggagcaaacagaaucgcuaaauaccccuauaacucaggcuuugucgcacacgccuuuauaucagugcacgaacuucuaccauuaauguucuaucaacaucuaacaggaaaaagcgaagaccugcugaaagagaccgucaggcacauacaaagaauauacaaagacuuugaagaagaaagaauuaauaccauagaagaccuugaaaaagcaaaccaaggcagauuaccauuaggcgcauucccaaaacaaaugcuaggccuauuacaaaacaaacaaccugaccuauccgaaaaagcaaaaauaaaaauugaaaaacuaauagcugaaaccaaauuacuuagccacagguuaaacacuaaacucaaauccucaccuaaacuagguaaaaggcgagagaaauuaauuaaaacugguguccuugccgacuggcuagucaaagacuuuaugagauuucaaccuguagccuacgaugcccaaaaucaaccuauaaaaucaucaaaagcaaauuccacagaguuuugguucauaagaagagcacuugccuuauacggaggagaaaaaaacagacuagaaggguacuuuaaacaaacaaacuuaauaggaaauacuaacccucauccuuuccuuaauaaguuuaacuggaaagcguguagaaaucucguggacuuuuaccaacaauacuuagaacaacgagaaaaauucuuagaagcuauaaaaaaccaaccaugggagccauaccaguacuguuuacuacuaaaaauaccaaaagaaaauagaaaaaauuuaguaaaaggaugggaacaagguggaaucucauuaccacgcggccuuuucacagaagcaauccgugagacucuaucagaagacuuaaugcuaucuaagccaauaagaaaagaaauuaaaaaacacggccguguaggauucauuagccgagccauaaccuuauacuucaaagaaaaauaccaagauaaacaucaaucauucuacaaucuaaguuauaaacuugaagcaaaagcgccauuacucaaaagagaggaacauuaugaauauuggcaacaaaacaaaccacaaucccccacagaaucacaaagacuggaauuacacacgucagauagauggaaagacuaucuccuauacaaacgcuggcaacaccuagaaaaaaaauuaagacuauacagaaaucaagacgucauguuaugguuaaugacacucgaauuaacaaaaaaucacuucaaagaacugaaccuaaauuaccaccaacugaagcuugagaaccuagcaguaaauguacaagaagcagacgccaaacuuaauccacuuaaccaaacccuaccaaugguauuaccaguuaaaguauaccccgccacagccuucggagaaguccaauaccacaaaacacccauuagaacuguauauauaagagaagaacacacuaaagcacuaaaaauggggaacuuuaaagcauuagucaaagacagacgccuaaauggauuguucaguuuuaucaaagaagaaaacgauacacaaaaacaucccauaucacaacuacgccucagacgcgaauuagaaaucuaccaaucucuuagaguugacgcauucaaagaaacucuuucuuuagaagaaaaacuccucaauaaacauacaucguuaaguucccuagaaaaugaauuccgagcacuauuagaagaauggaaaaaagaauaugcagcauccucaaugguaacagacgaacauaucgcuuucaucgccucuguuagaaaugccuucugucacaaccaauaucccuucuacaaagaagcacuucaugccccgauaccacuuuucacuguagcccaaccaacuacagaagaaaaagacggcuuaggcauugccgaagcacuccuaaaaguccuucgagaauacugcgaaauaguaaaaucucaaauauga

SEQ ID NO: 11943 - RNA, 3288 nt, Artificial Sequence
  Cas13b variant__Riemerella anatipestifer__WP_064970887.1__Cas13b
auggaaaaaccccuaccaccaaacguguauacucuaaaacauaaauucuucuggggggcauuuuuaaauauagcucgccauaacgcguuuaucacaauaugccacaucaacgaacaacuaggucuaacaacaccucccaacgaugacaaaauagcagauguugucugcgguacuuggaacaauauacucaacaacgaucacgacuuacuaaaaaaaucccaguuaaccgaacucauacuuaaacacuuuccauuccuugccgcuaugugcuaccacccaccuaaaaaagaaggaaaaaaaaaagguagccaaaaagaacaacaaaaagaaaaagaaaaugaggcacaaucccaggcagaagcccuaaacccaagcgaacuaaucaaagucuuaaaaacccuuguaaagcaacuaagaacauugagaaacuauuacucacaccauucacacaaaaaaccagacgccgaaaaggauauauucaaacaccuuuacaaagcuuuugacgcaucguugcgaaugguaaaagaagauuauaaagcacacuuuacaguaaaccuaacacaagacuuugcccaccuaaacagaaaaggaaaaaacaaacaagacaauccagauuucgacagauaccgauucgaaaaggaugguuuuuucacagaaaguggccuauuauuuuucacaaaucucuucuuagauaaaagagaugcauacuggaugcuaaaaaaaguaucaggauucaaagcaucacacaaacaaucggaaaaaaugacaacagaaguuuucuguagaagccgaaucuuauuaccaaaacugcgacuagaaagccguuacgaccacaaucaaaugcuccuagauaugcuaucagaacuaagccgauacccaaaauuacuauaugaaaaacucucggaagaagacaaaaaacgauuccaaguagaagccgacggcuuccuagacgaaauagaagaagaacagaacccuuucaaagacacccuaauacgacaccaagaccgauucccauacuucgcuuuaagauaccuagaccucaaugaaucauuuaaaucaauacguuuucagguugaucuuggaacauaucacuacugcauuuaugauaaaaaaaucggagaugaacaagaaaaacgccaccuuacacgcacacuauuauccuuuggacggcuucaagacuuuacagaaauaaaccguccacaagaauggaaagcucuaaccaaagaucuagacuacaaagaaaccucaaaacaaccauuuauaagcaaaacgacuccccacuaucauauaacagauaauaaaauaggcuuucgacuuggaaccucaaaagagcuauacccuagccuagaagugaaagauggagccaacagaaucgcucaauacccauauaauucugacuucguagcacaugcuuuuaucuccguucaugaauuauuaccucuuauguuuuaccaacacuuaacaggaaaaucugaagauuuauuaaaagaaacaguaagacacauccagagaauauacaaagacuuugaagaagagcgcaucaacaccaucgaagacuuagaaaaagcaaaccaaggaagauuaccuuuaggagcauucccaaaacaaauguuaggacuccuucaaaacaaacaacccgaucuaucagaaaaggcaaaaauaaaaaucgaaaagcuaaucgcagaaacaaaacucuuaucacauagacuaaacacaaaacuuaaaucaucacccaaauuaggcaaaagacgagaaaaauuaaucaaaacuggaguacuagcagacuggcuaguaaaagauuuuaugagauuccagccaguugcuuacgacgcucaaaaccaacccaucgaaagcucaaaagcaaacucuaccgaauuccaauugauucaaagagcccuagcccuauacggaggcgaaaaaaaccgccuagaaggauauuuuaaacaaaccaaccuaauugguaacacaaacccacacccauuucuuaacaaguucaacuggaaagccugccguaaucucguagacuucuaucaacaauaccuagaacaaagagaaaaauuccuagaagcaauaaaaaaccaaccuugggaacccuaucaauauugccuacuacugaagauaccaaaagaaaaucggaaaaauuuagugaaaggaugggaacaaggaggaauaucccucccuagaggcuuauuuacagaggcuauccgcgaaacacuaaguaaagacuuaacacuaucuaagccgaucagaaaagaaauaaaaaaacaugggcgagugggguuuauaucucgagcuauuacacucuacuuccgugaaaaauaucaagacgaccaccaauccuucuacgaucuaccauacaaauuagaagcaaaagcauccccacucccaaaaaaagaacacuaugaauacuggcaacaaaauaaaccacaaaguccaacagaacuacaacgucucgaauuacauacuucagaccgauggaaagacuaccuccuauacaaaagauggcagcacuuagaaaaaaagcuacgccucuauagaaaccaagacgucauguuaugguuaaugacacucgaacuaaccaaaaaccacuuuaaagaauuaaauuugaauuaucaucaacuaaaacuagaaaaccuagccguaaauguacaagaagcagacgcaaagcuaaauccacuuaaccaaacauuacccaugguauuaccuguaaagguauaccccgcaacagccuucggcgagguccaauaucaagaaacuccaauaagaacgguuuacauccgugaagaacaaacaaaagccuuaaaaaugggcaacuuuaaggcgcugguaaaagauagacgucuaaacgguuuauucucuuuuauaaaagaagaaaaugacacucaaaaacacccaauaucucaacuucgacuacgacgagaacuagaaaucuaucaaagccuacgagucgacgcuuucaaagaaacacucaaucuagaggaaaagcuacuaaaaaaacacaccucacuaucuucaguagaaaauaaauucagaauucucuuagaggaauggaaaaaagaauacgccgcaucauccauggucacagacgaacacaucgcguucauagccuccguucgaaaugcauucugccacaaucaauauccuuuuuaugaggaggccuugcacgcuccuauaccuuuauucacagucgcucaacaaacuacagaagaaaaagacggucuuggcauagcagaagccuuacucagaguauuaagagaauacugcgaaauaguuaaaagucaaauauaa

SEQ ID NO: 11944 - RNA, 2853 nt, Artificial Sequence
  Cas13b variant__Riemerella anatipestifer__WP_061710138.1__Cas13b
auguuuuucucuuuccacaaugcacaacgaguuauauucaaacaucuauauaaagccuucgaugcaucacuucgaaugguuaaagaagauuauaaagcucacuuuacaguaaaccuuacgagagauuuugcacaccuaaaccgaaaaggcaaaaauaaacaagacaaucccgacuucaacagauacagguuugaaaaagacggauucuucacagaauccggacuguuauucuuuacaaaucuauuucuagauaaaagagacgcauacuggauguuaaagaaagucucaggauuuaaagccucccauaaacaaucugagaaaaugacuacagaaguauucugcagaucucgcauucuacuaccuaaacuucgacucgaauccagauacgaucacaaccaaauguuacuagacaugcuuuccgaauuaucaagauguccaaaacuacuauacgaaaaauuauccgaaaaagauaagaaauguuuucaaguugaagcagacggauuccuagaugaaauagaagaggaacaaaacccauucaaagauacucuaauaagacaccaagacagauuccccuacuucgcacuaagauaccuagaccugaacgaaucauuuaaauccauucgguuccaagucgacuuaggaacauaccacuacugcaucuaugacaagaaaauuggauacgaacaagaaaaacgacauuuaacaagaacuuuacuaaacuucgguagacuacaagacuucaccgaaauuaaucgaccucaagaauggaaagcccuaacaaaagacuuggacuacaaugaaacaucaaaucaaccauucauaucaaaaacgacuccacauuaucacauaacagacaacaaaauuggauuccgacuaagaacaucaaaagaauuauauccaucauuagaaguuaaagauggagcaaaucgcaucgcuaaauauccguacaacagcgacuuugucgcacacgcauucauaucaauaucuguacaugaacuacuaccacuaauguuuuaucaacaucucacaggcaaaucugaagaucuccuaaaagaaacaguaagacacauccagagaauuuauaaagacuuugaagaggaacguauaaacacaauagaagacuuagaaaaagcaaaccaagguagacuaccccuaggcgcauuuccaaaacaaauguuaggacuccuacaaaacaaacaaccagauuuaagcgaaaaagcaaaaaucaaaauagaaaaauuaauagcagaaacuaaacuccucucucacagauugaauaccaaauugaaaucaagccccaaacucggaaaaagaagggaaaaacuaauaaaaacaggaguacuagccgauuggcuaguaaaagacuuuaugcgauuucaaccaguuguauaugacgcccaaaaccaacccauaaaaucuuccaaagcgaacucuacagaaucccggcuaauucggcgugcauuagccuuauacggcggagagaaaaaccgucuagaaggauacuucaaacaaaccaaccuaauuggaaacacgaauccucacccauuccuuaacaaauuuaauuggaaagcgugcagaaaucucgucgauuucuaccaacaauaccuagaacaacgggaaaaguuccucgaagcaauaaaacaccaaccuugggagccauaccaauauugcuugcuauuaaaagucccuaaagaaaauaggaagaaucuaguuaaaggaugggaacaaggaggcauaucauuaccaagaggacucuuuacugaagcgauaagagaaacacuauccaaggaucuaacgcuaaguaaacccauccgcaaagaaauaaagaaacacggaagaguaggauucauaucacgggcaaucacuuuauacuucaaagaaaaauaccaggacaaacaucaaucauucuacaaucuaucuuacaaauuagaagcaaaagcaccuuuacucaagaaagaagaacacuacgaauacuggcaacaaaacaaaccccaaagucccacugaaucacaacgacuagaacuccacacaucagauagauggaaagauuaccuacuuuauaaacgauggcaacaccuagaaaagaaauuacgccucuaccgaaaucaagauauaaugcuauggcucaugacacucgagcugacuaaaaaucacuuuaaagaauuaaacuuaaacuaucaucaauuaaaacuugaaaaucucgccguaaauguucaagaagcugacgcuaaauuaaacccauuaaaucaaacacuucccaugguccuaccaguaaaagucuaccccacaacagcuuucggagaaguacaauaucacgaaacuccuauacgcacaguuuacauaagagaagaacaaacuaaagcauuaaaaaugggcaacuucaaagcacucguaaaagaucgacaucucaacggccuauucucauucauaaaagaagaaaaugacacacaaaaacaucccauuagucaacuucgauuaagaagagaauuagagaucuaccaaagucuaagaguagaugcauucaaagaaacacuauccuuagaagaaaaacuauuaaacaaacacgcaucacucagcucccucgaaaacgaguuccguacauuacuugaagaauggaaaaagaaauacgcagcuucaucaauggucacagacaaacauauagcuuucauagcauccguccgcaacgcuuucugccacaaccaauacccauucuacaaagaaacacuacaugcgccaauacuccuauucacaguugcucaaccaacuacagaagaaaaagauggacuagguauagcagaagcucuccuuagaguacuccgugaauauugcgaaauagucaaaucacaaauauga

SEQ ID NO: 11945 - RNA, 2850 nt, Artificial Sequence
  ARMAN Cas9 variant__Candidatus Micrarchaeum acidiphilum__OJI07263.1__Cas9
augcgugacagcaucacagcaccaagauacaguagugcauuggcagcacgcauaaaagaguucaacagugcauucaaauugggaauugauuuaggaacaaaaacuggcggugucgcuuuagucaaagacaacaaaguucucuuagcuaaaacauuucuggacuaccauaaacaaacuuuagaagaaaggagaauacauagaaggaauaggagaucccguuuagcaagaaggaaacguauugccagacuacgauccuggauacuacgacagaaaauauauggaaaacaauuaccagacccauauaaaauaaagaaaaugcaacuacccaauggaguaagaaagggcgaaaacuggauugaccuagucguaagcggaagagauuuaucuccagaagccuuuguccgagccauaacacuaaucuuucaaaagagagggcaaagauaugaagaaguagcaaaagaaauagaagaaauguccuacaaagaauuuaguacacauaucaaagcacuaacauccguuacugaagaagaguucacagcccuagcagcugaaauagaaagaagacaagacguaguagauacagacaaagaagcagaaagauacacacaacuaucugaacuuuuaagcaaagucagcgaaucuaaaucagaauccaaggauagagcccaaaggaaagaagaccuaggaaagguaguaaacgcauucuguucagcacacagaauagaagacaaagauaaguggugcaaagaacuaaugaaauuacuagauaggccaguaaggcacgcaagauuccuaaacaaagucuuaauaagaugcaacauaugcgacagagccacaccgaagaaaagucggccagauguaagagaacuacucuacuucgauaccguuagaaacuucuuaaaagcaggccgaguggaacaaaaccccgacguaauaagcuauuauaagaaaauauacauggaugcugaagugauccgagucaaaauucuaaacaaagaaaaacuaacugaugaagacaagaaacaaaaacgcaaauuagcaagcgaacuaaauagauauaaaaauaaagaauacguaacagacgcacaaaagaaaaugcaagaacaacugaaaacacuacuguucaugaaauuaacugggagaagcagauauugcauggcccauuugaaagaaagagcugcaggcaaagacguagaagaagguuuacaugguguaguacaaaaacgacaugacagaaacauagcucaaagaaaccacgauuuaagagucauuaacuuaauagaaagucuacuauuugaccaaaauaaaucacuuucagacgcuauacggaaaaacggacuaauguacguaacaauugaagcaccagaaccaaaaacuaaacaugcaaagaaaggugcagcuguaguaagagaucccagaaaauuaaaagaaaaauuauucgacgaucagaacgggguaugcauauauacaggauuacaauuagauaaacuagaaauauccaaauacgaaaaagaccacauauucccugauucuagagacggccccaguaucagagacaauuuaguucuaacaacaaaagaaauuaacucagauaaaggcgauagaacaccaugggaauggaugcacgacaacccugaaaaauggaaagccuucgaacgcagaguagccgaguuuuacaagaaagggagaaucaacgaaagaaaaagagaacuacuucucaauaaaggaaccgaauacccaggagauaacccaacggaacuagcacgaggcggagcaagaguaaacaacuucauaacagaauuuaacgauagguuaaaaacacauggaguacaagaacuacaaacaauauucgaacgaaacaaaccuauaguacaaguaguaagaggagaagaaacacaacgacugagaagacaauggaaugcacuuaaccaaaauuucaucccccuuaaagauagagcgaugagcuuuaaucaugcagaagacgccgcuauagcagccagcaugcccccaaaauucuggagagaacaaaucuacagaacugccuggcacuucgguccuagcggaaaugaacgacccgacuuugcauuagcugaacuagccccacaauggaacgauuucuuuaugacaaaagggggaccaauaaucgcaguacucgggaaaaccaaauacaguuggaaacauucaaucauagaugacacaauauacaaaccuuuuaguaaaucagcauacuaugucggaaucuacaagaaaccgaaugcaauaacauccaacgcaauaaaaguauugcgccccaaauuauuaaacggagaacauacaaugagcaaaaaugcuaaauacuaccaucagaaaaucgguaaugaaagauuucuuaugaaaucacaaaaaggaggauccauaaucacaguaaaaccucacgacgguccagaaaagguauuacaaaucaguccgacauacgaaugugcaguacucacaaaacaugacggaaaaauaauaguaaaauuuaaaccaaucaaaccgcuaagagacauguaugccagagguguaaucaaagccauggacaaagagcuagaaacaagccuaaguucaaugucgaaacacgcuaaauacaaagaacuucauacacacgauaucaucuacuuaccugcaacaaagaaacacgucgauggauacuucaucauaacaaaacuaucagcaaaacauggaauaaaagcucucccggaaucaaugguaaaaguaaaauauacacaaauaggaucagaaaauaacagcgaaguaaaacuaacaaaaccaaagccagaaauaacacuagacucggaagauauaacaaauauauacaacuuuacacguuaa

SEQ ID NO: 11946 - RNA, 2904 nt, Artificial Sequence
  ARMAN Cas9 variant__Candidatus Parvarchaeum acidiphilum__APG80630.1__Cas9
augcucggcagcuccagguaucuaagauauaaucucacaucauuugaaggcaaagaaccauuucuaauaaugggauauuacaaagaauauaacaaagaacucucaucuaaagcacaaaaagaauucaacgaccaaauaagcgaauuuaacucuuacuauaaacucggaaucgaccuaggggacaaaacaggaauugcuauaguuaaaggaaacaaaauaauacuagcuaaaacgcuaauagaccuccacucacaaaaauuagauaaacgaagagaagcgagacgaaaucgucgaacacgacucagcagaaaaaagagacuagcucgacuucgaaguuggguuaugagacaaaaaguaggaaaucagagauuacccgacccauauaaaauaaugcacgacaacaaauauuggagcauauauaacaaaucaaacagugcaaauaaaaaaaacuggauagaccucuuaauacauaguaauucccuuucagcagacgacuuuguaagagguuuaacaaucauauucagaaaaagaggcuacuuggcguucaaauaccuauccaggcucuccgacaaagaauucgaaaaauauauagacaaccucaaacccccgauaucaaaauaugaauaugacgaagacuuagaagaauuaagcagcagagucgagaacggcgaaaucgaagaaaaaaaauuugaaggacuaaaaaacaaacuugauaaaauugacaaagaaagcaaagauuuucagguaaaacaaagagaagaagucaagaaagaacuugaagacuuaguagacuuauucgcuaagucagucgauaacaagauagauaaagcuagauggaaaagagaacuaaacaaccucuuagacaaaaaaguaagaaaaauucgauucgacaaccgauucauacuaaaaugcaaaauuaaaggcugcaacaaaaacacuccuaaaaaagaaaaaguaagagauuucgagcuaaaaaugguacucaacaacgcaagaucagacuaucaaauuagugacgaagaucuaaauucuuuuaggaacgaagugauaaacauauuccaaaaaaaagaaaaucugaaaaagggugaauuaaaaggcguaaccaucgaagauuuaagaaaacaauuaaacaaaacuuucaacaaagccaaaauaaaaaaaggaauaagagaacaaauaagaucgauaguguuugaaaaaauuuccggccgaucaaaauuuuguaaagaacauuuaaaagaauuuagugaaaaacccgccccgagugaccgaauaaacuacgguguuaacagugcaagagaacaacacgacuuuagaguauuaaauuucaucgauaagaagauauuuaaagacaaacuaauagauccaucaaaacuucgauacauaacaauagaaagcccagaaccagaaacugaaaagcuagaaaaagggcaaauaagcgaaaaaucguucgaaacccuaaaggaaaaacucgccaaagaaacugggggaaucgauaucuauacaggagaaaaacuaaaaaaagauuucgaaauagaacacaucuuuccacgagcaagaaugggacccucaauaagagaaaaugaaguagcaucaaaccuagagacuaacaaagaaaaagcagacaggacuccaugggaaugguucggccaagacgaaaaaagauggucagaauuugaaaagcgaguaaacagucucuacagcaaaaaaaaaauaagugaaagaaaaagagagauccuacuaaauaaauccaacgaauaucccggacuaaauccgacggaacuaagccgaaucccaaguacauuaagcgacuuuguugaaucaauacgaaaaauguuugucaaauacggcuacgaagaaccacaaacacuaguacaaaaaggaaaacccauaauacaaguagugagaggaagagacacacaagcucugcgauggagauggcaugcucuagacaguaacauaauuccagagaaggauagaaaaucaucauucaaccacgcugaggaugcuguaauagcagcaugcaugccaccauacuaucuaagacaaaaaauauuccgagaagaagcaaaaaucaaacgaaaagugucaaauaaagaaaaagaaguaacacgaccugacaugcccaccaaaaaaauagcccccaacuggucggaauuuaugaaaacaagaaacgaacccguaauagaagucauaggcaaaguaaaaccaagcuggaaaaacucaauaauggaucaaaccuuuuacaaauaccuacuaaaaccauucaaagacaacuuaaucaaaauuccaaacguaaaaaacaccuacaaguggauaggaguuaauggacaaaccgacagucugagucuaccguccaaaguauuaucgauaagcaacaaaaaagucgacucauccaccguccucuuaguccacgacaaaaaagguggaaaaagaaacuggguacccaaaagcauaggcggacuuuuagucuacauaacaccaaaagacggaccaaaaagaauaguacaagucaaaccagcgacacaaggacuacuuaucuacagaaacgaagacggaagaguugaugccgucagggaguucauaaauccagugauagaaauguacaauaauggcaaacuagcauuuguggaaaaagaaaacgaagaagaauuacuuaaauauuucaaucuucuagaaaaaggacaaaaguucgaacgaauaagaagauacgauaugauaacauauaauaguaaguucuacuaugugacgaaaauaaacaaaaaccacagaguaacuauacaggaagaaucaaaaaucaaagcagaaucagacaaaguaaaaucaucauccggaaaagaguacacaagaaaagaaacagaggagcucucauuacaaaaacuagcagaacuaauaaguauauaa

SEQ ID NO: 11947 - RNA, 2850 nt, Artificial Sequence
  ARMAN Cas9 variant__Candidatus Micrarchaeum sp.__OJT94500.1__Cas9
augagagauucaauaacagcaccuagauacagcagugcacuagccgcuagaaucaaagaauuuaauagcgccuuuaaauuaggaaucgacuuaggaaccaaaaccggaggagucgcacuuguuaaggacaacaaaguucuauuagccaaaacauuccuagacuaccauaaacaaacauuagaagaaagaagaauacacagacguaauaggaggagcaggcuagcaagaaggaaaagaaucgcaagacuaagaucauggauucugagacaaaagauauacgggaaacaacuaccagauccguauaaaaucaagaaaaugcaacuacccaacggugugagaaaaggugaaaacuggaucgauuuaguaguuagugguagagauuuaucaccagaagcauucguaagagcaauaacacuaauauuucagaaaagaggucaacgcuaugaggaaguagccaaagagauagaagaaaugucguacaaagaauuuucaacacacauuaaagcguuaaccucaguaacagaagaagaauuuacagcauuagcagcagaaauugaacgaagacaagacguaguagacacagauaaagaagcggaacgauacacucaacucagcgaauuauuaagcaaaguaucagaaaguaaaucagaaucgaaagauagagcacaacgaaaagaagaccuaggaaaaguagugaaugcauuuuguucagcucacagaauagaagacaaagacaaauggugcaaagaauugaugaaacuauuagaccgaccaguacgacaugcaagauucuuaaauaaagucuuaauacgauguaauauaugugaucgagcaaccccaaagaaaucacgaccagauguaagagaacuacuguauuucgacaccguaagaaacuucuuaaaagcaggcaggguagaacaaaacccagauguuauaucauauuacaagaaaaucuacauggaugcagaaguuauacguguaaaaauacuaaauaaagaaaaacucacagacgaagauaagaaacagaaaaggaaacuagcuagugaacuaaauagauacaaaaacaaagaauauguaaccgacgcucaaaagaaaaugcaagaacaacuaaaaaccuuacuauuuaugaaacucacaggaagauccagguauuguauggcucaucuaaaagaaagagcagcaggaaaagacguugaagaaggauuacauggagugguacagaaaaggcacgauaggaacauagcacaaagaaaccaugaccuucgaguaauaaacuuaaucgaaucacuauuauuugaucccaacaaaaguuuaucugacgccauacggaaaaaugguuuaauguauguuacaaucgaagcaccggaaccuaaaaccaaacaugcuaagaaaggagcagcaguaguuagagacccaagaaaacuaaaagaaaaacucuucgaugaccaaaauggaguauguauuuauacaggccuacaacuugauaaacuugaaaucuccaaauaugaaaaagaccacauauucccagacucucgagacgggccgagcauaagagacaacuuaguacuuacaaccaaagaaauaaauucagauaaaggagauagaacaccaugggaauggaugcacgauaacccagaaaaauggaaagcauucgaacgcagaguagcagaguucuacaagaaaggaagaauaaaugaacguaaacgagaauuauuguugaacaaaggaacugaauaccccggugacaauccaacagaacuagcacgaggaggcgcuagaguuaauaacuucauaacggaauuuaaugauagguuaaaaacccacggaguucaagaacuacaaaccauauuugaaagaaacaaaccaaucgugcaaguaguccguggcgaagagacccaaagacuucgaaggcaauggaacgcacuaaaucaaaauuucauaccauuaaaagacagagcaaugucauucaaccacgcagaagacgcagcuauagcagcaucaaugccaccaaaauucuggagagaacaaauuuacagaacagcauggcauuucggaccaucgggaaaugaaagaccugacuuugcacuagcugaacuagcaccacaauggaacgacuuuuucaugacaaaagguggcccaauaauagccguuuuagguaaaacaaaauauagcuggaaacacaguauuauugaugacacgauauacaaaccauucucaaaaucugcauauuacgugggaauauacaagaaacccaaugcaaucacaucaaacgccauuaaaguguuacgaccaaaacuacuaaauggcgaacauacaaugaguaaaaacgcaaaauauuaucaccagaaaauuggaaacgaacgauuuuuaaugaaaucucaaaaaggagguuccauaauaacaguaaaaccucacgacggucccgaaaaaguacuccaaauaucaccaacauacgaaugugcugucuuaacaaaacacgacggaaaaaucauaguaaaauucaaaccaauuaaacccuuacgagacauguacgccagagggguaauuaaggcaauggauaaggagcuagaaaccagcuuauccuccaugagcaaacaugcaaaauacaaagaauuacacacccacgauauaauauauuuaccagcuacaaagaaacauguagacggauacuucauaauaacaaaauuaagugcaaaacauggaaucaaagcucugcccgaaucuaugguaaaagucaaauacacacaaauaggcagugaaaauaacuccgaaguaaaacuaacaaaacccaaaccagaaauaacauuggauagcgaagacauaacuaacauauauaauuuuacaagauag

SEQ ID NO: 11948 - RNA, 2961 nt, Artificial Sequence
  CasX variant__Deltaproteobacteria bacterium__OGP07438.1__CasX
auggaaaaaaggauaaauaaaauuagaaaaaaguugucagcagauaaugcaacaaaaccuguaagcagaagugggccuaugaaaacucugcuagugagaguaaugaccgaugauuuaaaaaaaagauuggaaaaacgacgaaaaaaaccagaaguaaugccucaaguaauaucaaacaacgccgcaaauaacuuaaggaugcuacuugaugauuauacaaaaaugaaggaagccaucuuacaaguauacuggcaagaguuuaaagacgaccauguuggccucaugugcaaguuugcacaaccagcaucaaaaaaaauagaucagaacaaauuaaaaccugagauggaugagaaaggcaacuugacgacagcuggauucgcauguagccaauguggacaaccauuguuuguauauaaacuugagcaagucucagagaaagguaaggcuuauacaaacuacuuugguagaugcaacguagcagaacacgaaaaacuaauauuacuugcacaguuaaagccugaaaaagauucagacgaggcuguaacauauagucuagguaaauuuggccaaagagcacuagacuuuuauagcauacacgucacuaaagaaaguacacaucccguaaaaccacuagcacaaauagcuggaaacagauaugcauccggaccaguaggaaaagcacuaagcgacgcaugcaugggaacuauugcaaguuucuuaagcaaauaccaagacauaauaauugaacaccagaaagugguaaaaggaaaccaaaaacgccuagagucucuaagagaguuagccggaaaagagaauuuagaguacccaagcguaacccuuccgccacagccacacacuaaagaggggguagacgccuauaaugaaguuauugcacgaguuagaauguggguaaaucuaaaccuuuggcagaaauuaaaauuaucacgagaugacgcaaagccacuucuuagauuaaaaggguuuccuaguuuuccuguaguugaacgaagagaaaacgaaguagacugguggaauacaauaaaugaaguuaaaaaauuaauagaugcaaaaagagauauggguagaguauuuuggagcggcgugacagcugaaaaaagaaacacaauacuagagggauauaauuaucuaccgaaugaaaaugaccacaagaaaagagaaggaucacuagaaaacccaaaaaaaccagccaaaagacaauuuggggaucuuuuacuauaccucgagaaaaaauaugcaggcgacuggggaaaaguauuugacgaagcuugggaaaggauagacaaaaagauagcuggauuaacuucacacauagaaagagaagaagcaagaaaugcagaagaugcacagagcaaagccguauugacagauuggcuaagagcaaaagcgaguuuuguauuagaaagauuaaaagaaauggaugaaaaagaauuuuacgcaugugaaauccaacuacaaaaaugguauggggaucuccgcggaaauccauuugcaguagaagcagaaaaucgaguaguagacaucucaggauuuucuauaggauccgauggacauucaauacaauauagaaacuuauuggcuuggaaauacuuagaaaacgguaaacgagaauuuuauuuauuaaugaacuaugggaaaaagggacgaauuagauucacagaugggaccgauauaaaaaaaagcggaaaauggcaggguuuacuauauggaggaggaaaagccaaaguaauagaucuaacauucgacccagaugaugaacaacugauaauacuuccacuagcuuuuggaacacgucaaggcagagaauucauauggaaugaccuucugucacucgaaacaggucuaauuaaguuagcaaacggcagaguaaucgaaaaaacuaucuauaauaaaaaaauaggacgcgaugaacccgcacuauuuguagcacucacauucgaaagaagggaagucguggacccaaguaacauaaaaccaguuaauuuaauaggaguagauagaggcgaaaacaucccggcgguuaucgcucucacagacccagaaggaugcccucucccagaauuuaaagauucaagcggcggaccaaccgauauauuacguauuggagaaggcuauaaagaaaaacaaagagcuauacaagccgcaaaagaaguagaacaacgaagagcaggagguuauucaagaaaauuugcaucaaaaaguagaaauuuagcagaugauaugguacguaauucagcaagagauuuauuuuaucacgcgguuacacacgacgcaguacuagucuuugaaaaccuaagucgagguuucggaagacaaggaaaaagaacuuucaugacagaaagacaauacacaaaaauggaagacugguuaacagcaaaauuagcuuaugaagggcuaacuagcaagacguacuugaguaaaaccuuagcucaauacacauccaaaacuuguaguaauuguggcuuuacuaucacaacagcagauuaugauggaaugcugguacggcuaaaaaaaacaagcgaugguugggcaaccacacuaaauaauaaagaguuaaaggcagaaggacaaauuacauacuauaaucgauauaaaagacaaacuguugaaaaagaacuaucagcugaauuagacagguuaagugaggaaagugguaacaacgacauaaguaaauggacgaaggguagaagagaugaagcacuauuccuauuaaaaaaaagauucucucauagaccaguccaagaacaauuuguuugucuagauugcggacacgaaguacaugcagacgaacaggccgcacuaaauauugccagaaguugguuguuccucaacucgaauucaacagaguucaaaucauauaagucaggcaaacaaccauucguaggagcauggcaggcauuuuauaagagaagauuaaaagaaguauggaaaccaaaugccuaa

SEQ ID NO: 11949 - RNA, 2937 nt, Artificial Sequence
  CasX variant__Planctomycetes bacterium__OHB99618.1__CasX
augcaagaaauaaaaagaauaaauaaaauaagaaggagacucguuaaagauucuaacacaaaaaaagcaggaaaaacuggaccaaugaaaacccuuuuaguaagaguaaugacaccagacuugagagaaagauuagaaaaccuucgcaaaaaaccggaaaacaucccucaaccaauaucaaacacaucaagagcuaaccuuaacaaacuucuuacagauuacacagaaaugaaaaaagcaauauuacauguauacugggaagaauuucaaaaagacccaguuggauuaaugucaagaguagcacaaccagcaccgaaaaauauagaccaacgaaaguugauaccaguuaaagacgguaacgaaagacuuacuucauccggauucgcaugcucacaaugcugccaaccuuuauacguuuauaaacuagaacaaguaaacgacaaagggaaaccacauacaaauuacuuuggaagguguaacgucagcgaacaugaaaggcuaauauuauuaaguccccacaagccagaagcaaaugaugaacucguaacauauaguuuaggaaaauuuggacaacgagcgcuagauuuuuauucaauucacguuacaagagaaagcaaccauccgguaaaaccacuagaacagaucggcgguaacagcugugcaagcggaccggugggaaaggcacuaagugacgcguguaugggagcaguagcaaguuuccuaacaaaauaucaggauauaaucuuagaacaccagaaaguaauaaaaaagaaugagaaaagauuagccaaucuaaaggauaucgcaucugcuaacggauuagcauucccaaagaucacauuaccaccacaaccacacaccaaagaagggauugaagcuuauaauaacguaguggcccagauaguaauauggguaaaucugaacuuguggcaaaaauuaaaaauaggaagagaugaagcuaagccacugcagagauugaaaggauucccauccuuucccuuaguagaaagacaagcaaaugaaguagacuggugggacauggucuguaacguaaaaaaauuaauaaaugaaaagaaagaagacggaaaagucuuuuggcaaaacuuagcaggauauaaaagacaagaagcacuauuaccuuaccuaaguagugaagaagacagaaaaaagggaaaaaaauucgcacgauaucaauuuggugauuuauuacuucaccucgaaaaaaaacacggagaagauuggggcaaaguauacgacgaagcgugggagagaauagacaaaaaaguagaaggauuaagcaaacacauaaaacuagaagaagaacguagaucagaagacgcacagucaaaagcagcucuaacagauuggcuaagggccaaagcaucauuugucauagaaggacuaaaagaagcagauaaagacgaauucugcaggugugaauuaaaauuacaaaaaugguacggagacuuaagaggaaaaccauucgcaauagaggcagaaaacucaauacuagacauaucggguuucaguaaacaauauaacugcgcauucauauggcaaaaagacggcguaaaaaaacuaaacuuauauuugauaauaaauuacuuuaaaggaggaaaacuaagauuuaaaaaaauaaaaccggaagcauuugaagcaaacagauucuacacaguaaucaacaaaaagagcggagaaauaguacccauggaaguaaacuucaacuuugacgauccaaaccuaauaauuuuaccucuggcuuuuggaaaacgacaaggaagagaauuuauauggaaugauuuauuaucauuagaaacagggucgcugaaacuagcaaauggcagaguaauagaaaaaacacuuuauaauagacgcacacgccaagaugaaccagcgcuuuucguagccuuaacauucgaaagaagggaaguacuagauucuagcaacaucaaacccaugaaucucauaggcauagauagaggagaaaacauuccagcaguaaucgcgcuaaccgauccugaaggauguccacuuucacgauucaaggauucauuaggaaacccaacacacauucuaaggauuggcgaaucuuauaaagaaaaacaaaggacaauacaagcagcaaaagaaguagaacaaagaagagcgggaggcuauagucguaaauacgccucgaaagcuaaaaaucuagcagaugacaugguacggaacacagcaagagacuuacuauauuacgccguuacgcaggacgcaauguuaaucuuugaaaacuuaaguagaggauuugguagacaaggaaaaaggacguuuauggcagaacgacaauauacuaggauggaagacuggcuuacagccaaacuagcauacgaaggacuuccaucaaaaacguaccuuagcaaaacccucgcucaguauacaucaaaaacuugcagcaacuguggauuuacaauaacaucagccgauuaugaucgaguauuagaaaaacuaaaaaaaacggcaacuggauggaugacuacaaucaacggcaaagagcucaaaguagagggacaaauaacauauuacaacagauauaagcgacaaaaugugguaaaagacuuaucaguugaauuagaccgacuaagcgaagaaucuguaaacaacgacauaaguucauggacgaaaggaagaucaggagaagccuuaaguuuauuaaaaaaaagguucucacaccgcccaguccaagaaaaauucguaugucuaaacuguggauucgaaacacacgcggaugaacaggccgcacuaaacauagcaagaucuugguuauuccucagaucacaggaauacaaaaaguaccaaacaaauaaaacaacgggcaauacagauaaaagagcauuuguagaaacauggcaaucauuuuacaggaaaaagcuaaaagaaguuuggaaaccagcuguguag

SEQ ID NO: 11950 - RNA, 3378 nt, Artificial Sequence
  CasY variant__Candidatus Katanobacteria bacterium__OJI08769.1__CasY
augagaaagaaacuguucaaaggcuauauacuacacaacaaacgacuugucuauacugguaaagcagcaauacggucuauuaaauacccccuaguagcaccuaacaaaacagcacucaacaaucuuagugagaaaauaaucuacgauuacgaacacuuauuuggcccauuaaacguugcauccuaugcacgaaauucaaaccguuacaguuuaguagauuuuuggauagauucccuuagagcaggaguaauauggcaaucaaaaucaacaucgcucaucgaccuuauaucaaaacucgaaggaagcaaaagcccaagugagaaaaucuucgaacaaauagacuuugaacuuaaaaacaaauuagauaaagaacaguucaaagacaucauacuacuaaacacagguauacggucuuccagcaauguacguucauuaagaggacgauuuuuaaaaugcuuuaaagaagaauuuagagauaccgaagaaguaauagcuugcguagacaaauggucuaaagaccuaauaguugaagguaaaaguauacuugugagcaaacaguuucuauauugggaagaagaauuuggaauuaaaaucuucccccacuuuaaagacaaccaugauuuaccgaaacuuacuuucuuugucgaaccaucacuagaauuuucaccccauuuaccacuagccaauugcuuggaacgacucaagaaauuugacauuagccgggaaaguuuacuaggcuuggacaacaauuuuucugcauucucuaacuacuuuaacgaguuauucaauuuacuaagucgaggcgaaauuaagaaaauaguaacagcuguucuugcggucagcaaaagcugggaaaaugaaccagaauuagaaaaacguuuacacuuccuaagugaaaaagcaaaauuauuaggauauccaaaacucacuuccaguugggcugauuacagaaugauaauugggggaaaaauuaaaucauggcacucaaauuauacugaacaacuuaucaaagugagagaagacuuaaagaaacaucaaauagcacuagauaaacuccaagaagaucucaagaaaguuguagacucaucacuacgagaacaaaucgaagcacaacgugaagcauugcuucccuuauuagacacuauguuaaaagaaaaagacuucuccgacgauuuagaacuauauagauucauauuaagcgauuuuaaaucguuacugaacggaucauaccaacgauacauacaaacugaagaagaaagaaaagaagaccgcgacgucacuaagaaauacaaagacuuauacagcaacuuacguaauauaccaagauuuuucggagaaucaaagaaagaacaauucaauaaauuuauaaauaaaagucuacccaccauagacguuggucuaaaaauacuugaagauauacgaaaugcacuagaaacaguuucuguucguaaacccccuucaauaacagaagaauaugugacgaaacaauuggaaaaacucucacgaaaauacaaaauuaaugccuucaauaguaacagauucaaacagauaacagaacaaguccuccgaaaauauaauaacggagaacuuccgaaaauuagcgaaguguuuuauagguauccaagagagucucauguugcaauccgcauacuaccaguaaaaauaagcaacccgagaaaagacauaucauaccuauuagacaaauaccaaaucaguccagauuggaaaaauucaaacccaggugaaguaguggaccuaauagaaaucuacaaauuaacccucggauggcuacuaucuuguaauaaagacuuuucaauggauuuuucaagcuaugaccugaaauuauucccagaagcagcaucacucauuaaaaauuuuggaagcugcuuaucaggauauuaucuaucaaaaaugauauucaacuguauaacauccgaaauaaaaggaaugauuacccucuacacaagagauaaauuugucguuagguaugucacgcaaaugaucggaagcaaucaaaaauucccacuguuauguuuaguuggagaaaaacaaacgaaaaacuuuucaagaaauuggggaguacuaauagaagaaaaaggagaccuuggagaagagaaaaaucaggaaaaaugucucauauucaaagacaaaacagauuucgcaaaagcuaaagaaguagaaauauucaaaaauaacauuuggcgaauuagaaccucaaaauaucaaauacaauuccuuaacagacuuuuuaagaaaacaaaagaaugggaccuaaugaaccuaguacucuccgaaccaucacugguguuagaggaagaaugggguguaaguugggacaaagacaaacuacuaccacuccugaagaaagagaaaaguugcgaagaacgccucuauuacagccuaccacugaacuugguuccagcaacagacuauaaagaacaaagugccgagauugaacaacgcaacacauaccuaggcuuagacguaggugaguucggcgucgcauaugcagucguaagaauaguaagggauagaauagaacuauuaucuuggggcuuccuaaaagacccagcguuacgaaaaauaagagaaagaguccaagauaugaaaaagaaacaaguuauggcaguuuuuaguagcaguaguacagcuguagccagaguacgugaaauggccauacauucauuaagaaaccaaauucauucuauugcucucgcauacaaagcaaaaauuauuuaugaaauuuccauaucaaauuucgaaacuggugguaauagaauggcuaaaauauaucgaucaauaaaagucagugacguuuaccgagaaucuggagcagauacgcuagucagcgaaaugauauggggcaagaaaaacaaacaaaugggaaaccauauaucaucauacgcaacaucauauacuugcuguaacugcgccagaacaccauuugagcuugugauugauaacgauaaagaauacgaaaagggaggagacgaauuuauuuuuaacguaggagacgaaaagaaagucagaggcuuccugcaaaagagcuuacuaggaaaaacaaucaaaggaaaagaaguacugaaaucaauaaaagaauaugcaagaccaccuauuagggagguacuacuagaaggggaagacguugaacaacuucuaaaaagaagaggcaacucauauaucuacagauguccauucuguggauauaaaacagaugcagauauccaagcagcuuuaaacauugcauguagaggauacauuucugauaaugcaaaagacgcaguaaaagaaggcgagcggaaacucgauuacauacuagaaguuagaaaauuaugggagaaaaacggagcaguguuaagaucagcuaaauuccuauaa

SEQ ID NO: 11951 - RNA, 3864 nt, Artificial Sequence
  CasY variant__Candidatus Kerfeldbacteria bacterium__OGY82221.1__CasY
augaaacgaauuuuaaacucccuaaaaguagcagcacucaggcuauuguuccgaggaaaaggaagcgagcugguaaaaacuguuaaauauccauuaguaucacccguacaaggagcaguagaggaacuugcagaagcuauacgacaugauaacuuacacuuauuuggucaaaaagaaauuguagaucuaauggaaaaagaugaaggaacgcaaguuuauagcgugguugauuucuggcuugacacacuacgucuagguauguucuuuucaccauccgcaaaugcguuaaaaauuacacuugggaaauuuaauagugaucaagucucucccuuuagaaaaguuuuagaacaaucacccuucuuucuugccggacgacuaaaaguagaacccgcagaaaggauacucagcgucgaaauaagaaaaauaggaaaaagagagaauagaguagaaaacuacgcagcagacguagaaacauguuuuauaggacaacuaucuagugaugaaaaacaaaguauacaaaaauuggcgaacgauauaugggauucaaaagaccaugaagaacaaagaauguuaaaagcagacuucuuugcaauaccacucauaaaagauccuaaagccguuacagaggaagacccugaaaaugaaacagccggaaaacaaaaaccacucgaauuaugcguaugcuuaguaccagaguuauauacaagaggauuuggaucuauagcagacuuuuuaguccaaagguugacauuacuaagagauaaaaugaguacagauacagcagaagacugccuagaauacguaggaauagaagaagaaaaggguaauggcaugaacucucugcuaggcaccuuucuaaagaauuuacaaggugacggguuugaacaaauauuccaguucauguugggaucuuacguaggcuggcaaggcaaagaagauguccuacgggaacgauuggauuuacuugcugaaaaaguuaaacgacuaccuaaaccuaaauuugcaggagaauggagcgggcaucgaauguuucuacacggacaacuaaaaagcuggaguucaaacuucuuucgucucuucaaugagacgagagagcuacucgagucuaucaaaagcgauauucaacaugcaacuauguugauaucguacguagaagaaaaaggagguuaucauccucaacuuuuaucacaguacaggaaacuaauggaacaauuaccagcuuugagaacgaagguacuugacccagagauugagaugacacauaugucugaagcagucagaagcuacauaaugauacacaaaucgguagcuggcuuuuuaccugacuuacuugaaagucuugaccgagacaaagaucgugaguuccuguuaaguauauuuccgcggauuccgaaaauagacaagaaaacaaaagaaaucguagcaugggaauuaccuggugaaccggaagaagguuaccuauuuacugcaaauaaucuuuucagaaacuuccuugaaaaucccaaacauguuccaagguuuauggcggaaagaaucccagaagauuggacucgacuccgauccgcaccagucugguuugaugguauggucaaacaauggcaaaaaguaguaaaucaauuaguagaaucgccaggcgcucuauaccaguuuaacgaaaguuuccuaagacaacgucuucaagcaauguuaacaguguauaaacgagaccuucaaacggaaaaauuccuaaaauuauuagccgacguauguagaccccuaguagauuucuuuggacuagguggaaaugauauaauuuuuaagucaugccaagacccaagaaagcaauggcagaccguaauuccauugagugucccggccgauguauauacugcuugugaaggauuagcgauaagauuacgugaaacccuaggauuugaguggaaaaaccuaaaaggacaugaacgcgaagauuuccugcgucuccaucaacuacuagggaaccuauuauuuuggauaagagaugcuaagcuaguagucaaauuggaagauuggaugaauaaucccugcguacaagaauacguagaagcaagaaaagcaauagauuuaccguuagagauauucgguuuugaaguuccgauauuccuuaacggcuaccuauucagcgaacuuagacaacuggaacuucugcugaggcgaaaaagcgucaugaccucauacucuguaaaaacaacuggaucaccuaacagauuauuccaauuaguauaccuuccccuuaaccccagugauccagaaaagaaaaauuccaauaacuuucaagaaagauuagacacaccaaccggacucaguagaagauuccuagaccucacguuagacgccuucgcaggaaaacuccuaacagauccaguaacacaagaacuaaaaacaauggcaggauucuaugaccauuuauuuggguucaaauuacccuguaaacuagcagcaaugaguaaucauccuggaaguucaucgaaaaugguaguccuagcaaaaccgaagaaaggaguagccagcaauauaggauucgaacccauaccugacccugcacaccccguauuuagaguuagaaguucauggccggagcuuaaauauuuagaagggcuguuauauuugccagaggauacaccacuaacuauagaacuagcagaaacauccgucagcugucaaucaguuucuagcguugcauuugaucuuaaaaauuugacuacaauacuaggccgagucggagaguucagaguaacagcugaccaaccauuuaaauuaacccccauaauuccagaaaaagaagaaaguuucauugguaaaaccuacuuaggacuagaugcaggagaaagaagcggaguaggauuugcuauaguaacuguugauggagacggauaugaaguacaacgacuaggagugcaugaagauacacaacugauggcacuacaacaaguagcaaguaaaucauuaaaagaaccaguuuuccaacccuuaagaaaagguacuuuucgacaacaggaacggauaagaaaaucacugagaggguguuacuggaacuuuuaucacgccuuaaugauuaaauauagagcuaaaguaguucaugaagaaagcguagguagcaguggguuaguuggacaauggcucagggcauuccaaaaagaucuuaagaaagcugauguguuaccaaagaaaggugguaaaaauggaguagacaaaaagaaaagagagucaucagcccaagacacauuguggggaggcgcauucucgaagaaagaagaacaacaaauagcauuugaaguacaagcugcgggaagcagucaauuuugccuaaaaugcggauggugguuccaacugggcaugcgcgaaguuaaccgaguacaggaaucuggagugguucuugauuggaaccgaucaauaguaacauucuugauugaaucaagcggagaaaaaguauauggcuuuuccccacaacaacuagaaaaagguuuuaggccugauauagaaacuuuuaagaaaaugguccgcgacuuuaugagaccaccaauguuugaucgaaaaggacguccagcagccgcuuaugagagauuuguacucggaagaagacacagacgauacagauuugacaaaguuuucgaagagagguucggacgaucugcacuauucauuuguccacgaguaggauguggcaauuucgaucacaguagugaacaaucggcaguaguauuagcauuaauuggauacauagccgauaaagaagguaugucugguaagaaacugguauauguuagauuagcugaauuaauggcggaauggaaauuaaagaaacucgaaagaucacgaguagaggaacaaucauccgcacaauaa

SEQ ID NO: 11952 - RNA, 3579 nt, Artificial Sequence
  CasY variant__Candidatus Komeilibacteria bacterium__OJI06454.1__CasY
auggcagagaguaaacaaaugcaauguagaaaauguggugccagcaugaaauacgagguaauuggccuagggaaaaaaagcuguagauacaugugcccugacugcgggaaucauacaucagcgcgcaaaauacaaaauaaaaaaaaaagagauaaaaaauaugguucagcaucaaaagcacagucacaacgaauagcaguagccggagcauuauacccagauaagaaagugcaaacuaucaaaaccuauaaauacccagcggacuuaaacggggaaguccacgaucgaggaguugccgaaaaaauagaacaggcgauacaagaagacgaaauaggguuguuaggaccgucuuccgaauaugcaugcuggauagcuagccagaaacagucagaaccauauuccguuguugauuucugguuugacgcaguuugugccgguggaguuuuugccuauaguggagcuagacuccuaaguacuguuuuacaacuuagcggagaagaaagugugcuuagagcagcacuagcaucaucaccauucguagacgacauaaaucuagcacaagccgaaaaauucuuagccguuucaagaagaacaggucaggauaaauuaggaaagcgaauuggcgaauguuuugccgaaggaagacuugaagcucuaggcauuaaagauagaaugagggaauucguacaggcuauagauguagcucaaacagcaggccaaagguuugcagccaaacuaaaaauauucggaauaagucaaaugccugaagcaaaacaauggaacaacgauagcggauugacaguaugcaucuugccugacuauuacgucccagaggaaaauagagccgaucaauuaguaguauuacuccguagauuaagagagauagccuauuguaugggaauagaagaugaggcaggguuugaacaucuaggcauugauccuggagcacuuaguaauuucagcaauggaaaucccaaaagaggguucuuagggagacuacuaaauaacgacauuauagcacuagcaaauaauaugucagcaaugaccccuuauugggaaggaagaaaaggcgaacuaauagaaagauuagcuugguuaaaacacagggccgaaggacuauaucuaaaagaaccacacuucggcaauuccugggcagaccaucgaucaagaauauuuucaagaauagcuggcugguuaucagguugugcaggaaaacuuaaaauagcaaaagaccaaauaucaggagucaggacugaucuuuuucuacuaaaacgacuucuggacgcaguaccacaaucagcuccaucucccgauuucauagcaucuauaagugcguuagaccgauuuuuggaagcagcggaaucaagucaagauccugcagaacaaguucgagcucucuaugcuuuccacuugaaugcaccugccguaagaaguauagccaauaaagcuguccaacgaucugauucccaagaauggcuaauuaaggaacuagacgcaguugaucacuuagaguuuaacaaagccuucccauuuuuuucugauacaggaaaaaaaaaaaaaaaaggugcgaacucaaacggagcgcccagugaagaagaauauacagaaacugagucaauacaacaaccagaagacgcagagcaagaaguaaauggucaggaaggcaauggggcaucaaaaaaucagaaaaaauuucaaagaauaccacgauuuuuuggagaaggaucucguucagaauacagaauacuuacagaagcaccucaguauuucgacauguuuuguaauaauaugagagcaauauucaugcaacuagaaagucagccgagaaaagcgcccagagauuuuaaauguuuuuuacaaaauagauugcaaaaauuauacaagcaaacuuuccuaaaugcacgaucaaacaaaugcagagccuugcuugaaucaguccugauaucauggggagaauuuuacacuuacggagcaaaugaaaaaaaauuuagauugagacaugaagcaagcgaaagaucuucugacccagacuauguagugcaacaagcacuagagauagcacgaagauuauucuuauuuggauucgaauggagagauugcagcgcuggugaacgaguagacuuaguagaaauacacaagaaagccauaagcuucuuacuagcaauuacgcaagcagaaguaucaguaggaucuuauaacugguuagguaauaguaccguaucacgauauuuaucuguagcagguacagauacacuuuauggcacucaacuagaagaguucuuaaaugcaacaguacuuucacaaaugaggggcuuagcgaucagacuuaguucacaagaauuaaaagaugguuuugauguucaacuagaaagcaguugccaagauaauuuacaacauuuauuaguauacagagcaaguagagauuuggcagcuuguaagagagcaacuugucccgcugaauuagacccaaaaauacuaguacuaccagcaggugcguuuaucgccaguguaaugaaaaugauagagcgaggugaugaaccuuuagcaggagcauaucuaagacauagaccacacuccuucggguggcaaaucagaguacgaggaguagcggaaguaggaauggaccagggcaccgcuuuagcuuuucaaaaaccuacugaaagugaacccuuuaaaauaaaaccuuuuucagcacaauacggcccaguauuauggcuaaacucgucgagcuauucacaaagccaauaucucgauggauuuuuaagccagccuaagaauuggucaaugaggguuuuaccacaagcgggaagcguaagaguagaacaacgugucgcauuaauuuggaaucuacaagcuggaaaaaugcgauuagaaaggucuggagcucgagcauuuuuuaugccaguaccuuuuucauucagaccaaguggaaguggcgaugaagcuguguuagcaccaaauagauaucucggacuguucccccauucuggcgggauagaauaugcuguaguagauguacuggauucggccggauucaaaauccuagaaagaggaacuauagcaguaaauggauuuagucagaaaagaggugaaagacaagaagaagcucaucgagagaagcaacgcagaggaauaucagauauuggaagaaaaaaaccaguacaagcagagguagacgcggcuaaugaacuacacaggaaauauacagacguugcuacaagauuggguuguagaauagucguacaaugggcuccccaaccuaaaccggguacagcgcccacagcacaaacaguauaugcgagggccguuagaacugaggcaccaagaucuggcaaucaagaagaccaugcucgaaugaagagcucguggggauauacauggucaacuuauugggaaaaaagaaaaccggaggacauuuuaggaauaucgacgcaaguuuauuggaccgggggaauuggagaaucaugcccugcuguugccguagcuuuacuaggacauauaagagcaacuuccacacaaacugagugggaaaaagaggaaguaguauuuggacgauuaaaaaaauuuuucccgucuuaa

SEQ ID NO: 11953 - RNA, 3633 nt, Artificial Sequence
  CasY variant__Candidatus Parcubacteria bacterium__APG80656.1__CasY
augucgaaaaggcacccuaggauuagcggaguaaaaggcuauaggcuucaugcacaacgacuagaauacacaggaaaaucaggcgcaaugagaacaauuaaauacccacuauauaguucaccuucaggagguaggacaguaccaagagaaauaguuucagcgauuaaugaugacuauguuggacuauacggauuaucaaacuuugaugaucuauacaaugcagaaaaacgaaacgaagagaagguauauagcguauuagacuucugguacgauugcguacaauacggagcagucuuuucauacacagcaccaggucuucuaaaaaaugucgcagaaguacgaggcggaucguacgaacucacaaaaacucuaaaaggaagucaccuauacgacgaauugcaaauagacaaagugauaaaauuccuaaauaaaaaagaaauuucaagagccaauggaucacuagauaaacuuaaaaaagacauuaucgacugcuucaaggcagaauauagagaaagacauaaagaccaauguaauaaauuggcagaugauauaaaaaaugccaaaaaagacgccggggcaagucuuggagagagacagaaaaaacuauuuagagauuuuuuuggaauaucagagcaaucagaaaacgacaaaccaaguuuuaccaacccuuuaaauuuaaccuguuguuuacuaccauuugauacagucaacaacaaccgaaaccggggggaaguguuguucaacaaauuaaaagaauaugcccaaaagcuugauaaaaaugaaggaucacuugaaaugugggaguauaucggaauaggaaauagcgguacagcuuucaguaacuuccuaggagaaggguuccucggacgacucagagagaauaaaauaaccgaacuuaaaaaagcaaugauggauauuacagaugcauggagaggacaggaacaagaagaggaauuagaaaaaagacuuagaauacuggccgcacuaaccaucaaacuacgagaaccaaaauuugacaaccauuggggagguuauagaagcgacaucaacggcaaauuaaguucauggcuacaaaacuacaucaaucaaaccguaaaaaucaaagaagaccugaaaggccauaaaaaagaucuuaaaaaggccaaagagaugaucaaucgauuuggcgaaucagacacuaaagaagaagcaguaguaaguucucuauuagaaucaauagaaaaaauaguucccgaugacagugcagacgaugaaaagccagauauaccagcuaucgccaucuaucgucgauuucuuucagacggaagauugacuuugaacagauucguccagagagaagacguucaagaagcauugauaaaagaacgccuagaagccgaaaaaaaaaaaaaaccuaaaaagaggaaaaaaaaaagugacgcugaagacgaaaaagagacaauagacuuuaaagaacuauucccacaccucgcaaagccucuaaaauuaguaccgaacuuuuacggagauucgaaaagagaacuauauaaaaaguauaaaaacgccgcaauuuacacagaugcucuauggaaagcaguagaaaaaauauauaaaucugccuuuuccucaagucuaaaaaauucauuuuucgacacugauuucgacaaagauuucuuuauuaaacgguuacaaaaaauuuuuucugucuaucgaagauucaauacagacaaauggaagccaauagucaagaacucuuuugcaccauacugcgauauaguaucauuagcggaaaacgaaguauuauauaaaccaaaacaaagcagaucuagaaaaucagcugcuauagauaaaaacagaguacguuuaccaucaaccgaaaacaucgcaaaagcaggaauagcacuagcaagagagcuauccguagcaggguuugauuggaaagauuuacuaaaaaaagaagaacaugaagaauauaucgaucuuaucgaauuacauaaaacugcauuagcucuacuccuggcagucacagagacccaauuggauauauccgcuuuagacuuuguagaaaacggcacuguaaaagauuucaugaaaacacgcgacggaaaccuugucuuagaaggccguuuccuugaaauguuuucacaaucuauuguauuuucagagcuaagaggguuagcaggauuaaugaguagaaaagaauuuauaacacgaucugcaauucagacaaugaauggaaaacaagcagaacuauuauacaucccacaugaguuccaaucagccaaaauaacuacuccaaaagaaaugaguagagcauuccuagaccuagcaccagcagaauucgcaacaaguuuagaaccagagagcuuaucagaaaagucccuccuaaaacuuaaacaaaugagguacuauccccacuacuucggguacgaacuaaccagaacaggacaagggauagacggaggagucgcggaaaacgccuugagacucgaaaagaguccagucaaaaaaagagaaauaaaauguaaacaauauaaaacacuaggacgaggacaaaacaaaauaguuuuauacguacguaguaguuauuaucagacacaauuccuagaaugguuucuacauagaccaaaaaauguccaaacagacguggcaguaaguggcucauuuuuaaucgacgaaaagaaagugaaaacuagauggaauuaugaugcacuaaccgucgcacuggagccaguaucaggaucagagagagucuucgucagucaacccuucacuauauuuccggaaaaaucugcugaagaagaaggacaaagauaucuaggaauugauaucggagaauacgggauagcauacacagcuuuagagauaacuggagauagugcaaaaauacuagaucaaaacuuuauaagcgacccacaguuaaagacauuacgugaagaaguaaaaggacucaaacuagaucaaaggcgaggcacuuucgcaaugccaagcaccaaaauagccagaauacgcgaaucauuaguucacagccuaagaaauagaauacaccauuuagcacucaaacacaaagcgaaaauaguauacgaauuagaagucucacguuucgaagaaggaaaacaaaagauaaaaaaaguauaugccaccuuaaaaaaggcagaugucuauagugaaauugacgccgauaaaaaucuacaaacaaccguauggggaaaacuagcaguagcaagcgaaauaucggcaucuuauacaucacaauuuuguggugcauguaaaaaacucuggagagcggaaaugcaaguggacgaaacaaucacaacgcaagaacuuauaggaacagucagaguaauuaaaggaggcacucuaauagaugccauaaaagacuuuaugagaccgccaaucuuugacgaaaaugauaccccauuuccaaaauauagagauuucugugacaaacaccauauaucuaaaaaaaugcgcgguaacagcuguuuauuuauaugucccuuuuguagagcuaaugcagacgcugauauacaagcaucacaaacgaucgcguuacuuagguauguaaaagaagaaaaaaaagucgaagauuauuuugaaagauuucgaaaacuaaaaaacaucaaaguccucggccagaugaaaaaaauauaa

SEQ ID NO: 11954 - RNA, 3681 nt, Artificial Sequence
  CasY variant__Candidatus Vogelbacteria bacterium__OJI07455.1__CasY
augcaaaaaguacguaaaacauugagugaaguccauaaaaauccuuacggaacaaaaguaagaaaugcaaaaacaggauauagccugcaaauagaacgguuaucauacaccggaaaagaaggcaugcggaguuucaaaauaccuuuggaaaauaagaacaaagaaguauucgaugaauuuguaaaaaaaauaagaaacgacuacauaucccaggucggacuccuaaaucuaagcgauugguaugaacacuaucaagaaaaacaagaacauuauuccuuagccgauuucuggcucgauucuuuaagagcaggaguaauauucgcacauaaggaaacggaaauaaaaaauuuaaucucaaaaauacgcggcgauaaaagcauaguugacaaguucaaugcgucaauaaaaaaaaaacacgcagacuuauacgccuuaguugauauaaaagcacuuuaugauuuccucaccagcgacgcaagaagaggccugaaaacagaagaagaauucuuuaacucaaaacgaaauacccucuucccaaaauuccgcaaaaaagacaauaaagcaguagauuuauggguaaagaaauucauaggauuggauaacaaagacaaauuaaauuuuacaaaaaaauucaucggauuugaucccaauccacaaauaaaauacgaucacacauucuucuuccaccaggauauaaauuucgacuuagaacgaauaacaacaccgaaggaauuaauaucuacauauaaaaaguuccuugguaaaaacaaagacuuauacggcucugaugaaacuacugaagaucaauuaaaaaugguucuaggcuuucacaacaaccauggugcauucucaaaauacuucaacgcaaguuuagaagcguuuagaggacgugacaauagcuuaguagaacaaauaauaaauaacaguccuuauuggaauucacacagaaaagaacucgaaaaaagaauaauauuccuacaaguucaaucuaaaaaaauuaaagaaaccgaguuaggaaagccacacgaauacuuagccucguucggaggcaaauucgagucauggguaucaaauuacuuaagacaagaagaagaaguaaaaagacagcuauucggauacgaagaaaacaaaaaaggacaaaagaaauucauagucgguaauaaacaggaauuagacaaaauaauucgaggaacugacgaauacgaaauaaaagcaaucucaaaagaaacaauaggcuuaacacaaaaaugucuaaaacuacuagaacaauuaaaggauucagucgaugauuacacacuaucauuauacagacaacuaauuguggaacuaagaauaagauuaaauguagaauuccaagaaaccuacccugagcuaauagggaaaucagaaaaggauaaagaaaaagacgcaaaaaauaaaagggcugauaaacgauauccccaaauauucaaagacauaaaacuaauaccaaacuuuuuaggagaaacaaaacagauggucuacaaaaaauuuaucagaucagcugacauccucuacgaaggaauaaacuuuauugaccaaauagauaaacagauaacacagaacuuacuaccguguuucaaaaacgauaaagaaagaauagaauucacagaaaaacaauuugaaacucuaagaagaaaauacuaucucaugaauucaaguagauuucaccaugucaucgaagguaucauaaacaacagaaaauuaaucgaaaugaagaaaagagagaacagcgaauuaaaaacauucuccgacucgaaauuuguguugucgaaacuauuccucaaaaaaggcaaaaaauaugaaaaugaagucuacuauacuuuuuacauaaacccaaaagcaagagaccaacgcagaauuaaaauaguucuagacauuaaugggaacaauagcguugguauacuucaagaccuaguacaaaaacuaaaaccaaaaugggacgacauaaucaaaaaaaaugacaugggcgaacuaauagaugcaauagaaauagaaaaaguacgucuaggcauccugauagcacuauauugugaacauaaauuuaaaauaaaaaaagaacugcuaucguuagaccucuuugcauccgcauaccaauaccucgaacuagaagacgacccagaagaacuaucaggcacuaaccuaggacgauuccuacaaagucuaguuugcucagaaaucaaaggagccauaaacaaaauaagcagaacagaauacauagaaagauacacaguccaaccgaugaacacagaaaaaaacuauccauuguuaauaaauaaagaagguaaagcaacauggcauaucgcagcgaaagacgaucucagcaaaaaaaaaggaggaggaacagucgccaugaaccaaaaaauaggaaaaaauuuuuuuggaaaacaagacuacaaaacaguauuuaugcuacaagauaaacgauucgacuuacuaacaaguaaguaucacuuacaguuccuuucuaaaacacucgacaccgguggaggaagcugguggaaaaacaaaaacauagauuuaaaccuaaguagcuauaguuuuauauuugaacaaaaagucaaagucgagugggaucuuaccaaccuagaucauccaauaaaaauaaaaccgucugaaaauuccgacgauagacgacuuuucguauccauuccauucguaauaaagccaaaacaaacaaaacgaaaagaucuacaaacaagaguaaauuauaugggaauagauaucggagaauacggacuagcauggacuauaauaaauaucgauuuaaaaaacaaaaaaauaaauaaaaucuccaaacaagguuucauuuacgaaccacugacucauaaagucagagauuacguagcaacgauaaaagacaaccaaguaagaggaacauuuggaaugccagauacuaaacuagcacgauuaagagagaacgcuauuacuucccucagaaaucaaguacacgacauagcuaugcgauacgacgcaaaaccaguauacgaauucgaaauaagcaauuuugaaacgggaagcaacaaagugaaaguaauauaugauucagucaaaagagcugauauuggcagaggacaaaauaacaccgaggcugauaauacagaaguaaacuuaguauggggaaaaaccucgaaacaauuuggaucacaaaucggagccuacgcaacuagcuauaucugcucauuuugcggauauagccccuacuaugaauuugaaaacucuaagucaggagacgaagaaggagccagagacaaccuuuaccaaaugaaaaaauugucccgccccagucucgaggacuuuuuacaagguaauccaguuuauaaaacguuuagagacuuugauaaauacaaaaaugaucaaagacugcaaaagaccggagauaaagauggcgaguggaagacacauagaggaaacacagccaucuacgcaugccaaaaaugucgccauauaucagacgccgacauccaagcauccuacuggaucgcacugaaacaggucguaagagauuucuacaaggacaaagaaauggacggagacuuaauacaaggugacaauaaagacaaacgaaaaguuaacgaacuaaaucggcuaauaggaguucacaaagacguacccauaauaaacaaaaauuuaauaacaagccuagauaucaaucuacuauaa

SEQ ID NO: 11955 - RNA, 3603 nt, Artificial Sequence
  CasY variant__Candidatus Vogelbacteria bacterium__OJI09436.1__CasY
augaaagcaaaaaaaagcuucuauaaccagaaacgaaaauuuggaaaaagaggauacagauuacaugacgaaaggaucgcauauuccggaggaaucggaagcaugagaaguaucaaauaugaacucaaggauucauaugguauagcaggacuacgaaaccgaauagcugaugcaacaauaucagauaacaaguggcuauauggaaauauaaauuuaaacgacuaucucgaauggcgaucaucaaaaacagauaaacaaauagaagacggcgacagggaaucuucauugcuagguuuuugguuagaagcauuaagguuaggcuucguuuuuucaaaacaaagccacgcaccaaacgauuucaaugaaaccgcuuuacaagaucuauucgaaacccuagaugacgauuuaaaacacguccuagaucgaaaaaaauggugugauuucauaaaaauaggaacuccaaagaccaacgaucagggcagacucaaaaaacaaauaaaaaaucuccuaaaaggaaauaaaagagaagaaaucgaaaaaacauuaaacgaaucagaugacgaacucaaagaaaaaauaaauagaaucgcagacguauucgcgaagaacaaaagcgacaaauacacaauauucaaauuagauaaaccgaauacugaaaaauauccgaggauaaacgaugugcagguagcauucuucugccacccagauuuugaagaaauaacagagagagaucguacuaaaacauuggauuuaauaauaaauagguucaacaaaagauacgaaaucacugaaaacaaaaaagaugauaaaaccaguaauagaauggcccuauauagucucaaccagggguauaucccacguguauuaaaugaucucuucuuauuuguaaaagacaacgaagaugauuucagccaauucuuaagcgacuuagaaaacuucuuuucguucucaaacgagcaaauuaaaauaauuaaagaacgacuaaaaaaauuaaaaaaauacgccgaaccaauacccggaaaaccgcaauuagcggacaaaugggacgauuaugcuagcgacuucggaggaaaacuugaaucaugguauaguaaucgaauagaaaaacuaaaaaagauuccagaaucagucagugaccuucgaaacaaucuagaaaaaauuagaaauguauuaaaaaagcaaaauaaugcaucaaagauacuagaguuaucucaaaagauaauagaguauauccgcgacuauggagucagcuucgaaaagccugaaauaauaaaauuuucauggauaaacaaaacaaaggacggacaaaaaaaaguuuucuacgucgccaaaauggccgacagagaauuuauagaaaaacucgaucuauggauggcggaccuaagaagccaauuaaacgaauacaaccaggauaauaaaguuucauuuaaaaaaaaaggaaaaaaaauagaagaacucggaguacuugauuuugccuuaaauaaagcuaaaaaaaauaaauccacaaaaaaugaaaauggauggcagcaaaaacuaucagaaucaauucagagcgcaccauuauucuuuggagaaggcaaucguguaagaaaugaggaaguauacaaccugaaagacuuauuauucucagaaauaaaaaauguugaaaauauauuaaugucauccgaagcggaggaucuuaaaaauaucaaaauagaauacaaagaagauggagccaaaaaaggaaacuauguacuaaacguauuagcaagauuuuacgcaagauuuaacgaagacgguuacgggggauggaauaaagucaaaacaguauuagaaaauaucgccagggaagcaggaacagauuuuagcaaauacggcaacaauaacaaccgaaaugcaggcagauuuuaucucaacggaagagaacgccaaguuuuuacacuuauaaaguuugaaaaaucaauaacagucgaaaaaauuuuagagcuagucaaacugcccucauuacuagaugaagcguauagggaucuugugaacgaaaacaaaaaccacaaacuaagagacguaauacaauuaaguaaaacuauaauggcuuuaguccuuagucacucggacaaagaaaaacaaauaggagggaacuacauacacaguaaauugaguggauacaaugcacuaauaaguaaacgugauuuuauaucuagauauuccguacaaacgacuaacggaacacaaugcaaacuagcaauaggcaaaggaaaaaguaaaaaaggaaaugaaauagauagguauuuuuaugcauuucaauuuuuuaaaaaugacgacucaaaaaucaauuuaaaaguaauaaaaaacaacagucacaaaaacaucgacuucaacgacaacgaaaacaaaauaaacgcccuacaagucuacagcaguaacuaucagauacaauucuuagauugguucuuugaaaagcaccaaggaaaaaaaacaucauuagaaguuggugguagcuucacaauagcagaaaaaagucuuacgauagacuggucgggaucuaaucccagaguuggguucaaacguucagauacagaagaaaaaagaguauuuguaagucaaccauuuacacugauaccagaugaugaagacaaagaaagacgaaaagaacguaugauaaagacaaaaaacagguucauaggcauagacauuggagaauacggacuagcauggucauuaaucgagguggacaauggugauaaaaauaaccgaggcauaagacaacuugaguccggauucauaaccgauaaccaacaacaaguacuaaaaaaaaauguaaaaucauggagacaaaaccaaauaagacaaaccuuuaccucucccgacacaaaaauagccaggcuaagagaaucucuaauuggaagcuauaagaaucaauuagaaagcuuaaugguugcgaaaaaagccaaccuaagcuucgaauacgaagucaguggauucgaagucggaggaaaacgaguagcaaaaauuuacgacagcauaaagagggguaguguacgcaaaaaggauaacaauucucagaacgaucagaguuggggcaaaaaaggaaucaaugaauggagcuucgaaacuacggccgccgggacaucucaauuuugcacccacugcaaaagauggagcucuuuagcuauaguagauauugaagaauaugaacucaaagacuauaacgauaaucuauucaaaguaaaaaucaacgauggagaaguacgauuacucggcaaaaaagguuggcggaguggagaaaaaauaaaaggcaaagaauuauuugguccagugaaagacgcaaugcgaccaaacguggacggacuaggaaugaagauuguaaaaagaaaguaccuaaaacuugaucuuagagauuggguaagccgcuacggaaauauggcaauuuuuauuugcccguacguugauugccaccacauuagccacgcagauaaacaagccgcauucaacauagcaguacgcggauaccucaaaucaguaaacccagaccgagcgauaaaacacggagacaaaggauuaucaagggacuucuuaugucaagaggaaggcaaacuuaacuuugagcaaauaggucugcuauaa

SEQ ID NO: 11956 - RNA, 3462 nt, Artificial Sequence
  CasY variant__Candidatus Vogelbacteria bacterium__PIP58309.1__CasY
augcaaaaaguacgaaaaacacuaagcgaaguacauaaaaacccuuaugguacgaaaguacgaaacgcaaaaacaggauauucccuacaaauagagagacuuaguuacacagguaaagaaggaaugcggagcuuuaaaauaccacuagaaaauaaaaauaaagaaguauucgacgaauuugucaagaaaauaagaaacgauuauauaagccaaguaggauuacucaaucuaucagauugguaugaacauuaccaagaaaaacaagaacacuacagccuagcugacuucuggcuagacucucuaagagccgguguaauuuucgcgcacaaagaaacagaaaucaaaaaccuaauaaguaaaauaagaggagauaaaucuaucguagacaaauucaaugcaucuaucaagaagaaacacgcagaucuguacgcauuaguagauauaaaagcauuauacgacuuuuugacaucagacgcaagaaggggauuaaaaacagaagaagaauuuuucaauucuaaaagaaauacacuauuuccgaaguuuagaaagaaagacaauaaagcaguagaccuaugggucaagaaauucauaggacuagacaauaaagacaaacuaaacuucacuaagaaauucaucggauucgauccaaauccacaaauaaaauaugaucacaccuucuucuuucaucaagacauaaacuucgaucuagaaagaauaacaacaccaaaagaauuaauaaguacauacaagaaauuccuagguaaaaacaaagaccuauacgguagcgacgaaacaacugaagaccaauuaaaaaugguacuaggauuccauaacaaccauggugcauucaguaaauauuuuaaugcuucacucgaagcauuucgaggacgugacaacucucuaguugaacaaauaauaaauaauucacccuacuggaacagccacagaaaagaacucgagaaaaggauaaucuuuuuacaaguccaaaguaagaaaauaaaagaaacagaauuaggaaagccucaugaauaucucgccucguucggagggaaauuugaaucaugggugaguaauuaucuacgccaagaagaagaagucaaacgacaauuauuuggguaugaagaaaacaagaaaggacaaaagaaauucauaguaggaaacaaacaagaauuagauaaaauaauacgcggaacggaugaguacgaaauaaaagcaauuuccaaagaaacaauaggacucacacaaaaaugccuaaaacuacuugaacaacucaaagauuccgucgacgauuacacgcugucauuauauaggcaacugaucguagagcuaagaauaagacugaacguggaauuucaagagacauaucccgaauuaauaggaaaauccgaaaaagauaaagaaaaagaugccaaaaauaaacgagcagacaaacgauauccacagaucuuuaaagacaucaaacucauaccaaacuucuuaggugaaaccaaacaaaugguauauaagaaauucauuagaucagcggauauacuuuacgaaggaaucaauuuuauagaucaaauugauaaacaaauuacucagaacuuauuaccaugcuucaaaaacgacaaagaaagaauugaguucaccgaaaaacaauucgaaacauuaagaagaaaauauuaucugaugaacagcaguagauuucaccaugucauugaaggaauaauaaauaauagaaaacucauagaaaugaagaaaagagaaaacagcgaauuaaaaacuuuuagcgacaguaaauuuguauuaucaaaauuauuucucaagaaagggaagaaauaugaaaaugaaguuuauuauaccuuuuauauaaacccaaaagcacgagaccaaagacgaauaaaaauugucuuagacauuaauggaaacaacaguguuggcauauuacaagaucucguacaaaaauuaaaaccaaaaugggaugauauaaucaagaaaaacgauaugggagaacucauagaugcaauugaaaucgagaaaguacgacuuggaauauuaaucgccuuauacugcgaacacaaauuuaaaauaaagaaagaauuacuuuccuuagaucuauuugcaucugccuaccaauaucucgaauuagaagacgauccagaagaacuaagcggcacuaaccuuggaagguuuuuacaaaguuuaguauguucugaaauaaaaggagcaauaaauaaaaucucaagaacugaguauauagaaagauacacaguucaacccaugaauacugagaaaaauuaucccuuguuaauaaacaaagaggggaaagcaacauggcacauugcagcaaaagacgauuuaucuaaaaagaaaggaggaggaacaguagccaugaaccagaaaauaggcaaaaauuucuucggaaaacaagauuauaaaacaguuuucaugcuacaagauaaacgauuugaccuauuaaccaguaaauaccaccuacaauuucuaucaaaaacacuagacacgggaggaggaagcugguggaaaaacaaaaauauagacuugaacuuaaguucauacucauucauauucgaacaaaaaguaaaagucgaaugggacuuaaccaacuuagaucacccaauaaaaauaaaaccuucggagaacucagacgaucguagacuguuuguaaguauucccuucguuaucaaaccaaaacaaacuaaacgaaaagacuugcaaaccagagucaacuauaugggaauagauauaggagaauacggauuagcuuggacaauaauaaacauagauuugaaaaauaagaaaauaaauaaaauaucgaaacaaggauuuauauaugaaccacuaacucacaaagucagggacuacguagcaacaauaaaagacaaccaaguaagaggaacauuugguaugccagacacgaaacuggcucgucuaagggaaaaugcaauaacuagccuacggaaucaaguacacgacauagcaaugagauacgacgcgaaaccaguauaugaauuugaaauauccaacuuugaaacaggaagcaacaaaguaaaaguaaucuaugacuccguaaaacgagccgacauaggccggggacaaaacaacacagaagcugauaauaccgaaguaaaucuaguauggggcaaaacaucaaaacaauuuggaucacaaaucggugcuuacgccacaagcuacauauguucuuucugcggcuauucaccauauuaugaauuugaaaacucaaaaagcggagaugaagaaggugcaagggacaauuuauaccaaaugaagaaacuaaguagaccaucccuugaagacuuccuacaaggcaauccaguuuacaaaacguucagagacuuugauaaauauaaaaacgaccaaaggcuacagaaaacaggcgauaaagacggugaauggaaaacacaucgaggaaacacagcaauauaugcaugccaaaaaugcuaa

SEQ ID NO: 11957 - protein, 8 aa, Artificial Sequence
  NLS SV40
MPKKKRKV

SEQ ID NO: 11958 - protein, 16 aa, Artificial Sequence
  NLS N2D
MEEDTPPKKKRKVEDL

SEQ ID NO: 11959 - protein, 7 aa, Artificial Sequence
  NLS
PKKKRKV

SEQ ID NO: 11960 - protein, 8 aa, Artificial Sequence
  NLS
PKKKRKVG

SEQ ID NO: 11961 - protein, 19 aa, Artificial Sequence
  NLS
NLSKRPAAIKKAGQAKKKK

SEQ ID NO: 11962 - protein, 38 aa, Artificial Sequence
  NLS
NQSSNFGPMKGGNFGGRSSGPYGGGGQYFAKPRNQGGY

SEQ ID NO: 11963 - protein, 9 aa, Artificial Sequence
  NLS
PAAKRVKLD

SEQ ID NO: 11964 - protein, 16 aa, Artificial Sequence
  NLS
KRPAATKKAGQAKKKK

SEQ ID NO: 11965 - RNA, 24 nt, Artificial Sequence
  NLS SV40 variant
augcccaagaagaagcgcaaggug

SEQ ID NO: 11966 - RNA, 48 nt, Artificial Sequence
  NLS N2D variant
auggaggaggacaccccgcccaagaagaagcgcaagguggaggaccug

SEQ ID NO: 11967 - RNA, 21 nt, Artificial Sequence
  NLS variant
cccaagaagaagcgcaaggug

SEQ ID NO: 11968 - RNA, 24 nt, Artificial Sequence
  NLS variant
cccaagaagaagcgcaaggugggc

SEQ ID NO: 11969 - RNA, 57 nt, Artificial Sequence
  NLS variant
aaccugagcaagcgccccgccgccaucaagaaggcgggccaggccaagaagaagaag

SEQ ID NO: 11970 - RNA, 114 nt, Artificial Sequence
  NLS variant
aaccagagcuccaacuucggccccaugaagggcgggaacuucgggggccgcagcuccgggccguacggcggcgggggccaguacuucgccaagccccggaaccagggcggguac

SEQ ID NO: 11971 - RNA, 27 nt, Artificial Sequence
  NLS variant
cccgccgccaagcgcgugaagcuggac

SEQ ID NO: 11972 - RNA, 48 nt, Artificial Sequence; identical to SEQ ID NO: 1379
  NLS variant

SEQ ID NO: 11973 - RNA, 24 nt, Artificial Sequence
  NLS variant
augcccaagaaaaagagaaaagug

SEQ ID NO: 11974 - RNA, 48 nt, Artificial Sequence
  NLS variant
auggaggaagacaccccucccaagaaaaagagaaaaguggaggaucug

SEQ ID NO: 11975 - RNA, 21 nt, Artificial Sequence
  NLS variant
cccaagaaaaagagaaaagug

SEQ ID NO: 11976 - RNA, 24 nt, Artificial Sequence
  NLS variant
cccaagaaaaagagaaaagugggc

SEQ ID NO: 11977 - RNA, 57 nt, Artificial Sequence
  NLS variant
aaccugagcaagagacccgccgcuaucaaaaaggcaggccaggccaaaaagaaaaag

SEQ ID NO: 11978 - RNA, 114 nt, Artificial Sequence
  NLS variant
aaccagagcuccaauuucggccccaugaaagggggaaacuuugguggcagaucuucagggccuuacggaggcggugggcaauauuucgccaagccaaggaaucagggaggcuac

SEQ ID NO: 11979 - RNA, 27 nt, Artificial Sequence
  NLS variant
cccgccgcuaagagagugaaacuggac

SEQ ID NO: 11980 - RNA, 48 nt, Artificial Sequence; identical to SEQ ID NO: 2539
  NLS variant

SEQ ID NO: 11981 - RNA, 24 nt, Artificial Sequence
  NLS variant
augcccaagaaaaagagaaaagug

SEQ ID NO: 11982 - RNA, 48 nt, Artificial Sequence; identical to SEQ ID NO: 11974
  NLS variant

SEQ ID NO: 11983 - RNA, 21 nt, Artificial Sequence
  NLS variant
cccaagaaaaagagaaaagug

SEQ ID NO: 11984 - RNA, 24 nt, Artificial Sequence
  NLS variant
cccaagaaaaagagaaaagugggc

SEQ ID NO: 11985 - RNA, 57 nt, Artificial Sequence
  NLS variant
aaccugagcaagagacccgccgcuaucaaaaaggccggccaggcgaaaaagaaaaag

SEQ ID NO: 11986 - RNA, 114 nt, Artificial Sequence
  NLS variant
aaccagagcuccaauuucggccccaugaaagggggaaacuuuggcgggagaucuagcggaccuuacggcgggggaggccaauauuucgccaagccgcggaaucagggcggguac

SEQ ID NO: 11987 - RNA, 27 nt, Artificial Sequence
  NLS variant
cccgccgcuaagagagugaaacuggac

SEQ ID NO: 11988 - RNA, 48 nt, Artificial Sequence; identical to SEQ ID NO: 3699
  NLS variant

SEQ ID NO: 11989 - RNA, 24 nt, Artificial Sequence
  NLS variant
augccaaaaaaaaaaagaaaaguc

SEQ ID NO: 11990 - RNA, 48 nt, Artificial Sequence
  NLS variant
auggaagaagacacaccaccaaaaaaaaaaagaaaaguagaagaccua

SEQ ID NO: 11991 - RNA, 21 nt, Artificial Sequence
  NLS variant
ccgaaaaaaaaaagaaaagua

SEQ ID NO: 11992 - RNA, 24 nt, Artificial Sequence
  NLS variant
ccaaaaaaaaaaagaaaagucgga

SEQ ID NO: 11993 - RNA, 57 nt, Artificial Sequence
  NLS variant
aaccuaagcaaaagaccagcagcaauaaaaaaagcaggacaagcaaaaaaaaaaaaa

SEQ ID NO: 11994 - RNA, 114 nt, Artificial Sequence
  NLS variant
aaucaaaguaguaauuuuggaccaaugaaaggaggaaauuuuggaggaagaaguaguggaccauauggaggaggaggacaauauuuugcaaaaccaagaaaucaaggaggauau

SEQ ID NO: 11995 - RNA, 27 nt, Artificial Sequence
  NLS variant
ccagcagcaaaaagaguaaaauuagac

SEQ ID NO: 11996 - RNA, 48 nt, Artificial Sequence; identical to SEQ ID NO: 4859
  NLS variant

SEQ ID NO: 11997 - RNA, 24 nt, Artificial Sequence
  NLS variant
augcccaagaaaaagagaaaaguc

SEQ ID NO: 11998 - RNA, 48 nt, Artificial Sequence
  NLS variant
auggaagaggacacgccgccgaaaaagaaaaggaaaguggaagaccua

SEQ ID NO: 11999 - RNA, 21 nt, Artificial Sequence
  NLS variant
ccgaagaagaaaagaaaaguc

SEQ ID NO: 12000 - RNA, 24 nt, Artificial Sequence
  NLS variant
ccgaagaagaagagaaaaguggga

SEQ ID NO: 12001 - RNA, 57 nt, Artificial Sequence
  NLS variant
aacuuaagcaagcgcccggccgcgauaaagaaagcgggccaggccaagaaaaagaaa

SEQ ID NO: 12002 - RNA, 114 nt, Artificial Sequence
  NLS variant
aaucaaucgagcaauuucgggccaaugaaagggggaaauuucgggggaaggagcucgggaccguacgggggagggggacaguacuuugcaaagccaaggaaccagggcggguac

SEQ ID NO: 12003 - RNA, 27 nt, Artificial Sequence
  NLS variant
ccagccgccaaacgcgucaaacuagac

SEQ ID NO: 12004 - RNA, 48 nt, Artificial Sequence; identical to SEQ ID NO: 7179
  NLS variant

SEQ ID NO: 12005 - RNA, 24 nt, Artificial Sequence
  NLS variant
augcccaaaaagaaacgcaaaguc

SEQ ID NO: 12006 - RNA, 48 nt, Artificial Sequence
  NLS variant
auggaagaggacacgccgccgaaaaagaaaaggaaaguggaagaccug

SEQ ID NO: 12007 - RNA, 21 nt, Artificial Sequence
  NLS variant
ccgaagaagaagaggaaggua

SEQ ID NO: 12008 - RNA, 24 nt, Artificial Sequence
  NLS variant
ccgaagaagaagaggaagguggga

SEQ ID NO: 12009 - RNA, 57 nt, Artificial Sequence
  NLS variant
aaccucucgaaaaggcccgcggccauaaagaaagccgggcaagcgaaaaagaaaaag

SEQ ID NO: 12010 - RNA, 114 nt, Artificial Sequence
  NLS variant
aaccagagcucgaacuuuggcccgaugaagggcgggaacuuuggcgggcgaucgagcgggccauauggcgggggcgggcaauauuucgcgaaaccgagaaaucaagggggcuau

SEQ ID NO: 12011 - RNA, 27 nt, Artificial Sequence
  NLS variant
ccagccgccaaacgcgucaaacuagac

SEQ ID NO: 12012 - RNA, 48 nt, Artificial Sequence
  NLS variant
aaacgcccagccgcaaccaaaaaagccggccaagccaaaaaaaaaaaa

SEQ ID NO: 12013 - RNA, 24 nt, Artificial Sequence
  NLS variant
augccaaaaaaaaaaagaaaaguc

SEQ ID NO: 12014 - RNA, 48 nt, Artificial Sequence; identical to SEQ ID NO: 11990
  NLS variant

SEQ ID NO: 12015 - RNA, 21 nt, Artificial Sequence
  NLS variant
ccaaaaaaaaaaagaaaagua

SEQ ID NO: 12016 - RNA, 24 nt, Artificial Sequence
  NLS variant
ccgaaaaaaaaaagaaaaguagga

SEQ ID NO: 12017 - RNA, 57 nt, Artificial Sequence; identical to SEQ ID NO: 11993
  NLS variant

SEQ ID NO: 12018 - RNA, 114 nt, Artificial Sequence; identical to SEQ ID NO: 11994
  NLS variant

SEQ ID NO: 12019 - RNA, 27 nt, Artificial Sequence
  NLS variant
ccagcagcaaaaagaguaaaauuagac

SEQ ID NO: 12020 - RNA, 48 nt, Artificial Sequence; identical to SEQ ID NO: 4859
  NLS variant

SEQ ID NO: 12021 - protein, 6 aa, Artificial Sequence
  NLS variant
AAKKPR

SEQ ID NO: 12022 - protein, 6 aa, Artificial Sequence
  NLS variant
AAKKQK

SEQ ID NO: 12023 - protein, 6 aa, Artificial Sequence
  NLS variant
AAKKTK

SEQ ID NO: 12024 - protein, 6 aa, Artificial Sequence
  NLS variant
AAKRRL

SEQ ID NO: 12025 - protein, 6 aa, Artificial Sequence
  NLS variant
AEKKAK

SEQ ID NO: 12026 - protein, 6 aa, Artificial Sequence
  NLS variant
AEKKKK

SEQ ID NO: 12027 - protein, 6 aa, Artificial Sequence
  NLS variant
AERKTK

SEQ ID NO: 12028 - protein, 6 aa, Artificial Sequence
  NLS variant
AGKRRK

SEQ ID NO: 12029 - protein, 6 aa, Artificial Sequence
  NLS variant
AGSKRK

SEQ ID NO: 12030 - protein, 30 aa, Artificial Sequence
  NLS variant
AHFKISGEKRPSTDPGKKAKNPKKKKKKDP

SEQ ID NO: 12031 - protein, 12 aa, Artificial Sequence
  NLS variant
AHRAKKMSKTHA

SEQ ID NO: 12032 - protein, 6 aa, Artificial Sequence
  NLS variant
AHSRRK

SEQ ID NO: 12033 - protein, 6 aa, Artificial Sequence
  NLS variant
AKERKK

SEQ ID NO: 12034 - protein, 17 aa, Artificial Sequence
  NLS variant
AKFGAENVARRVAFRKS

SEQ ID NO: 12035 - protein, 6 aa, Artificial Sequence
  NLS variant
AKGKKR

SEQ ID NO: 12036 - protein, 6 aa, Artificial Sequence
  NLS variant
AKGRGR

SEQ ID NO: 12037 - protein, 6 aa, Artificial Sequence
  NLS variant
AKIPKK

SEQ ID NO: 12038 - protein, 6 aa, Artificial Sequence
  NLS variant
AKKAKA

SEQ ID NO: 12039 - protein, 7 aa, Artificial Sequence
  NLS variant
AKKAKKK

SEQ ID NO: 12040 - protein, 6 aa, Artificial Sequence
  NLS variant
AKKKKA

SEQ ID NO: 12041 - protein, 6 aa, Artificial Sequence
  NLS variant
AKKRGR

SEQ ID NO: 12042 - protein, 6 aa, Artificial Sequence
  NLS variant
AKKRKH

SEQ ID NO: 12043 - protein, 6 aa, Artificial Sequence
  NLS variant
AKKRKI

SEQ ID NO: 12044 - protein, 6 aa, Artificial Sequence
  NLS variant
AKKRKK

SEQ ID NO: 12045 - protein, 6 aa, Artificial Sequence
  NLS variant
AKKRKR

SEQ ID NO: 12046 - protein, 6 aa, Artificial Sequence
  NLS variant
AKKRKS

SEQ ID NO: 12047 - protein, 6 aa, Artificial Sequence
  NLS variant
AKKRKT

SEQ ID NO: 12048 - protein, 6 aa, Artificial Sequence
  NLS variant
AKKRPE

SEQ ID NO: 12049 - protein, 6 aa, Artificial Sequence
  NLS variant
AKKRRK

SEQ ID NO: 12050 - protein, 6 aa, Artificial Sequence
  NLS variant
AKKRRR

SEQ ID NO: 12051 - protein, 6 aa, Artificial Sequence
  NLS variant
AKKTRR

SEQ ID NO: 12052 - protein, 6 aa, Artificial Sequence
  NLS variant
AKKTTR

SEQ ID NO: 12053 - protein, 8 aa, Artificial Sequence
  NLS variant
AKREAALE

SEQ ID NO: 12054 - protein, 6 aa, Artificial Sequence
  NLS variant
AKRHEG

SEQ ID NO: 12055 - protein, 8 aa, Artificial Sequence
  NLS variant
AKRILANR

SEQ ID NO: 12056 - protein, 5 aa, Artificial Sequence
  NLS variant
AKRKC

SEQ ID NO: 12057 - protein, 6 aa, Artificial Sequence
  NLS variant
AKRKRK

SEQ ID NO: 12058 - protein, 8 aa, Artificial Sequence
  NLS variant
AKRMAQEA

SEQ ID NO: 12059 - protein, 8 aa, Artificial Sequence
  NLS variant
AKRNTRTY

SEQ ID NO: 12060 - protein, 6 aa, Artificial Sequence
  NLS variant
AKRPRR

SEQ ID NO: 12061 - protein, 6 aa, Artificial Sequence
  NLS variant
AKRRKG

SEQ ID NO: 12062 - protein, 5 aa, Artificial Sequence
  NLS variant
AKRRP

SEQ ID NO: 12063 - protein, 6 aa, Artificial Sequence
  NLS variant
AKRSRN

SEQ ID NO: 12064 - protein, 8 aa, Artificial Sequence
  NLS variant
AKRTNVPG

SEQ ID NO: 12065 - protein, 6 aa, Artificial Sequence
  NLS variant
AKRVSR

SEQ ID NO: 12066 - protein, 8 aa, Artificial Sequence
  NLS variant
AKRVVRED

SEQ ID NO: 12067 - protein, 6 aa, Artificial Sequence
  NLS variant
ALKKKK

SEQ ID NO: 12068 - protein, 6 aa, Artificial Sequence
  NLS variant
ALKRKS

SEQ ID NO: 12069 - protein, 6 aa, Artificial Sequence
  NLS variant
AMKRPR

SEQ ID NO: 12070 - protein, 6 aa, Artificial Sequence
  NLS variant
APAKKR

SEQ ID NO: 12071 - protein, 6 aa, Artificial Sequence
  NLS variant
APKKKR

SEQ ID NO: 12072 - protein, 6 aa, Artificial Sequence
  NLS variant
APKKKT

SEQ ID NO: 12073 - protein, 6 aa, Artificial Sequence
  NLS variant
APKKLK

SEQ ID NO: 12074 - protein, 6 aa, Artificial Sequence
  NLS variant
APKRKK

SEQ ID NO: 12075 - protein, 6 aa, Artificial Sequence
  NLS variant
ARKKKR

SEQ ID NO: 12076 - protein, 6 aa, Artificial Sequence
  NLS variant
ARKKRR

SEQ ID NO: 12077 - protein, 6 aa, Artificial Sequence
  NLS variant
ARKRKR

SEQ ID NO: 12078 - protein, 6 aa, Artificial Sequence
  NLS variant
ARKRRK

SEQ ID NO: 12079 - protein, 29 aa, Artificial Sequence
  NLS variant
ARRPSCSPEQHGGKVARLQPPPTKAQPAR

SEQ ID NO: 12080 - protein, 22 aa, Artificial Sequence
  NLS variant
ASIERKRQRALMLRQARLAARP

SEQ ID NO: 12081 - protein, 6 aa, Artificial Sequence
  NLS variant
ASKRKK

SEQ ID NO: 12082 - protein, 14 aa, Artificial Sequence
  NLS variant
ASPEYVNLPINGNG

SEQ ID NO: 12083 - protein, 6 aa, Artificial Sequence
  NLS variant
ASPKKR

SEQ ID NO: 12084 - protein, 6 aa, Artificial Sequence
  NLS variant
ASRKRK

SEQ ID NO: 12085 - protein, 6 aa, Artificial Sequence
  NLS variant
ASRKSR

SEQ ID NO: 12086 - protein, 6 aa, Artificial Sequence
  NLS variant
ASRSKR

SEQ ID NO: 12087 - protein, 8 aa, Artificial Sequence
  NLS variant
ATKARRTI

SEQ ID NO: 12088 - protein, 6 aa, Artificial Sequence
  NLS variant
ATPKKR

SEQ ID NO: 12089 - protein, 6 aa, Artificial Sequence
  NLS variant
CKKSRK

SEQ ID NO: 12090 - protein, 5 aa, Artificial Sequence
  NLS variant
CKRHG

SEQ ID NO: 12091 - protein, 8 aa, Artificial Sequence
  NLS variant
CKRHGVNR

SEQ ID NO: 12092 - protein, 5 aa, Artificial Sequence
  NLS variant
CKRRK

SEQ ID NO: 12093 - protein, 23 aa, Artificial Sequence
  NLS variant
CPFPGCGKIFARSENLKIHKRTH

SEQ ID NO: 12094 - protein, 5 aa, Artificial Sequence
  NLS variant
CRKCK

SEQ ID NO: 12095 - protein, 5 aa, Artificial Sequence
  NLS variant
CRKCR

SEQ ID NO: 12096 - protein, 5 aa, Artificial Sequence
  NLS variant
CRKRL

SEQ ID NO: 12097 - protein, 7 aa, Artificial Sequence
  NLS variant
CTKRPRW

SEQ ID NO: 12098 - protein, 26 aa, Artificial Sequence
  NLS variant
CYWEECPREGKSFKAKYKLVNHIRVH

SEQ ID NO: 12099 - protein, 6 aa, Artificial Sequence
  NLS variant
DAVKKK

SEQ ID NO: 12100 - protein, 6 aa, Artificial Sequence
  NLS variant
DAYKKK

SEQ ID NO: 12101 - protein, 6 aa, Artificial Sequence
  NLS variant
DERKKR

SEQ ID NO: 12102 - protein, 6 aa, Artificial Sequence
  NLS variant
DIKKKR

SEQ ID NO: 12103 - protein, 16 aa, Artificial Sequence
  NLS variant
DKAKRVSRNKSEKKRR

SEQ ID NO: 12104 - protein, 26 aa, Artificial Sequence
  NLS variant
DKALKKRSGKKDKHSQSPRAAGPREG

SEQ ID NO: 12105 - protein, 6 aa, Artificial Sequence
  NLS variant
DKEKLK

SEQ ID NO: 12106 - protein, 6 aa, Artificial Sequence
  NLS variant
DKEKRK

SEQ ID NO: 12107 - protein, 5 aa, Artificial Sequence
  NLS variant
DKGHR

SEQ ID NO: 12108 - protein, 8 aa, Artificial Sequence
  NLS variant
DKKEEVFL

SEQ ID NO: 12109 - protein, 6 aa, Artificial Sequence
  NLS variant
DKKHKK

SEQ ID NO: 12110 - protein, 8 aa, Artificial Sequence
  NLS variant
DKKKKKKR

SEQ ID NO: 12111 - protein, 8 aa, Artificial Sequence
  NLS variant
DKKLGRPH

SEQ ID NO: 12112 - protein, 8 aa, Artificial Sequence
  NLS variant
DKKRKTRK

SEQ ID NO: 12113 - protein, 6 aa, Artificial Sequence
  NLS variant
DKKRRK

SEQ ID NO: 12114 - protein, 10 aa, Artificial Sequence
  NLS variant
DKLLKDLPEL

SEQ ID NO: 12115 - protein, 5 aa, Artificial Sequence
  NLS variant
DKRQR

SEQ ID NO: 12116 - protein, 6 aa, Artificial Sequence
  NLS variant
DLSKRK

SEQ ID NO: 12117 - protein, 10 aa, Artificial Sequence
  NLS variant
DNFQDDPHAG

SEQ ID NO: 12118 - protein, 5 aa, Artificial Sequence
  NLS variant
DNKRR

SEQ ID NO: 12119 - protein, 6 aa, Artificial Sequence
  NLS variant
DPKKAK

SEQ ID NO: 12120 - protein, 6 aa, Artificial Sequence
  NLS variant
DPSKKK

SEQ ID NO: 12121 - protein, 10 aa, Artificial Sequence
  NLS variant
DQMLKRRNVS

SEQ ID NO: 12122 - protein, 7 aa, Artificial Sequence
  NLS variant
DREKDKK

SEQ ID NO: 12123 - protein, 8 aa, Artificial Sequence
  NLS variant
DRKNLDRA

SEQ ID NO: 12124 - protein, 6 aa, Artificial Sequence
  NLS variant
DRKRKR

SEQ ID NO: 12125 - protein, 6 aa, Artificial Sequence
  NLS variant
DRRAKL

SEQ ID NO: 12126 - protein, 6 aa, Artificial Sequence
  NLS variant
DRRRDR

SEQ ID NO: 12127 - protein, 8 aa, Artificial Sequence
  NLS variant
DRRRDRPR

SEQ ID NO: 12128 - protein, 7 aa, Artificial Sequence
  NLS variant
DRRRRRR

SEQ ID NO: 12129 - protein, 6 aa, Artificial Sequence
  NLS variant
DSEKRR

SEQ ID NO: 12130 - protein, 6 aa, Artificial Sequence
  NLS variant
DSKKVK

SEQ ID NO: 12131 - protein, 15 aa, Artificial Sequence
  NLS variant
DSPSPKRQRLSHSVF

SEQ ID NO: 12132 - protein, 6 aa, Artificial Sequence
  NLS variant
DTKRAK

SEQ ID NO: 12133 - protein, 6 aa, Artificial Sequence
  NLS variant
DVRKRV

SEQ ID NO: 12134 - protein, 13 aa, Artificial Sequence
  NLS variant
DVRKRVQDLEQKM

SEQ ID NO: 12135 - protein, 6 aa, Artificial Sequence
  NLS variant
EAKRAR

SEQ ID NO: 12136 - protein, 6 aa, Artificial Sequence
  NLS variant
EARRSR

SEQ ID NO: 12137 - protein, 7 aa, Artificial Sequence
  NLS variant
EEERLKK

SEQ ID NO: 12138 - protein, 6 aa, Artificial Sequence
  NLS variant
EEKQRR

SEQ ID NO: 12139 - protein, 15 aa, Artificial Sequence
  NLS variant
EELRLKEELLKGIYA

SEQ ID NO: 12140 - protein, 16 aa, Artificial Sequence
  NLS variant
EEQLRRRKNSRLNNTG

SEQ ID NO: 12141 - protein, 10 aa, Artificial Sequence
  NLS variant
EGAPPAKRAR

SEQ ID NO: 12142 - protein, 6 aa, Artificial Sequence
  NLS variant
EGRVRK

SEQ ID NO: 12143 - protein, 6 aa, Artificial Sequence
  NLS variant
EKDKKR

SEQ ID NO: 12144 - protein, 8 aa, Artificial Sequence
  NLS variant
EKKFAYQA

SEQ ID NO: 12145 - protein, 8 aa, Artificial Sequence
  NLS variant
EKKGLKLT

SEQ ID NO: 12146 - protein, 8 aa, Artificial Sequence
  NLS variant
EKKIEDWE

SEQ ID NO: 12147 - protein, 6 aa, Artificial Sequence
  NLS variant
EKKLKL

SEQ ID NO: 12148 - protein, 6 aa, Artificial Sequence
  NLS variant
EKKNKE

SEQ ID NO: 12149 - protein, 6 aa, Artificial Sequence
  NLS variant
EKKQRL

SEQ ID NO: 12150 - protein, 6 aa, Artificial Sequence
  NLS variant
EKKRAR

SEQ ID NO: 12151 - protein, 6 aa, Artificial Sequence
  NLS variant
EKKRKK

SEQ ID NO: 12152 - protein, 6 aa, Artificial Sequence
  NLS variant
EKKRKR

SEQ ID NO: 12153 - protein, 6 aa, Artificial Sequence
  NLS variant
EKKRQL

SEQ ID NO: 12154 - protein, 6 aa, Artificial Sequence
  NLS variant
EKKRQR

SEQ ID NO: 12155 - protein, 7 aa, Artificial Sequence
  NLS variant
EKKRREK

SEQ ID NO: 12156 - protein, 6 aa, Artificial Sequence
  NLS variant
EKKRRK

SEQ ID NO: 12157 - protein, 6 aa, Artificial Sequence
  NLS variant
EKQKRK

SEQ ID NO: 12158 - protein, 8 aa, Artificial Sequence
  NLS variant
EKREAEWK

SEQ ID NO: 12159 - protein, 6 aa, Artificial Sequence
  NLS variant
EKRKKE

SEQ ID NO: 12160 - protein, 6 aa, Artificial Sequence
  NLS variant
EKRKRR

SEQ ID NO: 12161 - protein, 6 aa, Artificial Sequence
  NLS variant
EKRKRS

SEQ ID NO: 12162 - protein, 6 aa, Artificial Sequence
  NLS variant
EKRREK

SEQ ID NO: 12163 - protein, 8 aa, Artificial Sequence
  NLS variant
EKRSPTEK

SEQ ID NO: 12164 - protein, 8 aa, Artificial Sequence
  NLS variant
EKRYGPCI

SEQ ID NO: 12165 - protein, 6 aa, Artificial Sequence
  NLS variant
EKSKKR

SEQ ID NO: 12166 - protein, 6 aa, Artificial Sequence
  NLS variant
EKSKRD

SEQ ID NO: 12167 - protein, 6 aa, Artificial Sequence
  NLS variant
EKSKRR

SEQ ID NO: 12168 - protein, 6 aa, Artificial Sequence
  NLS variant
EKSPKK

SEQ ID NO: 12169 - protein, 6 aa, Artificial Sequence
  NLS variant
EKVKKR

SEQ ID NO: 12170 - protein, 6 aa, Artificial Sequence
  NLS variant
ELRLKK

SEQ ID NO: 12171 - protein, 6 aa, Artificial Sequence
  NLS variant
ELRRRK

SEQ ID NO: 12172 - protein, 9 aa, Artificial Sequence
  NLS variant
ELVEQILAL

SEQ ID NO: 12173 - protein, 6 aa, Artificial Sequence
  NLS variant
EPRARR

SEQ ID NO: 12174 - protein, 10 aa, Artificial Sequence
  NLS variant
EQLFKRRNVA

SEQ ID NO: 12175 - protein, 6 aa, Artificial Sequence
  NLS variant
ERARAC

SEQ ID NO: 12176 - protein, 6 aa, Artificial Sequence
  NLS variant
ERDMKK

SEQ ID NO: 12177 - protein, 6 aa, Artificial Sequence
  NLS variant
ERHNNR

SEQ ID NO: 12178 - protein, 5 aa, Artificial Sequence
  NLS variant
ERHNR

SEQ ID NO: 12179 - protein, 6 aa, Artificial Sequence
  NLS variant
ERKKNW

SEQ ID NO: 12180 - protein, 6 aa, Artificial Sequence
  NLS variant
ERKRKR

SEQ ID NO: 12181 - protein, 6 aa, Artificial Sequence
  NLS variant
ERKTKR

SEQ ID NO: 12182 - protein, 7 aa, Artificial Sequence
  NLS variant
ERLLKKK

SEQ ID NO: 12183 - protein, 6 aa, Artificial Sequence
  NLS variant
ERQKKR

SEQ ID NO: 12184 - protein, 6 aa, Artificial Sequence
  NLS variant
ERRKKL

SEQ ID NO: 12185 - protein, 6 aa, Artificial Sequence
  NLS variant
ERRKQS

SEQ ID NO: 12186 - protein, 6 aa, Artificial Sequence
  NLS variant
ERRKRR

SEQ ID NO: 12187 - protein, 21 aa, Artificial Sequence
  NLS variant
ERRRAVSGTYRTHPFQRPSAR

SEQ ID NO: 12188 - protein, 10 aa, Artificial Sequence
  NLS variant
ERRRRKRRLR

SEQ ID NO: 12189 - protein, 7 aa, Artificial Sequence
  NLS variant
ERRRRRR

SEQ ID NO: 12190 - protein, 7 aa, Artificial Sequence
  NLS variant
ESARRSR

SEQ ID NO: 12191 - protein, 6 aa, Artificial Sequence
  NLS variant
ESHRRR

SEQ ID NO: 12192 - protein, 6 aa, Artificial Sequence
  NLS variant
ESLKRK

SEQ ID NO: 12193 - protein, 6 aa, Artificial Sequence
  NLS variant
ETVKRK

SEQ ID NO: 12194 - protein, 24 aa, Artificial Sequence
  NLS variant
EVLKVIRTGKRKKKAWKRMVTKVC

SEQ ID NO: 12195 - protein, 6 aa, Artificial Sequence
  NLS variant
FKKLFK

SEQ ID NO: 12196 - protein, 8 aa, Artificial Sequence
  NLS variant
FKKVISML

SEQ ID NO: 12197 - protein, 6 aa, Artificial Sequence
  NLS variant
FKRIKR

SEQ ID NO: 12198 - protein, 8 aa, Artificial Sequence
  NLS variant
FKRIKRKI

SEQ ID NO: 12199 - protein, 5 aa, Artificial Sequence
  NLS variant
FKRRN

SEQ ID NO: 12200 - protein, 5 aa, Artificial Sequence
  NLS variant
FKRRW

SEQ ID NO: 12201 - protein, 6 aa, Artificial Sequence
  NLS variant
FNKKRK

SEQ ID NO: 12202 - protein, 6 aa, Artificial Sequence
  NLS variant
FRKEKK

SEQ ID NO: 12203 - protein, 5 aa, Artificial Sequence
  NLS variant
FRKRM

SEQ ID NO: 12204 - protein, 8 aa, Artificial Sequence
  NLS variant
FRRLNRSL

SEQ ID NO: 12205 - protein, 6 aa, Artificial Sequence
  NLS variant
FSKKRR

SEQ ID NO: 12206 - protein, 6 aa, Artificial Sequence
  NLS variant
FVKKRR

SEQ ID NO: 12207 - protein, 5 aa, Artificial Sequence
  NLS variant
FVKRR

SEQ ID NO: 12208 - protein, 6 aa, Artificial Sequence
  NLS variant
FVSKKR

SEQ ID NO: 12209 - protein, 6 aa, Artificial Sequence
  NLS variant
GAGRRK

SEQ ID NO: 12210 - protein, 6 aa, Artificial Sequence
  NLS variant
GAKKQK

SEQ ID NO: 12211 - protein, 6 aa, Artificial Sequence
  NLS variant
GAKRKR

SEQ ID NO: 12212 - protein, 6 aa, Artificial Sequence
  NLS variant
GAKRSR

SEQ ID NO: 12213 - protein, 5 aa, Artificial Sequence
  NLS variant
GCKKR

SEQ ID NO: 12214 - protein, 5 aa, Artificial Sequence
  NLS variant
GCKRK

SEQ ID NO: 12215 - protein, 5 aa, Artificial Sequence
  NLS variant
GCRKK

SEQ ID NO: 12216 - protein, 6 aa, Artificial Sequence
  NLS variant
GDGRRR

SEQ ID NO: 12217 - protein, 6 aa, Artificial Sequence
  NLS variant
GDKRKL

SEQ ID NO: 12218 - protein, 6 aa, Artificial Sequence
  NLS variant
GEKRKR

SEQ ID NO: 12219 - protein, 8 aa, Artificial Sequence
  NLS variant
GETRYYND

SEQ ID NO: 12220 - protein, 18 aa, Artificial Sequence
  NLS variant
GGKPCSQHIISVTGFVDS

SEQ ID NO: 12221 - protein, 6 aa, Artificial Sequence
  NLS variant
GGKRKR

SEQ ID NO: 12222 - protein, 6 aa, Artificial Sequence
  NLS variant
GGKRRK

SEQ ID NO: 12223 - protein, 6 aa, Artificial Sequence
  NLS variant
GGRKRK

SEQ ID NO: 12224 - protein, 16 aa, Artificial Sequence
  NLS variant
GGSRRKRRKDRDSGRK

SEQ ID NO: 12225 - protein, 6 aa, Artificial Sequence
  NLS variant
GHKRKK

SEQ ID NO: 12226 - protein, 6 aa, Artificial Sequence
  NLS variant
GKAAKR

SEQ ID NO: 12227 - protein, 6 aa, Artificial Sequence
  NLS variant
GKARRR

SEQ ID NO: 12228 - protein, 6 aa, Artificial Sequence
  NLS variant
GKGKRK

SEQ ID NO: 12229 - protein, 6 aa, Artificial Sequence
  NLS variant
GKGNKR

SEQ ID NO: 12230 - protein, 8 aa, Artificial Sequence
  NLS variant
GKKGSTSS

SEQ ID NO: 12231 - protein, 31 aa, Artificial Sequence
  NLS variant
GKKIADRAKMRGKAKVEKRGQEGGGAKGGKK

SEQ ID NO: 12232 - protein, 6 aa, Artificial Sequence
  NLS variant
GKKIKD

SEQ ID NO: 12233 - protein, 6 aa, Artificial Sequence
  NLS variant
GKKKGR

SEQ ID NO: 12234 - protein, 6 aa, Artificial Sequence
  NLS variant
GKKKQR

SEQ ID NO: 12235 - protein, 7 aa, Artificial Sequence
  NLS variant
GKKKRKR

SEQ ID NO: 12236 - protein, 6 aa, Artificial Sequence
  NLS variant
GKKPKT

SEQ ID NO: 12237 - protein, 6 aa, Artificial Sequence
  NLS variant
GKKQRL

SEQ ID NO: 12238 - protein, 6 aa, Artificial Sequence
  NLS variant
GKKRKR

SEQ ID NO: 12239 - protein, 6 aa, Artificial Sequence
  NLS variant
GKKRSR

SEQ ID NO: 12240 - protein, 25 aa, Artificial Sequence
  NLS variant
GKKYENVVIKRSPRKRGRPRKDGTS

SEQ ID NO: 12241 - protein, 6 aa, Artificial Sequence
  NLS variant
GKNRKL

SEQ ID NO: 12242 - protein, 6 aa, Artificial Sequence
  NLS variant
GKNRRK

SEQ ID NO: 12243 - protein, 6 aa, Artificial Sequence
  NLS variant
GKRGRR

SEQ ID NO: 12244 - protein, 6 aa, Artificial Sequence
  NLS variant
GKRGRV

SEQ ID NO: 12245 - protein, 6 aa, Artificial Sequence
  NLS variant
GKRKAD

SEQ ID NO: 12246 - protein, 6 aa, Artificial Sequence
  NLS variant
GKRKAE

SEQ ID NO: 12247 - protein, 6 aa, Artificial Sequence
  NLS variant
GKRKGK

SEQ ID NO: 12248 - protein, 5 aa, Artificial Sequence
  NLS variant
GKRKH

SEQ ID NO: 12249 - protein, 6 aa, Artificial Sequence
  NLS variant
GKRKKK

SEQ ID NO: 12250 - protein, 6 aa, Artificial Sequence
  NLS variant
GKRKRG

SEQ ID NO: 12251 - protein, 6 aa, Artificial Sequence
  NLS variant
GKRKRK

SEQ ID NO: 12252 - protein, 6 aa, Artificial Sequence
  NLS variant
GKRKRV

SEQ ID NO: 12253 - protein, 6 aa, Artificial Sequence
  NLS variant
GKRKVL

SEQ ID NO: 12254 - protein, 6 aa, Artificial Sequence
  NLS variant
GKRRGR

SEQ ID NO: 12255 - protein, 6 aa, Artificial Sequence
  NLS variant
GKRRKT

SEQ ID NO: 12256 - protein, 6 aa, Artificial Sequence
  NLS variant
GKRRRR

SEQ ID NO: 12257 - protein, 8 aa, Artificial Sequence
  NLS variant
GKRSLEVT

SEQ ID NO: 12258 - protein, 6 aa, Artificial Sequence
  NLS variant
GKVNKK

SEQ ID NO: 12259 - protein, 6 aa, Artificial Sequence
  NLS variant
GLKRDR

SEQ ID NO: 12260 - protein, 6 aa, Artificial Sequence
  NLS variant
GLKRGR

SEQ ID NO: 12261 - protein, 6 aa, Artificial Sequence
  NLS variant
GLKRKQ

SEQ ID NO: 12262 - protein, 6 aa, Artificial Sequence
  NLS variant
GLKRKR

SEQ ID NO: 12263 - protein, 6 aa, Artificial Sequence
  NLS variant
GLKRKS

SEQ ID NO: 12264 - protein, 6 aa, Artificial Sequence
  NLS variant
GLSRKR

SEQ ID NO: 12265 - protein, 6 aa, Artificial Sequence
  NLS variant
GNKRKR

SEQ ID NO: 12266 - protein, 6 aa, Artificial Sequence
  NLS variant
GPGRKR

SEQ ID NO: 12267 - protein, 6 aa, Artificial Sequence
  NLS variant
GPLRRR

SEQ ID NO: 12268 - protein, 8 aa, Artificial Sequence
  NLS variant
GPRRSRPR

SEQ ID NO: 12269 - protein, 6 aa, Artificial Sequence
  NLS variant
GQAKKK

SEQ ID NO: 12270 - protein, 6 aa, Artificial Sequence
  NLS variant
GQRGRK

SEQ ID NO: 12271 - protein, 6 aa, Artificial Sequence
  NLS variant
GRERKK

SEQ ID NO: 12272 - protein, 6 aa, Artificial Sequence
  NLS variant
GRGKGR

SEQ ID NO: 12273 - protein, 6 aa, Artificial Sequence
  NLS variant
GRGRRR

SEQ ID NO: 12274 - protein, 6 aa, Artificial Sequence
  NLS variant
GRKKAE

SEQ ID NO: 12275 - protein, 6 aa, Artificial Sequence
  NLS variant
GRKKKK

SEQ ID NO: 12276 - protein, 6 aa, Artificial Sequence
  NLS variant
GRKKRR

SEQ ID NO: 12277 - protein, 6 aa, Artificial Sequence
  NLS variant
GRKRAV

SEQ ID NO: 12278 - protein, 5 aa, Artificial Sequence
  NLS variant
GRKRH

SEQ ID NO: 12279 - protein, 6 aa, Artificial Sequence
  NLS variant
GRKRKA

SEQ ID NO: 12280 - protein, 6 aa, Artificial Sequence
  NLS variant
GRKRKG

SEQ ID NO: 12281 - protein, 6 aa, Artificial Sequence
  NLS variant
GRKRKH

SEQ ID NO: 12282 - protein, 6 aa, Artificial Sequence
  NLS variant
GRKRKS

SEQ ID NO: 12283 - protein, 6 aa, Artificial Sequence
  NLS variant
GRKRKW

SEQ ID NO: 12284 - protein, 6 aa, Artificial Sequence
  NLS variant
GRKRRR

SEQ ID NO: 12285 - protein, 6 aa, Artificial Sequence
  NLS variant
GRKRSR

SEQ ID NO: 12286 - protein, 8 aa, Artificial Sequence
  NLS variant
GRKVAKDS

SEQ ID NO: 12287 - protein, 5 aa, Artificial Sequence
  NLS variant
GRNRK

SEQ ID NO: 12288 - protein, 6 aa, Artificial Sequence
  NLS variant
GRPRKQ

SEQ ID NO: 12289 - protein, 6 aa, Artificial Sequence
  NLS variant
GRPRKR

SEQ ID NO: 12290 - protein, 8 aa, Artificial Sequence
  NLS variant
GRRRRRRR

SEQ ID NO: 12291 - protein, 6 aa, Artificial Sequence
  NLS variant
GRVRKL

SEQ ID NO: 12292 - protein, 6 aa, Artificial Sequence
  NLS variant
GSKRKK

SEQ ID NO: 12293 - protein, 6 aa, Artificial Sequence
  NLS variant
GSKRRR

SEQ ID NO: 12294 - protein, 6 aa, Artificial Sequence
  NLS variant
GSRRKR

SEQ ID NO: 12295 - protein, 6 aa, Artificial Sequence
  NLS variant
GTKRKR

SEQ ID NO: 12296 - protein, 17 aa, Artificial Sequence
  NLS variant
GTPRKKIQYRVKSRTPS

SEQ ID NO: 12297 - protein, 6 aa, Artificial Sequence
  NLS variant
GVKRKA

SEQ ID NO: 12298 - protein, 6 aa, Artificial Sequence
  NLS variant
GVKRKR

SEQ ID NO: 12299 - protein, 6 aa, Artificial Sequence
  NLS variant
GVKRRD

SEQ ID NO: 12300 - protein, 6 aa, Artificial Sequence
  NLS variant
GVKRRR

SEQ ID NO: 12301 - protein, 5 aa, Artificial Sequence
  NLS variant
HAKKM

SEQ ID NO: 12302 - protein, 5 aa, Artificial Sequence
  NLS variant
HAKRL

SEQ ID NO: 12303 - protein, 5 aa, Artificial Sequence
  NLS variant
HCGKK

SEQ ID NO: 12304 - protein, 5 aa, Artificial Sequence
  NLS variant
HDRQK

SEQ ID NO: 12305 - protein, 6 aa, Artificial Sequence
  NLS variant
HDVKRK

SEQ ID NO: 12306 - protein, 6 aa, Artificial Sequence
  NLS variant
HGKRKR

SEQ ID NO: 12307 - protein, 5 aa, Artificial Sequence
  NLS variant
HGKRR

SEQ ID NO: 12308 - protein, 15 aa, Artificial Sequence
  NLS variant
HHHHHHHHHHHHQPH

SEQ ID NO: 12309 - protein, 12 aa, Artificial Sequence
  NLS variant
HHHHHHHHHHHP

SEQ ID NO: 12310 - protein, 10 aa, Artificial Sequence
  NLS variant
HHHHHHHHPH

SEQ ID NO: 12311 - protein, 8 aa, Artificial Sequence
  NLS variant
HHHHHHQH

SEQ ID NO: 12312 - protein, 6 aa, Artificial Sequence
  NLS variant
HHHHQP

SEQ ID NO: 12313 - protein, 6 aa, Artificial Sequence
  NLS variant
HHHQPH

SEQ ID NO: 12314 - protein, 5 aa, Artificial Sequence
  NLS variant
HIRQK

SEQ ID NO: 12315 - protein, 5 aa, Artificial Sequence
  NLS variant
HKDTK

SEQ ID NO: 12316 - protein, 5 aa, Artificial Sequence
  NLS variant
HKIQK

SEQ ID NO: 12317 - protein, 6 aa, Artificial Sequence
  NLS variant
HKKERK

SEQ ID NO: 12318 - protein, 17 aa, Artificial Sequence
  NLS variant
HKKKHPDASVNFSEFSK

SEQ ID NO: 12319 - protein, 5 aa, Artificial Sequence
  NLS variant
HKKRD

SEQ ID NO: 12320 - protein, 6 aa, Artificial Sequence
  NLS variant
HKKRKK

SEQ ID NO: 12321 - protein, 6 aa, Artificial Sequence
  NLS variant
HKKRKR

SEQ ID NO: 12322 - protein, 5 aa, Artificial Sequence
  NLS variant
HKRCK

SEQ ID NO: 12323 - protein, 5 aa, Artificial Sequence
  NLS variant
HKRDK

SEQ ID NO: 12324 - protein, 5 aa, Artificial Sequence
  NLS variant
HKRKE

SEQ ID NO: 12325 - protein, 5 aa, Artificial Sequence
  NLS variant
HKRKN

SEQ ID NO: 12326 - protein, 5 aa, Artificial Sequence
  NLS variant
HKRQG

SEQ ID NO: 12327 - protein, 5 aa, Artificial Sequence
  NLS variant
HKRQK

SEQ ID NO: 12328 - protein, 6 aa, Artificial Sequence
  NLS variant
HKRSAK

SEQ ID NO: 12329 - protein, 6 aa, Artificial Sequence
  NLS variant
HKRTKK

SEQ ID NO: 12330 - protein, 5 aa, Artificial Sequence
  NLS variant
HLKIH

SEQ ID NO: 12331 - protein, 6 aa, Artificial Sequence
  NLS variant
HLKRKR

SEQ ID NO: 12332 - protein, 5 aa, Artificial Sequence
  NLS variant
HLKTH

SEQ ID NO: 12333 - protein, 6 aa, Artificial Sequence
  NLS variant
HNKRKR

SEQ ID NO: 12334 - protein, 5 aa, Artificial Sequence
  NLS variant
HNRTK

SEQ ID NO: 12335 - protein, 17 aa, Artificial Sequence
  NLS variant
HRCVLAACSTYFKKLFK

SEQ ID NO: 12336 - protein, 5 aa, Artificial Sequence
  NLS variant
HRKKK

SEQ ID NO: 12337 - protein, 6 aa, Artificial Sequence
  NLS variant
HRKRKR

SEQ ID NO: 12338 - protein, 5 aa, Artificial Sequence
  NLS variant
HRKRP

SEQ ID NO: 12339 - protein, 5 aa, Artificial Sequence
  NLS variant
HRKRQ

SEQ ID NO: 12340 - protein, 5 aa, Artificial Sequence
  NLS variant
HRPRK

SEQ ID NO: 12341 - protein, 5 aa, Artificial Sequence
  NLS variant
HRPRR

SEQ ID NO: 12342 - protein, 8 aa, Artificial Sequence
  NLS variant
HSERYKDD

SEQ ID NO: 12343 - protein, 6 aa, Artificial Sequence
  NLS variant
HSPVKR

SEQ ID NO: 12344 - protein, 6 aa, Artificial Sequence
  NLS variant
HSRPRK

SEQ ID NO: 12345 - protein, 5 aa, Artificial Sequence
  NLS variant
HTRQK

SEQ ID NO: 12346 - protein, 6 aa, Artificial Sequence
  NLS variant
HVKAHS

SEQ ID NO: 12347 - protein, 5 aa, Artificial Sequence
  NLS variant
IAHRR

SEQ ID NO: 12348 - protein, 6 aa, Artificial Sequence
  NLS variant
IERKRQ

SEQ ID NO: 12349 - protein, 5 aa, Artificial Sequence
  NLS variant
IHKRT

SEQ ID NO: 12350 - protein, 29 aa, Artificial Sequence
  NLS variant
IINGRKLKLKKSRRRSSQTSNNSFTSRRS

SEQ ID NO: 12351 - protein, 6 aa, Artificial Sequence
  NLS variant
IKKKKD

SEQ ID NO: 12352 - protein, 6 aa, Artificial Sequence
  NLS variant
IKKKKH

SEQ ID NO: 12353 - protein, 7 aa, Artificial Sequence
  NLS variant
IKKKKKK

SEQ ID NO: 12354 - protein, 6 aa, Artificial Sequence
  NLS variant
IKKKKR

SEQ ID NO: 12355 - protein, 6 aa, Artificial Sequence
  NLS variant
IKKKKV

SEQ ID NO: 12356 - protein, 6 aa, Artificial Sequence
  NLS variant
IKKKQK

SEQ ID NO: 12357 - protein, 7 aa, Artificial Sequence
  NLS variant
IKKKQKH

SEQ ID NO: 12358 - protein, 6 aa, Artificial Sequence
  NLS variant
IKKKSK

SEQ ID NO: 12359 - protein, 6 aa, Artificial Sequence
  NLS variant
IKKRKK

SEQ ID NO: 12360 - protein, 6 aa, Artificial Sequence
  NLS variant
IKKRKV

SEQ ID NO: 12361 - protein, 6 aa, Artificial Sequence
  NLS variant
IKNLKR

SEQ ID NO: 12362 - protein, 6 aa, Artificial Sequence
  NLS variant
IKQKRK

SEQ ID NO: 12363 - protein, 12 aa, Artificial Sequence
  NLS variant
IKRNFSDIASPA

SEQ ID NO: 12364 - protein, 5 aa, Artificial Sequence
  NLS variant
IKRPR

SEQ ID NO: 12365 - protein, 5 aa, Artificial Sequence
  NLS variant
IKTRR

SEQ ID NO: 12366 - protein, 6 aa, Artificial Sequence
  NLS variant
ILKRKH

SEQ ID NO: 12367 - protein, 8 aa, Artificial Sequence
  NLS variant
IPDPTGQS

SEQ ID NO: 12368 - protein, 6 aa, Artificial Sequence
  NLS variant
IPKKRG

SEQ ID NO: 12369 - protein, 6 aa, Artificial Sequence
  NLS variant
IQKKRK

SEQ ID NO: 12370 - protein, 8 aa, Artificial Sequence
  NLS variant
IRKDVDDL

SEQ ID NO: 12371 - protein, 8 aa, Artificial Sequence
  NLS variant
IRKEESAL

SEQ ID NO: 12372 - protein, 8 aa, Artificial Sequence
  NLS variant
IRRIYSDE

SEQ ID NO: 12373 - protein, 8 aa, Artificial Sequence
  NLS variant
IRRPGRSR

SEQ ID NO: 12374 - protein, 6 aa, Artificial Sequence
  NLS variant
ISRKTR

SEQ ID NO: 12375 - protein, 6 aa, Artificial Sequence
  NLS variant
ITKTRR

SEQ ID NO: 12376 - protein, 8 aa, Artificial Sequence
  NLS variant
IVINILSE

SEQ ID NO: 12377 - protein, 5 aa, Artificial Sequence
  NLS variant
IWRKK

SEQ ID NO: 12378 - protein, 6 aa, Artificial Sequence
  NLS variant
KAASKK

SEQ ID NO: 12379 - protein, 6 aa, Artificial Sequence
  NLS variant
KACDRK

SEQ ID NO: 12380 - protein, 6 aa, Artificial Sequence
  NLS variant
KAEARK

SEQ ID NO: 12381 - protein, 8 aa, Artificial Sequence
  NLS variant
KAEQERRK

SEQ ID NO: 12382 - protein, 6 aa, Artificial Sequence
  NLS variant
KAERKT

SEQ ID NO: 12383 - protein, 6 aa, Artificial Sequence
  NLS variant
KAFRQR

SEQ ID NO: 12384 - protein, 6 aa, Artificial Sequence
  NLS variant
KAGSKR

SEQ ID NO: 12385 - protein, 6 aa, Artificial Sequence
  NLS variant
KAHSAK

SEQ ID NO: 12386 - protein, 5 aa, Artificial Sequence
  NLS variant
KAKFK

SEQ ID NO: 12387 - protein, 6 aa, Artificial Sequence
  NLS variant
KAKKDK

SEQ ID NO: 12388 - protein, 6 aa, Artificial Sequence
  NLS variant
KAKKEK

SEQ ID NO: 12389 - protein, 6 aa, Artificial Sequence
  NLS variant
KAKKPK

SEQ ID NO: 12390 - protein, 6 aa, Artificial Sequence
  NLS variant
KAKKQK

SEQ ID NO: 12391 - protein, 6 aa, Artificial Sequence
  NLS variant
KAKKRA

SEQ ID NO: 12392 - protein, 6 aa, Artificial Sequence
  NLS variant
KAKKTR

SEQ ID NO: 12393 - protein, 6 aa, Artificial Sequence
  NLS variant
KAKRAR

SEQ ID NO: 12394 - protein, 6 aa, Artificial Sequence
  NLS variant
KAKRIR

SEQ ID NO: 12395 - protein, 7 aa, Artificial Sequence
  NLS variant
KAKRKKR

SEQ ID NO: 12396 - protein, 6 aa, Artificial Sequence
  NLS variant
KAKRQR

SEQ ID NO: 12397 - protein, 7 aa, Artificial Sequence
  NLS variant
KAKRRLR

SEQ ID NO: 12398 - protein, 6 aa, Artificial Sequence
  NLS variant
KAKRSR

SEQ ID NO: 12399 - protein, 13 aa, Artificial Sequence
  NLS variant
KAKTFALKALKKK

SEQ ID NO: 12400 - protein, 11 aa, Artificial Sequence
  NLS variant
KALGVNMMMRK

SEQ ID NO: 12401 - protein, 6 aa, Artificial Sequence
  NLS variant
KAPRRR

SEQ ID NO: 12402 - protein, 16 aa, Artificial Sequence
  NLS variant
KAQHKVAKKRAIRRSR

SEQ ID NO: 12403 - protein, 6 aa, Artificial Sequence
  NLS variant
KARKLR

SEQ ID NO: 12404 - protein, 6 aa, Artificial Sequence
  NLS variant
KARKQK

SEQ ID NO: 12405 - protein, 5 aa, Artificial Sequence
  NLS variant
KARPH

SEQ ID NO: 12406 - protein, 6 aa, Artificial Sequence
  NLS variant
KAVKKK

SEQ ID NO: 12407 - protein, 6 aa, Artificial Sequence
  NLS variant
KDKESK

SEQ ID NO: 12408 - protein, 7 aa, Artificial Sequence
  NLS variant
KDKKKKD

SEQ ID NO: 12409 - protein, 6 aa, Artificial Sequence
  NLS variant
KDKLKK

SEQ ID NO: 12410 - protein, 16 aa, Artificial Sequence
  NLS variant
KDKRIKPIDPKKKISR

SEQ ID NO: 12411 - protein, 6 aa, Artificial Sequence
  NLS variant
KDKRKR

SEQ ID NO: 12412 - protein, 7 aa, Artificial Sequence
  NLS variant
KDRDSGR

SEQ ID NO: 12413 - protein, 7 aa, Artificial Sequence
  NLS variant
KEEKEKK

SEQ ID NO: 12414 - protein, 6 aa, Artificial Sequence
  NLS variant
KEKAKK

SEQ ID NO: 12415 - protein, 14 aa, Artificial Sequence
  NLS variant
KEKCKENGKMFKDK

SEQ ID NO: 12416 - protein, 7 aa, Artificial Sequence
  NLS variant
KEKKKKR

SEQ ID NO: 12417 - protein, 6 aa, Artificial Sequence
  NLS variant
KEKKRD

SEQ ID NO: 12418 - protein, 6 aa, Artificial Sequence
  NLS variant
KEKKRK

SEQ ID NO: 12419 - protein, 6 aa, Artificial Sequence
  NLS variant
KEKKRR

SEQ ID NO: 12420 - protein, 6 aa, Artificial Sequence
  NLS variant
KEKKSL

SEQ ID NO: 12421 - protein, 16 aa, Artificial Sequence
  NLS variant
KEKKSLFGLDVGRKRR

SEQ ID NO: 12422 - protein, 6 aa, Artificial Sequence
  NLS variant
KEKRKG

SEQ ID NO: 12423 - protein, 7 aa, Artificial Sequence
  NLS variant
KEKRKKG

SEQ ID NO: 12424 - protein, 7 aa, Artificial Sequence
  NLS variant
KEKRKKR

SEQ ID NO: 12425 - protein, 6 aa, Artificial Sequence
  NLS variant
KEKRKL

SEQ ID NO: 12426 - protein, 18 aa, Artificial Sequence
  NLS variant
KEKRKRREELFIEQKKRK

SEQ ID NO: 12427 - protein, 6 aa, Artificial Sequence
  NLS variant
KEKRRE

SEQ ID NO: 12428 - protein, 6 aa, Artificial Sequence
  NLS variant
KEKRRR

SEQ ID NO: 12429 - protein, 6 aa, Artificial Sequence
  NLS variant
KELRRK

SEQ ID NO: 12430 - protein, 11 aa, Artificial Sequence
  NLS variant
KELRRKKLVKR

SEQ ID NO: 12431 - protein, 6 aa, Artificial Sequence
  NLS variant
KEPKSR

SEQ ID NO: 12432 - protein, 6 aa, Artificial Sequence
  NLS variant
KEQERR

SEQ ID NO: 12433 - protein, 6 aa, Artificial Sequence
  NLS variant
KERKRK

SEQ ID NO: 12434 - protein, 6 aa, Artificial Sequence
  NLS variant
KERKRR

SEQ ID NO: 12435 - protein, 19 aa, Artificial Sequence
  NLS variant
KFKIKPGPECGTADGRSKK

SEQ ID NO: 12436 - protein, 5 aa, Artificial Sequence
  NLS variant
KFKKP

SEQ ID NO: 12437 - protein, 6 aa, Artificial Sequence
  NLS variant
KGGAKR

SEQ ID NO: 12438 - protein, 6 aa, Artificial Sequence
  NLS variant
KGGGKK

SEQ ID NO: 12439 - protein, 18 aa, Artificial Sequence
  NLS variant
KGGGYKTMKKRKVKDEKG

SEQ ID NO: 12440 - protein, 7 aa, Artificial Sequence
  NLS variant
KGGKGGK

SEQ ID NO: 12441 - protein, 5 aa, Artificial Sequence
  NLS variant
KGHKR

SEQ ID NO: 12442 - protein, 17 aa, Artificial Sequence
  NLS variant
KGKEKGGALGLEKARKK

SEQ ID NO: 12443 - protein, 22 aa, Artificial Sequence
  NLS variant
KGKKKGRTQKEKKAARARSKGK

SEQ ID NO: 12444 - protein, 6 aa, Artificial Sequence
  NLS variant
KGKLKN

SEQ ID NO: 12445 - protein, 5 aa, Artificial Sequence
  NLS variant
KGKRH

SEQ ID NO: 12446 - protein, 9 aa, Artificial Sequence
  NLS variant
KGKRSKRSR

SEQ ID NO: 12447 - protein, 14 aa, Artificial Sequence
  NLS variant
KGKSDEGKVRKVLK

SEQ ID NO: 12448 - protein, 6 aa, Artificial Sequence
  NLS variant
KGKTKR

SEQ ID NO: 12449 - protein, 6 aa, Artificial Sequence
  NLS variant
KGNRKK

SEQ ID NO: 12450 - protein, 6 aa, Artificial Sequence
  NLS variant
KGPNKK

SEQ ID NO: 12451 - protein, 79 aa, Artificial Sequence
  NLS variant
KGPRAKVAKLNIQSLSPVKKKKMVPGALGVPADLAPVDVEFSFPKFSRLRRGLKAEAVKGPVPAAPARRRLQLPRLRVR

SEQ ID NO: 12452 - protein, 6 aa, Artificial Sequence
  NLS variant
KGRAKK

SEQ ID NO: 12453 - protein, 6 aa, Artificial Sequence
  NLS variant
KGRGRP

SEQ ID NO: 12454 - protein, 6 aa, Artificial Sequence
  NLS variant
KGRKRK

SEQ ID NO: 12455 - protein, 6 aa, Artificial Sequence
  NLS variant
KGRPRK

SEQ ID NO: 12456 - protein, 6 aa, Artificial Sequence
  NLS variant
KGRRIR

SEQ ID NO: 12457 - protein, 14 aa, Artificial Sequence
  NLS variant
KGRSDEGRVRKVLK

SEQ ID NO: 12458 - protein, 6 aa, Artificial Sequence
  NLS variant
KGSKRK

SEQ ID NO: 12459 - protein, 12 aa, Artificial Sequence
  NLS variant
KGVKRKADTTTP

SEQ ID NO: 12460 - protein, 12 aa, Artificial Sequence
  NLS variant
KGVKRRADTTTP

SEQ ID NO: 12461 - protein, 6 aa, Artificial Sequence
  NLS variant
KHKDKE

SEQ ID NO: 12462 - protein, 5 aa, Artificial Sequence
  NLS variant
KHKIH

SEQ ID NO: 12463 - protein, 6 aa, Artificial Sequence
  NLS variant
KHKKEE

SEQ ID NO: 12464 - protein, 6 aa, Artificial Sequence
  NLS variant
KHKKRK

SEQ ID NO: 12465 - protein, 5 aa, Artificial Sequence
  NLS variant
KHKKV

SEQ ID NO: 12466 - protein, 19 aa, Artificial Sequence
  NLS variant
KHKKVSTNLCTHSFRKKQV

SEQ ID NO: 12467 - protein, 5 aa, Artificial Sequence
  NLS variant
KHKQK

SEQ ID NO: 12468 - protein, 6 aa, Artificial Sequence
  NLS variant
KHKRKK

SEQ ID NO: 12469 - protein, 5 aa, Artificial Sequence
  NLS variant
KHKRP

SEQ ID NO: 12470 - protein, 5 aa, Artificial Sequence
  NLS variant
KHLEH

SEQ ID NO: 12471 - protein, 5 aa, Artificial Sequence
  NLS variant
KHLHH

SEQ ID NO: 12472 - protein, 6 aa, Artificial Sequence
  NLS variant
KHLKPH

SEQ ID NO: 12473 - protein, 9 aa, Artificial Sequence
  NLS variant
KIKELYRRR

SEQ ID NO: 12474 - protein, 6 aa, Artificial Sequence
  NLS variant
KIKKKK

SEQ ID NO: 12475 - protein, 6 aa, Artificial Sequence
  NLS variant
KIKKRK

SEQ ID NO: 12476 - protein, 6 aa, Artificial Sequence
  NLS variant
KIKLKR

SEQ ID NO: 12477 - protein, 6 aa, Artificial Sequence
  NLS variant
KIKRKR

SEQ ID NO: 12478 - protein, 6 aa, Artificial Sequence
  NLS variant
KIRRKK

SEQ ID NO: 12479 - protein, 6 aa, Artificial Sequence
  NLS variant
KKAARA

SEQ ID NO: 12480 - protein, 17 aa, Artificial Sequence
  NLS variant
KKAESSSAYHMIRALRK

SEQ ID NO: 12481 - protein, 16 aa, Artificial Sequence
  NLS variant
KKAFQNVLRIQCLRRR

SEQ ID NO: 12482 - protein, 6 aa, Artificial Sequence
  NLS variant
KKAKNP

SEQ ID NO: 12483 - protein, 107 aa, Artificial Sequence
  NLS variant
KKAKRKAREKQLEEARRLAALQKRRELRAAGIEIQKKRKKKRGVDYNAEIPFEKKPALGFYDTSEENYQALDADFRKLRQQDLDGELRSEKEGRDRKKDKQHLKRKK

SEQ ID NO: 12484 - protein, 107 aa, Artificial Sequence
  NLS variant
KKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKK

SEQ ID NO: 12485 - protein, 6 aa, Artificial Sequence
  NLS variant
KKAQKK

SEQ ID NO: 12486 - protein, 14 aa, Artificial Sequence
  NLS variant
KKCRFPDDLDTNKK

SEQ ID NO: 12487 - protein, 18 aa, Artificial Sequence
  NLS variant
KKCSETWKTIFAKEKGKF

SEQ ID NO: 12488 - protein, 5 aa, Artificial Sequence
  NLS variant
KKCYK

SEQ ID NO: 12489 - protein, 18 aa, Artificial Sequence
  NLS variant
KKDLPSHIQEMLRRKEIL

SEQ ID NO: 12490 - protein, 16 aa, Artificial Sequence
  NLS variant
KKDPANTVEVKKGSRK

SEQ ID NO: 12491 - protein, 7 aa, Artificial Sequence
  NLS variant
KKEESGR

SEQ ID NO: 12492 - protein, 6 aa, Artificial Sequence
  NLS variant
KKEHKK

SEQ ID NO: 12493 - protein, 6 aa, Artificial Sequence
  NLS variant
KKEHRK

SEQ ID NO: 12494 - protein, 24 aa, Artificial Sequence
  NLS variant
KKEIARQMKAYEKQRGTRREEQKE

SEQ ID NO: 12495 - protein, 7 aa, Artificial Sequence
  NLS variant
KKEKDLD

SEQ ID NO: 12496 - protein, 6 aa, Artificial Sequence
  NLS variant
KKEKDS

SEQ ID NO: 12497 - protein, 6 aa, Artificial Sequence
  NLS variant
KKEKLE

SEQ ID NO: 12498 - protein, 18 aa, Artificial Sequence
  NLS variant
KKELPSHVQAMHKRKEFL

SEQ ID NO: 12499 - protein, 17 aa, Artificial Sequence
  NLS variant
KKENHEAMDIIVKIIKR

SEQ ID NO: 12500 - protein, 17 aa, Artificial Sequence
  NLS variant
KKENHNAMDIIVKIIKR

SEQ ID NO: 12501 - protein, 6 aa, Artificial Sequence
  NLS variant
KKERKR

SEQ ID NO: 12502 - protein, 17 aa, Artificial Sequence
  NLS variant
KKERKRLKEEKQKRKKE

SEQ ID NO: 12503 - protein, 6 aa, Artificial Sequence
  NLS variant
KKERNS

SEQ ID NO: 12504 - protein, 17 aa, Artificial Sequence
  NLS variant
KKERNSSGMARKAKRTK

SEQ ID NO: 12505 - protein, 17 aa, Artificial Sequence
  NLS variant
KKERNSSGTTRKSKQTK

SEQ ID NO: 12506 - protein, 6 aa, Artificial Sequence
  NLS variant
KKESGR

SEQ ID NO: 12507 - protein, 6 aa, Artificial Sequence
  NLS variant
KKEVER

SEQ ID NO: 12508 - protein, 17 aa, Artificial Sequence
  NLS variant
KKFGAQNVARRIEFRKK

SEQ ID NO: 12509 - protein, 6 aa, Artificial Sequence
  NLS variant
KKFGPK

SEQ ID NO: 12510 - protein, 6 aa, Artificial Sequence
  NLS variant
KKFGVK

SEQ ID NO: 12511 - protein, 17 aa, Artificial Sequence
  NLS variant
KKFKEEEASAKIPKKKR

SEQ ID NO: 12512 - protein, 5 aa, Artificial Sequence
  NLS variant
KKFTK

SEQ ID NO: 12513 - protein, 7 aa, Artificial Sequence
  NLS variant
KKGDKYD

SEQ ID NO: 12514 - protein, 6 aa, Artificial Sequence
  NLS variant
KKGGGK

SEQ ID NO: 12515 - protein, 6 aa, Artificial Sequence
  NLS variant
KKGKDE

SEQ ID NO: 12516 - protein, 13 aa, Artificial Sequence
  NLS variant
KKGKDEWFSRGKK

SEQ ID NO: 12517 - protein, 14 aa, Artificial Sequence
  NLS variant
KKGKDEWFSRGKKP

SEQ ID NO: 12518 - protein, 6 aa, Artificial Sequence
  NLS variant
KKGKGR

SEQ ID NO: 12519 - protein, 6 aa, Artificial Sequence
  NLS variant
KKGKRG

SEQ ID NO: 12520 - protein, 12 aa, Artificial Sequence
  NLS variant
KKGPSVQKRKKT

SEQ ID NO: 12521 - protein, 6 aa, Artificial Sequence
  NLS variant
KKGRGN

SEQ ID NO: 12522 - protein, 17 aa, Artificial Sequence
  NLS variant
KKGRGNRYHNKNRGKSK

SEQ ID NO: 12523 - protein, 6 aa, Artificial Sequence
  NLS variant
KKGRGR

SEQ ID NO: 12524 - protein, 9 aa, Artificial Sequence
  NLS variant
KKGRRNRFK

SEQ ID NO: 12525 - protein, 6 aa, Artificial Sequence
  NLS variant
KKGSKR

SEQ ID NO: 12526 - protein, 6 aa, Artificial Sequence
  NLS variant
KKGSRK

SEQ ID NO: 12527 - protein, 6 aa, Artificial Sequence
  NLS variant
KKHHKK

SEQ ID NO: 12528 - protein, 5 aa, Artificial Sequence
  NLS variant
KKHIH

SEQ ID NO: 12529 - protein, 5 aa, Artificial Sequence
  NLS variant
KKHKI

SEQ ID NO: 12530 - protein, 6 aa, Artificial Sequence
  NLS variant
KKHKKE

SEQ ID NO: 12531 - protein, 6 aa, Artificial Sequence
  NLS variant
KKHLKH

SEQ ID NO: 12532 - protein, 7 aa, Artificial Sequence
  NLS variant
KKHLKIH

SEQ ID NO: 12533 - protein, 6 aa, Artificial Sequence
  NLS variant
KKHPDA

SEQ ID NO: 12534 - protein, 6 aa, Artificial Sequence
  NLS variant
KKHPDV

SEQ ID NO: 12535 - protein, 7 aa, Artificial Sequence
  NLS variant
KKHYMLK

SEQ ID NO: 12536 - protein, 6 aa, Artificial Sequence
  NLS variant
KKIKGG

SEQ ID NO: 12537 - protein, 6 aa, Artificial Sequence
  NLS variant
KKIKKK

SEQ ID NO: 12538 - protein, 12 aa, Artificial Sequence
  NLS variant
KKIKKKKKKKHR

SEQ ID NO: 12539 - protein, 6 aa, Artificial Sequence
  NLS variant
KKIKLE

SEQ ID NO: 12540 - protein, 17 aa, Artificial Sequence
  NLS variant
KKIKLQTPNTFPKRKKG

SEQ ID NO: 12541 - protein, 6 aa, Artificial Sequence
  NLS variant
KKKDKE

SEQ ID NO: 12542 - protein, 6 aa, Artificial Sequence
  NLS variant
KKKDTK

SEQ ID NO: 12543 - protein, 7 aa, Artificial Sequence
  NLS variant
KKKEHKK

SEQ ID NO: 12544 - protein, 17 aa, Artificial Sequence
  NLS variant
KKKEKDICSSSKRRFQK

SEQ ID NO: 12545 - protein, 6 aa, Artificial Sequence
  NLS variant
KKKEKI

SEQ ID NO: 12546 - protein, 6 aa, Artificial Sequence
  NLS variant
KKKEQS

SEQ ID NO: 12547 - protein, 6 aa, Artificial Sequence
  NLS variant
KKKERK

SEQ ID NO: 12548 - protein, 6 aa, Artificial Sequence
  NLS variant
KKKETK

SEQ ID NO: 12549 - protein, 10 aa, Artificial Sequence
  NLS variant
KKKGGGKKKK

SEQ ID NO: 12550 - protein, 6 aa, Artificial Sequence
  NLS variant
KKKHKE

SEQ ID NO: 12551 - protein, 8 aa, Artificial Sequence
  NLS variant
KKKILLHS

SEQ ID NO: 12552 - protein, 6 aa, Artificial Sequence
  NLS variant
KKKIRR

SEQ ID NO: 12553 - protein, 6 aa, Artificial Sequence
  NLS variant
KKKKAR

SEQ ID NO: 12554 - protein, 6 aa, Artificial Sequence
  NLS variant
KKKKAS

SEQ ID NO: 12555 - protein, 6 aa, Artificial Sequence
  NLS variant
KKKKDT

SEQ ID NO: 12556 - protein, 7 aa, Artificial Sequence
  NLS variant
KKKKEKR

SEQ ID NO: 12557 - protein, 11 aa, Artificial Sequence
  NLS variant
KKKKGGGKKKK

SEQ ID NO: 12558 - protein, 6 aa, Artificial Sequence
  NLS variant
KKKKIR

SEQ ID NO: 12559 - protein, 7 aa, Artificial Sequence
  NLS variant
KKKKKDK

SEQ ID NO: 12560 - protein, 6 aa, Artificial Sequence
  NLS variant
KKKKKF

SEQ ID NO: 12561 - protein, 7 aa, Artificial Sequence
  NLS variant
KKKKKHK

SEQ ID NO: 12562 - protein, 7 aa, Artificial Sequence
  NLS variant
KKKKKHR

SEQ ID NO: 12563 - protein, 7 aa, Artificial Sequence
  NLS variant
KKKKKKH

SEQ ID NO: 12564 - protein, 8 aa, Artificial Sequence
  NLS variant
KKKKKKKD

SEQ ID NO: 12565 - protein, 15 aa, Artificial Sequence
  NLS variant
KKKKKKKSDKKKKKL

SEQ ID NO: 12566 - protein, 8 aa, Artificial Sequence
  NLS variant
KKKKKKRK

SEQ ID NO: 12567 - protein, 7 aa, Artificial Sequence
  NLS variant
KKKKKKT

SEQ ID NO: 12568 - protein, 7 aa, Artificial Sequence
  NLS variant
KKKKKRS

SEQ ID NO: 12569 - protein, 13 aa, Artificial Sequence
  NLS variant
KKKKKSDKKKKKL

SEQ ID NO: 12570 - protein, 7 aa, Artificial Sequence
  NLS variant
KKKKKTK

SEQ ID NO: 12571 - protein, 7 aa, Artificial Sequence
  NLS variant
KKKKMTK

SEQ ID NO: 12572 - protein, 6 aa, Artificial Sequence
  NLS variant
KKKKNG

SEQ ID NO: 12573 - protein, 6 aa, Artificial Sequence
  NLS variant
KKKKQI

SEQ ID NO: 12574 - protein, 6 aa, Artificial Sequence
  NLS variant
KKKKRA

SEQ ID NO: 12575 - protein, 6 aa, Artificial Sequence
  NLS variant
KKKKRD

SEQ ID NO: 12576 - protein, 7 aa, Artificial Sequence
  NLS variant
KKKKRKE

SEQ ID NO: 12577 - protein, 7 aa, Artificial Sequence
  NLS variant
KKKKRKQ

SEQ ID NO: 12578 - protein, 7 aa, Artificial Sequence
  NLS variant
KKKKRKR

SEQ ID NO: 12579 - protein, 8 aa, Artificial Sequence
  NLS variant
KKKKSGQI

SEQ ID NO: 12580 - protein, 11 aa, Artificial Sequence
  NLS variant
KKKKSKDKKRK

SEQ ID NO: 12581 - protein, 6 aa, Artificial Sequence
  NLS variant
KKKKSQ

SEQ ID NO: 12582 - protein, 6 aa, Artificial Sequence
  NLS variant
KKKKTR

SEQ ID NO: 12583 - protein, 6 aa, Artificial Sequence
  NLS variant
KKKMDK

SEQ ID NO: 12584 - protein, 17 aa, Artificial Sequence
  NLS variant
KKKMHPVEWDIWRKTKT

SEQ ID NO: 12585 - protein, 6 aa, Artificial Sequence
  NLS variant
KKKMRK

SEQ ID NO: 12586 - protein, 18 aa, Artificial Sequence
  NLS variant
KKKNAKVVADIKKKRQRL

SEQ ID NO: 12587 - protein, 8 aa, Artificial Sequence
  NLS variant
KKKNINNN

SEQ ID NO: 12588 - protein, 6 aa, Artificial Sequence
  NLS variant
KKKNKG

SEQ ID NO: 12589 - protein, 17 aa, Artificial Sequence
  NLS variant
KKKNLPKFPKNKKKNGK

SEQ ID NO: 12590 - protein, 18 aa, Artificial Sequence
  NLS variant
KKKNLQSQPNSTTSKKKH

SEQ ID NO: 12591 - protein, 8 aa, Artificial Sequence
  NLS variant
KKKPAVCK

SEQ ID NO: 12592 - protein, 6 aa, Artificial Sequence
  NLS variant
KKKPSP

SEQ ID NO: 12593 - protein, 17 aa, Artificial Sequence
  NLS variant
KKKPSPVSRKSPKQKKK

SEQ ID NO: 12594 - protein, 6 aa, Artificial Sequence
  NLS variant
KKKQRS

SEQ ID NO: 12595 - protein, 6 aa, Artificial Sequence
  NLS variant
KKKRAR

SEQ ID NO: 12596 - protein, 6 aa, Artificial Sequence
  NLS variant
KKKRDR

SEQ ID NO: 12597 - protein, 6 aa, Artificial Sequence
  NLS variant
KKKRGR

SEQ ID NO: 12598 - protein, 9 aa, Artificial Sequence
  NLS variant
KKKRGRPRK

SEQ ID NO: 12599 - protein, 18 aa, Artificial Sequence
  NLS variant
KKKRGWYKWLRKLRAREK

SEQ ID NO: 12600 - protein, 6 aa, Artificial Sequence
  NLS variant
KKKRKA

SEQ ID NO: 12601 - protein, 6 aa, Artificial Sequence
  NLS variant
KKKRKG

SEQ ID NO: 12602 - protein, 7 aa, Artificial Sequence
  NLS variant
KKKRKKG

SEQ ID NO: 12603 - protein, 6 aa, Artificial Sequence
  NLS variant
KKKRKP

SEQ ID NO: 12604 - protein, 7 aa, Artificial Sequence
  NLS variant
KKKRKRR

SEQ ID NO: 12605 - protein, 6 aa, Artificial Sequence
  NLS variant
KKKRQR

SEQ ID NO: 12606 - protein, 6 aa, Artificial Sequence
  NLS variant
KKKRRS

SEQ ID NO: 12607 - protein, 6 aa, Artificial Sequence
  NLS variant
KKKRRV

SEQ ID NO: 12608 - protein, 5 aa, Artificial Sequence
  NLS variant
KKKRW

SEQ ID NO: 12609 - protein, 6 aa, Artificial Sequence
  NLS variant
KKKSAK

SEQ ID NO: 12610 - protein, 6 aa, Artificial Sequence
  NLS variant
KKKSKH

SEQ ID NO: 12611 - protein, 7 aa, Artificial Sequence
  NLS variant
KKKSKKH

SEQ ID NO: 12612 - protein, 17 aa, Artificial Sequence
  NLS variant
KKKTEGLVKLTPIDKRK

SEQ ID NO: 12613 - protein, 6 aa, Artificial Sequence
  NLS variant
KKKTGA

SEQ ID NO: 12614 - protein, 9 aa, Artificial Sequence
  NLS variant
KKKTGARKK

SEQ ID NO: 12615 - protein, 18 aa, Artificial Sequence
  NLS variant
KKKTGVIAPKRFVQRLKK

SEQ ID NO: 12616 - protein, 6 aa, Artificial Sequence
  NLS variant
KKKTVI

SEQ ID NO: 12617 - protein, 16 aa, Artificial Sequence
  NLS variant
KKKTVINDLLHYKKEK

SEQ ID NO: 12618 - protein, 6 aa, Artificial Sequence
  NLS variant
KKKVDE

SEQ ID NO: 12619 - protein, 6 aa, Artificial Sequence
  NLS variant
KKKVER

SEQ ID NO: 12620 - protein, 7 aa, Artificial Sequence
  NLS variant
KKKVERS

SEQ ID NO: 12621 - protein, 8 aa, Artificial Sequence
  NLS variant
KKLKKRNK

SEQ ID NO: 12622 - protein, 6 aa, Artificial Sequence
  NLS variant
KKLKPE

SEQ ID NO: 12623 - protein, 6 aa, Artificial Sequence
  NLS variant
KKLLHS

SEQ ID NO: 12624 - protein, 6 aa, Artificial Sequence
  NLS variant
KKLPKK

SEQ ID NO: 12625 - protein, 6 aa, Artificial Sequence
  NLS variant
KKLPKV

SEQ ID NO: 12626 - protein, 19 aa, Artificial Sequence
  NLS variant
KKLPPLPVVEKPKLFFKKR

SEQ ID NO: 12627 - protein, 6 aa, Artificial Sequence
  NLS variant
KKLVKR

SEQ ID NO: 12628 - protein, 10 aa, Artificial Sequence
  NLS variant
KKLYQVKGKK

SEQ ID NO: 12629 - protein, 24 aa, Artificial Sequence
  NLS variant
KKMFPQGFETADLPSKKGYLRFTK

SEQ ID NO: 12630 - protein, 24 aa, Artificial Sequence
  NLS variant
KKMFPQGFKTADLPSKKGYLRHTE

SEQ ID NO: 12631 - protein, 6 aa, Artificial Sequence
  NLS variant
KKMKLE

SEQ ID NO: 12632 - protein, 6 aa, Artificial Sequence
  NLS variant
KKMKTS

SEQ ID NO: 12633 - protein, 17 aa, Artificial Sequence
  NLS variant
KKNGGKGKNKPSAKIKK

SEQ ID NO: 12634 - protein, 9 aa, Artificial Sequence
  NLS variant
KKNKDKKRK

SEQ ID NO: 12635 - protein, 6 aa, Artificial Sequence
  NLS variant
KKNKIT

SEQ ID NO: 12636 - protein, 6 aa, Artificial Sequence
  NLS variant
KKNKPE

SEQ ID NO: 12637 - protein, 6 aa, Artificial Sequence
  NLS variant
KKNPKK

SEQ ID NO: 12638 - protein, 5 aa, Artificial Sequence
  NLS variant
KKPDR

SEQ ID NO: 12639 - protein, 6 aa, Artificial Sequence
  NLS variant
KKPKGK

SEQ ID NO: 12640 - protein, 7 aa, Artificial Sequence
  NLS variant
KKPKKKK

SEQ ID NO: 12641 - protein, 6 aa, Artificial Sequence
  NLS variant
KKPKSK

SEQ ID NO: 12642 - protein, 6 aa, Artificial Sequence
  NLS variant
KKPKVS

SEQ ID NO: 12643 - protein, 13 aa, Artificial Sequence
  NLS variant
KKPKWDDFKKKKK

SEQ ID NO: 12644 - protein, 6 aa, Artificial Sequence
  NLS variant
KKPPKK

SEQ ID NO: 12645 - protein, 5 aa, Artificial Sequence
  NLS variant
KKPRG

SEQ ID NO: 12646 - protein, 13 aa, Artificial Sequence
  NLS variant
KKPTWVCPVCDKK

SEQ ID NO: 12647 - protein, 18 aa, Artificial Sequence
  NLS variant
KKQALKEKELGNDAYKKK

SEQ ID NO: 12648 - protein, 17 aa, Artificial Sequence
  NLS variant
KKQESNHMQISLCRKKV

SEQ ID NO: 12649 - protein, 5 aa, Artificial Sequence
  NLS variant
KKQHR

SEQ ID NO: 12650 - protein, 6 aa, Artificial Sequence
  NLS variant
KKQRLN

SEQ ID NO: 12651 - protein, 17 aa, Artificial Sequence
  NLS variant
KKRAFSGFSSGRATKKP

SEQ ID NO: 12652 - protein, 6 aa, Artificial Sequence
  NLS variant
KKRAKI

SEQ ID NO: 12653 - protein, 6 aa, Artificial Sequence
  NLS variant
KKRAKK

SEQ ID NO: 12654 - protein, 6 aa, Artificial Sequence
  NLS variant
KKRAKV

SEQ ID NO: 12655 - protein, 6 aa, Artificial Sequence
  NLS variant
KKRERD

SEQ ID NO: 12656 - protein, 18 aa, Artificial Sequence
  NLS variant
KKRETLPEKTARKKKRLK

SEQ ID NO: 12657 - protein, 6 aa, Artificial Sequence
  NLS variant
KKRGAR

SEQ ID NO: 12658 - protein, 5 aa, Artificial Sequence
  NLS variant
KKRGH

SEQ ID NO: 12659 - protein, 6 aa, Artificial Sequence
  NLS variant
KKRGKK

SEQ ID NO: 12660 - protein, 6 aa, Artificial Sequence
  NLS variant
KKRGKS

SEQ ID NO: 12661 - protein, 6 aa, Artificial Sequence
  NLS variant
KKRGRG

SEQ ID NO: 12662 - protein, 7 aa, Artificial Sequence
  NLS variant
KKRGRKK

SEQ ID NO: 12663 - protein, 6 aa, Artificial Sequence
  NLS variant
KKRGRP

SEQ ID NO: 12664 - protein, 5 aa, Artificial Sequence
  NLS variant
KKRHG

SEQ ID NO: 12665 - protein, 5 aa, Artificial Sequence
  NLS variant
KKRHW

SEQ ID NO: 12666 - protein, 18 aa, Artificial Sequence
  NLS variant
KKRIRPLETTQQIRKRHC

SEQ ID NO: 12667 - protein, 6 aa, Artificial Sequence
  NLS variant
KKRKAE

SEQ ID NO: 12668 - protein, 6 aa, Artificial Sequence
  NLS variant
KKRKEP

SEQ ID NO: 12669 - protein, 6 aa, Artificial Sequence
  NLS variant
KKRKGA

SEQ ID NO: 12670 - protein, 6 aa, Artificial Sequence
  NLS variant
KKRKGK

SEQ ID NO: 12671 - protein, 6 aa, Artificial Sequence
  NLS variant
KKRKGR

SEQ ID NO: 12672 - protein, 6 aa, Artificial Sequence
  NLS variant
KKRKGS

SEQ ID NO: 12673 - protein, 6 aa, Artificial Sequence
  NLS variant
KKRKHD

SEQ ID NO: 12674 - protein, 6 aa, Artificial Sequence
  NLS variant
KKRKHE

SEQ ID NO: 12675 - protein, 6 aa, Artificial Sequence
  NLS variant
KKRKIA

SEQ ID NO: 12676 - protein, 6 aa, Artificial Sequence
  NLS variant
KKRKIE

SEQ ID NO: 12677 - protein, 6 aa, Artificial Sequence
  NLS variant
KKRKIK

SEQ ID NO: 12678 - protein, 6 aa, Artificial Sequence
  NLS variant
KKRKKA

SEQ ID NO: 12679 - protein, 6 aa, Artificial Sequence
  NLS variant
KKRKKD

SEQ ID NO: 12680 - protein, 6 aa, Artificial Sequence
  NLS variant
KKRKKF

SEQ ID NO: 12681 - protein, 6 aa, Artificial Sequence
  NLS variant
KKRKKH

SEQ ID NO: 12682 - protein, 6 aa, Artificial Sequence
  NLS variant
KKRKKI

SEQ ID NO: 12683 - protein, 6 aa, Artificial Sequence
  NLS variant
KKRKKP

SEQ ID NO: 12684 - protein, 6 aa, Artificial Sequence
  NLS variant
KKRKKR

SEQ ID NO: 12685 - protein, 6 aa, Artificial Sequence
  NLS variant
KKRKKS

SEQ ID NO: 12686 - protein, 6 aa, Artificial Sequence
  NLS variant
KKRKKY

SEQ ID NO: 12687 - protein, 6 aa, Artificial Sequence
  NLS variant
KKRKLA

SEQ ID NO: 12688 - protein, 6 aa, Artificial Sequence
  NLS variant
KKRKLE

SEQ ID NO: 12689 - protein, 6 aa, Artificial Sequence
  NLS variant
KKRKLG

SEQ ID NO: 12690 - protein, 6 aa, Artificial Sequence
  NLS variant
KKRKLN

SEQ ID NO: 12691 - protein, 6 aa, Artificial Sequence
  NLS variant
KKRKLP

SEQ ID NO: 12692 - protein, 6 aa, Artificial Sequence
  NLS variant
KKRKLT

SEQ ID NO: 12693 - protein, 7 aa, Artificial Sequence
  NLS variant
KKRKMTK

SEQ ID NO: 12694 - protein, 6 aa, Artificial Sequence
  NLS variant
KKRKPE

SEQ ID NO: 12695 - protein, 6 aa, Artificial Sequence
  NLS variant
KKRKPR

SEQ ID NO: 12696 - protein, 6 aa, Artificial Sequence
  NLS variant
KKRKRA

SEQ ID NO: 12697 - protein, 6 aa, Artificial Sequence
  NLS variant
KKRKRD

SEQ ID NO: 12698 - protein, 6 aa, Artificial Sequence
  NLS variant
KKRKRL

SEQ ID NO: 12699 - protein, 6 aa, Artificial Sequence
  NLS variant
KKRKRQ

SEQ ID NO: 12700 - protein, 6 aa, Artificial Sequence
  NLS variant
KKRKRS

SEQ ID NO: 12701 - protein, 6 aa, Artificial Sequence
  NLS variant
KKRKRV

SEQ ID NO: 12702 - protein, 6 aa, Artificial Sequence
  NLS variant
KKRKSE

SEQ ID NO: 12703 - protein, 6 aa, Artificial Sequence
  NLS variant
KKRKSK

SEQ ID NO: 12704 - protein, 6 aa, Artificial Sequence
  NLS variant
KKRKSS

SEQ ID NO: 12705 - protein, 6 aa, Artificial Sequence
  NLS variant
KKRKTE

SEQ ID NO: 12706 - protein, 6 aa, Artificial Sequence
  NLS variant
KKRKTR

SEQ ID NO: 12707 - protein, 6 aa, Artificial Sequence
  NLS variant
KKRLST

SEQ ID NO: 12708 - protein, 8 aa, Artificial Sequence
  NLS variant
KKRLSTSA

SEQ ID NO: 12709 - protein, 18 aa, Artificial Sequence
  NLS variant
KKRNATTKLAERKTKRSR

SEQ ID NO: 12710 - protein, 5 aa, Artificial Sequence
  NLS variant
KKRPD

SEQ ID NO: 12711 - protein, 6 aa, Artificial Sequence
  NLS variant
KKRPPV

SEQ ID NO: 12712 - protein, 6 aa, Artificial Sequence
  NLS variant
KKRPRR

SEQ ID NO: 12713 - protein, 6 aa, Artificial Sequence
  NLS variant
KKRQRL

SEQ ID NO: 12714 - protein, 10 aa, Artificial Sequence
  NLS variant
KKRREKQRRR

SEQ ID NO: 12715 - protein, 14 aa, Artificial Sequence
  NLS variant
KKRRGGRRLRKMKE

SEQ ID NO: 12716 - protein, 9 aa, Artificial Sequence
  NLS variant
KKRRGRPRK

SEQ ID NO: 12717 - protein, 6 aa, Artificial Sequence
  NLS variant
KKRRKH

SEQ ID NO: 12718 - protein, 9 aa, Artificial Sequence
  NLS variant
KKRRKHKRR

SEQ ID NO: 12719 - protein, 9 aa, Artificial Sequence
  NLS variant
KKRRKRRRK

SEQ ID NO: 12720 - protein, 6 aa, Artificial Sequence
  NLS variant
KKRRKV

SEQ ID NO: 12721 - protein, 6 aa, Artificial Sequence
  NLS variant
KKRRLE

SEQ ID NO: 12722 - protein, 6 aa, Artificial Sequence
  NLS variant
KKRRRD

SEQ ID NO: 12723 - protein, 6 aa, Artificial Sequence
  NLS variant
KKRRRK

SEQ ID NO: 12724 - protein, 6 aa, Artificial Sequence
  NLS variant
KKRRRQ

SEQ ID NO: 12725 - protein, 9 aa, Artificial Sequence
  NLS variant
KKRRRRARK

SEQ ID NO: 12726 - protein, 6 aa, Artificial Sequence
  NLS variant
KKRRRT

SEQ ID NO: 12727 - protein, 6 aa, Artificial Sequence
  NLS variant
KKRRSS

SEQ ID NO: 12728 - protein, 5 aa, Artificial Sequence
  NLS variant
KKRRY

SEQ ID NO: 12729 - protein, 6 aa, Artificial Sequence
  NLS variant
KKRSGK

SEQ ID NO: 12730 - protein, 6 aa, Artificial Sequence
  NLS variant
KKRSKA

SEQ ID NO: 12731 - protein, 6 aa, Artificial Sequence
  NLS variant
KKRSKR

SEQ ID NO: 12732 - protein, 6 aa, Artificial Sequence
  NLS variant
KKRSLE

SEQ ID NO: 12733 - protein, 35 aa, Artificial Sequence
  NLS variant
KKRSLEDNETEIKVSRDTWNTKNMRSLEPPRSKKR

SEQ ID NO: 12734 - protein, 6 aa, Artificial Sequence
  NLS variant
KKRTKD

SEQ ID NO: 12735 - protein, 8 aa, Artificial Sequence
  NLS variant
KKRTYISV

SEQ ID NO: 12736 - protein, 5 aa, Artificial Sequence
  NLS variant
KKRWY

SEQ ID NO: 12737 - protein, 6 aa, Artificial Sequence
  NLS variant
KKSAKV

SEQ ID NO: 12738 - protein, 17 aa, Artificial Sequence
  NLS variant
KKSCRKRLADHNRRRRK

SEQ ID NO: 12739 - protein, 15 aa, Artificial Sequence
  NLS variant
KKSFSTLFLETVKRK

SEQ ID NO: 12740 - protein, 7 aa, Artificial Sequence
  NLS variant
KKSILKK

SEQ ID NO: 12741 - protein, 11 aa, Artificial Sequence
  NLS variant
KKSILKKKEQS

SEQ ID NO: 12742 - protein, 7 aa, Artificial Sequence
  NLS variant
KKSKDKK

SEQ ID NO: 12743 - protein, 7 aa, Artificial Sequence
  NLS variant
KKSKKGR

SEQ ID NO: 12744 - protein, 7 aa, Artificial Sequence
  NLS variant
KKSKKRR

SEQ ID NO: 12745 - protein, 6 aa, Artificial Sequence
  NLS variant
KKSKRG

SEQ ID NO: 12746 - protein, 7 aa, Artificial Sequence
  NLS variant
KKSKRGR

SEQ ID NO: 12747 - protein, 7 aa, Artificial Sequence
  NLS variant
KKSKSKR

SEQ ID NO: 12748 - protein, 6 aa, Artificial Sequence
  NLS variant
KKSNKK

SEQ ID NO: 12749 - protein, 6 aa, Artificial Sequence
  NLS variant
KKSRKG

SEQ ID NO: 12750 - protein, 6 aa, Artificial Sequence
  NLS variant
KKSRKR

SEQ ID NO: 12751 - protein, 8 aa, Artificial Sequence
  NLS variant
KKSRKRGS

SEQ ID NO: 12752 - protein, 6 aa, Artificial Sequence
  NLS variant
KKSRLK

SEQ ID NO: 12753 - protein, 9 aa, Artificial Sequence
  NLS variant
KKSRLKRRR

SEQ ID NO: 12754 - protein, 6 aa, Artificial Sequence
  NLS variant
KKSRRS

SEQ ID NO: 12755 - protein, 6 aa, Artificial Sequence
  NLS variant
KKSSQK

SEQ ID NO: 12756 - protein, 17 aa, Artificial Sequence
  NLS variant
KKSSQSKKKKKAFSSQK

SEQ ID NO: 12757 - protein, 17 aa, Artificial Sequence
  NLS variant
KKSSQTKKKKKAFNSPK

SEQ ID NO: 12758 - protein, 16 aa, Artificial Sequence
  NLS variant
KKSSTRKDKEESKKKR

SEQ ID NO: 12759 - protein, 17 aa, Artificial Sequence
  NLS variant
KKSTALSRELGKIMRRR

SEQ ID NO: 12760 - protein, 18 aa, Artificial Sequence
  NLS variant
KKSYDRTKRQRRRNWKLK

SEQ ID NO: 12761 - protein, 17 aa, Artificial Sequence
  NLS variant
KKSYQDPEIIAHSRPRK

SEQ ID NO: 12762 - protein, 17 aa, Artificial Sequence
  NLS variant
KKTGKNRKLKSKRVKPR

SEQ ID NO: 12763 - protein, 17 aa, Artificial Sequence
  NLS variant
KKTGKNRKLKSKRVKTR

SEQ ID NO: 12764 - protein, 6 aa, Artificial Sequence
  NLS variant
KKTGKR

SEQ ID NO: 12765 - protein, 6 aa, Artificial Sequence
  NLS variant
KKVKLQ

SEQ ID NO: 12766 - protein, 7 aa, Artificial Sequence
  NLS variant
KKVRKVP

SEQ ID NO: 12767 - protein, 8 aa, Artificial Sequence
  NLS variant
KKVRKVPP

SEQ ID NO: 12768 - protein, 17 aa, Artificial Sequence
  NLS variant
KKVSIAGQSGKLWRWKR

SEQ ID NO: 12769 - protein, 20 aa, Artificial Sequence
  NLS variant
KKYENVVIKRSPRKRGRPRK

SEQ ID NO: 12770 - protein, 6 aa, Artificial Sequence
  NLS variant
KKYGPK

SEQ ID NO: 12771 - protein, 6 aa, Artificial Sequence
  NLS variant
KKYKKK

SEQ ID NO: 12772 - protein, 6 aa, Artificial Sequence
  NLS variant
KLKRKD

SEQ ID NO: 12773 - protein, 6 aa, Artificial Sequence
  NLS variant
KLKRKR

SEQ ID NO: 12774 - protein, 7 aa, Artificial Sequence
  NLS variant
KLKRKRS

SEQ ID NO: 12775 - protein, 6 aa, Artificial Sequence
  NLS variant
KLKRKS

SEQ ID NO: 12776 - protein, 7 aa, Artificial Sequence
  NLS variant
KLLPPKK

SEQ ID NO: 12777 - protein, 6 aa, Artificial Sequence
  NLS variant
KLPKVK

SEQ ID NO: 12778 - protein, 6 aa, Artificial Sequence
  NLS variant
KLQRKR

SEQ ID NO: 12779 - protein, 15 aa, Artificial Sequence
  NLS variant
KLVPGLFKDEMKRRR

SEQ ID NO: 12780 - protein, 15 aa, Artificial Sequence
  NLS variant
KLVPGLFKNEMKRRR

SEQ ID NO: 12781 - protein, 18 aa, Artificial Sequence
  NLS variant
KLVTKLQNSERKKRGARR

SEQ ID NO: 12782 - protein, 11 aa, Artificial Sequence
  NLS variant
KMISRKKKHQA

SEQ ID NO: 12783 - protein, 5 aa, Artificial Sequence
  NLS variant
KMRKK

SEQ ID NO: 12784 - protein, 7 aa, Artificial Sequence
  NLS variant
KNKDKKR

SEQ ID NO: 12785 - protein, 6 aa, Artificial Sequence
  NLS variant
KNKKGK

SEQ ID NO: 12786 - protein, 6 aa, Artificial Sequence
  NLS variant
KNKKRK

SEQ ID NO: 12787 - protein, 6 aa, Artificial Sequence
  NLS variant
KNKRQR

SEQ ID NO: 12788 - protein, 6 aa, Artificial Sequence
  NLS variant
KNKRRK

SEQ ID NO: 12789 - protein, 5 aa, Artificial Sequence
  NLS variant
KNMKR

SEQ ID NO: 12790 - protein, 6 aa, Artificial Sequence
  NLS variant
KNRKLK

SEQ ID NO: 12791 - protein, 6 aa, Artificial Sequence
  NLS variant
KNRLKS

SEQ ID NO: 12792 - protein, 5 aa, Artificial Sequence
  NLS variant
KNRRF

SEQ ID NO: 12793 - protein, 5 aa, Artificial Sequence
  NLS variant
KNRRL

SEQ ID NO: 12794 - protein, 6 aa, Artificial Sequence
  NLS variant
KPAKKK

SEQ ID NO: 12795 - protein, 6 aa, Artificial Sequence
  NLS variant
KPDPKK

SEQ ID NO: 12796 - protein, 6 aa, Artificial Sequence
  NLS variant
KPGRKP

SEQ ID NO: 12797 - protein, 6 aa, Artificial Sequence
  NLS variant
KPGRPR

SEQ ID NO: 12798 - protein, 5 aa, Artificial Sequence
  NLS variant
KPKEH

SEQ ID NO: 12799 - protein, 6 aa, Artificial Sequence
  NLS variant
KPKIRK

SEQ ID NO: 12800 - protein, 6 aa, Artificial Sequence
  NLS variant
KPKKKR

SEQ ID NO: 12801 - protein, 7 aa, Artificial Sequence
  NLS variant
KPKKKSK

SEQ ID NO: 12802 - protein, 6 aa, Artificial Sequence
  NLS variant
KPKKKT

SEQ ID NO: 12803 - protein, 6 aa, Artificial Sequence
  NLS variant
KPKKLR

SEQ ID NO: 12804 - protein, 6 aa, Artificial Sequence
  NLS variant
KPKKRK

SEQ ID NO: 12805 - protein, 6 aa, Artificial Sequence
  NLS variant
KPKKRR

SEQ ID NO: 12806 - protein, 6 aa, Artificial Sequence
  NLS variant
KPKKSK

SEQ ID NO: 12807 - protein, 6 aa, Artificial Sequence
  NLS variant
KPKLKK

SEQ ID NO: 12808 - protein, 6 aa, Artificial Sequence
  NLS variant
KPKNKK

SEQ ID NO: 12809 - protein, 6 aa, Artificial Sequence
  NLS variant
KPKRGR

SEQ ID NO: 12810 - protein, 6 aa, Artificial Sequence
  NLS variant
KPKSKR

SEQ ID NO: 12811 - protein, 6 aa, Artificial Sequence
  NLS variant
KPKTPK

SEQ ID NO: 12812 - protein, 7 aa, Artificial Sequence
  NLS variant
KPLKKLR

SEQ ID NO: 12813 - protein, 6 aa, Artificial Sequence
  NLS variant
KPLKKR

SEQ ID NO: 12814 - protein, 6 aa, Artificial Sequence
  NLS variant
KPMKKR

SEQ ID NO: 12815 - protein, 6 aa, Artificial Sequence
  NLS variant
KPRGRP

SEQ ID NO: 12816 - protein, 6 aa, Artificial Sequence
  NLS variant
KPRKKR

SEQ ID NO: 12817 - protein, 6 aa, Artificial Sequence
  NLS variant
KPRKPR

SEQ ID NO: 12818 - protein, 10 aa, Artificial Sequence
  NLS variant
KPRQKRPRRR

SEQ ID NO: 12819 - protein, 9 aa, Artificial Sequence
  NLS variant
KPRRIRKPR

SEQ ID NO: 12820 - protein, 7 aa, Artificial Sequence
  NLS variant
KPSKKKK

SEQ ID NO: 12821 - protein, 6 aa, Artificial Sequence
  NLS variant
KPTKKK

SEQ ID NO: 12822 - protein, 6 aa, Artificial Sequence
  NLS variant
KPVPRK

SEQ ID NO: 12823 - protein, 6 aa, Artificial Sequence
  NLS variant
KPVRKV

SEQ ID NO: 12824 - protein, 6 aa, Artificial Sequence
  NLS variant
KQALKK

SEQ ID NO: 12825 - protein, 17 aa, Artificial Sequence
  NLS variant
KQEDKNAMDVIVKVIKR

SEQ ID NO: 12826 - protein, 6 aa, Artificial Sequence
  NLS variant
KQKKRK

SEQ ID NO: 12827 - protein, 6 aa, Artificial Sequence
  NLS variant
KQKRKR

SEQ ID NO: 12828 - protein, 6 aa, Artificial Sequence
  NLS variant
KQLKLR

SEQ ID NO: 12829 - protein, 6 aa, Artificial Sequence
  NLS variant
KQRLNK

SEQ ID NO: 12830 - protein, 15 aa, Artificial Sequence
  NLS variant
KRAADEVLAEAKKPR

SEQ ID NO: 12831 - protein, 6 aa, Artificial Sequence
  NLS variant
KRAKLD

SEQ ID NO: 12832 - protein, 19 aa, Artificial Sequence
  NLS variant
KRAMKDDSHGNSTSPKRRK

SEQ ID NO: 12833 - protein, 17 aa, Artificial Sequence
  NLS variant
KRANSNLVAAYEKAKKK

SEQ ID NO: 12834 - protein, 6 aa, Artificial Sequence
  NLS variant
KRARAC

SEQ ID NO: 12835 - protein, 6 aa, Artificial Sequence
  NLS variant
KRARAL

SEQ ID NO: 12836 - protein, 22 aa, Artificial Sequence
  NLS variant
KRASEDTTSGSPPKKSSAGPKR

SEQ ID NO: 12837 - protein, 14 aa, Artificial Sequence
  NLS variant
KRCIWSTPKRRHKK

SEQ ID NO: 12838 - protein, 5 aa, Artificial Sequence
  NLS variant
KRCKI

SEQ ID NO: 12839 - protein, 6 aa, Artificial Sequence
  NLS variant
KRDAER

SEQ ID NO: 12840 - protein, 6 aa, Artificial Sequence
  NLS variant
KRDREK

SEQ ID NO: 12841 - protein, 5 aa, Artificial Sequence
  NLS variant
KRDRV

SEQ ID NO: 12842 - protein, 14 aa, Artificial Sequence
  NLS variant
KRDVLDDLYRKLQR

SEQ ID NO: 12843 - protein, 6 aa, Artificial Sequence
  NLS variant
KRELEK

SEQ ID NO: 12844 - protein, 6 aa, Artificial Sequence
  NLS variant
KRERDE

SEQ ID NO: 12845 - protein, 6 aa, Artificial Sequence
  NLS variant
KRERKQ

SEQ ID NO: 12846 - protein, 6 aa, Artificial Sequence
  NLS variant
KRERRD

SEQ ID NO: 12847 - protein, 6 aa, Artificial Sequence
  NLS variant
KRERRK

SEQ ID NO: 12848 - protein, 6 aa, Artificial Sequence
  NLS variant
KRERRQ

SEQ ID NO: 12849 - protein, 14 aa, Artificial Sequence
  NLS variant
KRFARGDKRGKLPR

SEQ ID NO: 12850 - protein, 50 aa, Artificial Sequence
  NLS variant
KRFFKINSHVTLFIFIQEAAKYENHTENALLLYMACTHASNPVYATMKIR

SEQ ID NO: 12851 - protein, 6 aa, Artificial Sequence
  NLS variant
KRFKRR

SEQ ID NO: 12852 - protein, 16 aa, Artificial Sequence
  NLS variant
KRFKRRWMVRKMKTKK

SEQ ID NO: 12853 - protein, 17 aa, Artificial Sequence
  NLS variant
KRFLLLFSFLKRNQKKK

SEQ ID NO: 12854 - protein, 6 aa, Artificial Sequence
  NLS variant
KRFRKR

SEQ ID NO: 12855 - protein, 48 aa, Artificial Sequence
  NLS variant
KRFYRLNHHVTYNHQEAGKYENHTENALLLYMACTHASNPVYATLKIR

SEQ ID NO: 12856 - protein, 6 aa, Artificial Sequence
  NLS variant
KRGGRL

SEQ ID NO: 12857 - protein, 19 aa, Artificial Sequence
  NLS variant
KRGINDRNFWRGENGRKTR

SEQ ID NO: 12858 - protein, 17 aa, Artificial Sequence
  NLS variant
KRGITNTLEESSSLKRK

SEQ ID NO: 12859 - protein, 6 aa, Artificial Sequence
  NLS variant
KRGKSK

SEQ ID NO: 12860 - protein, 16 aa, Artificial Sequence
  NLS variant
KRGLNSSFETSPKKVK

SEQ ID NO: 12861 - protein, 16 aa, Artificial Sequence
  NLS variant
KRGLSVDSAQEVKRFR

SEQ ID NO: 12862 - protein, 5 aa, Artificial Sequence
  NLS variant
KRGNR

SEQ ID NO: 12863 - protein, 20 aa, Artificial Sequence
  NLS variant
KRGNSSIGPNDLSKRKQRKK

SEQ ID NO: 12864 - protein, 6 aa, Artificial Sequence
  NLS variant
KRGPKK

SEQ ID NO: 12865 - protein, 6 aa, Artificial Sequence
  NLS variant
KRGPKP

SEQ ID NO: 12866 - protein, 6 aa, Artificial Sequence
  NLS variant
KRGPPK

SEQ ID NO: 12867 - protein, 6 aa, Artificial Sequence
  NLS variant
KRGRGR

SEQ ID NO: 12868 - protein, 6 aa, Artificial Sequence
  NLS variant
KRGRKE

SEQ ID NO: 12869 - protein, 6 aa, Artificial Sequence
  NLS variant
KRGRKP

SEQ ID NO: 12870 - protein, 6 aa, Artificial Sequence
  NLS variant
KRGRKS

SEQ ID NO: 12871 - protein, 5 aa, Artificial Sequence
  NLS variant
KRGRN

SEQ ID NO: 12872 - protein, 6 aa, Artificial Sequence
  NLS variant
KRGRPA

SEQ ID NO: 12873 - protein, 6 aa, Artificial Sequence
  NLS variant
KRGRPP

SEQ ID NO: 12874 - protein, 6 aa, Artificial Sequence
  NLS variant
KRGRPR

SEQ ID NO: 12875 - protein, 6 aa, Artificial Sequence
  NLS variant
KRGRQP

SEQ ID NO: 12876 - protein, 6 aa, Artificial Sequence
  NLS variant
KRGRRK

SEQ ID NO: 12877 - protein, 6 aa, Artificial Sequence
  NLS variant
KRGRRR

SEQ ID NO: 12878 - protein, 14 aa, Artificial Sequence
  NLS variant
KRGSDSMRWHFRKR

SEQ ID NO: 12879 - protein, 5 aa, Artificial Sequence
  NLS variant
KRHCF

SEQ ID NO: 12880 - protein, 5 aa, Artificial Sequence
  NLS variant
KRHDE

SEQ ID NO: 12881 - protein, 5 aa, Artificial Sequence
  NLS variant
KRHDG

SEQ ID NO: 12882 - protein, 6 aa, Artificial Sequence
  NLS variant
KRHEGD

SEQ ID NO: 12883 - protein, 5 aa, Artificial Sequence
  NLS variant
KRHRC

SEQ ID NO: 12884 - protein, 6 aa, Artificial Sequence
  NLS variant
KRHRKP

SEQ ID NO: 12885 - protein, 23 aa, Artificial Sequence
  NLS variant
KRIHSVSLSQSQIDPSKKVKRAK

SEQ ID NO: 12886 - protein, 6 aa, Artificial Sequence
  NLS variant
KRIKRK

SEQ ID NO: 12887 - protein, 6 aa, Artificial Sequence
  NLS variant
KRIRLE

SEQ ID NO: 12888 - protein, 6 aa, Artificial Sequence
  NLS variant
KRIRPR

SEQ ID NO: 12889 - protein, 6 aa, Artificial Sequence
  NLS variant
KRIRRS

SEQ ID NO: 12890 - protein, 17 aa, Artificial Sequence
  NLS variant
KRISDEKAFPLDGKRQR

SEQ ID NO: 12891 - protein, 18 aa, Artificial Sequence
  NLS variant
KRIWNWRACEAAKKTKAD

SEQ ID NO: 12892 - protein, 15 aa, Artificial Sequence
  NLS variant
KRKADGYNQPDSKRR

SEQ ID NO: 12893 - protein, 15 aa, Artificial Sequence
  NLS variant
KRKADGYNQPDTKRR

SEQ ID NO: 12894 - protein, 6 aa, Artificial Sequence
  NLS variant
KRKADT

SEQ ID NO: 12895 - protein, 6 aa, Artificial Sequence
  NLS variant
KRKAEK

SEQ ID NO: 12896 - protein, 6 aa, Artificial Sequence
  NLS variant
KRKAKE

SEQ ID NO: 12897 - protein, 19 aa, Artificial Sequence
  NLS variant
KRKAKENIGKVNKKSNKKR

SEQ ID NO: 12898 - protein, 16 aa, Artificial Sequence
  NLS variant
KRKAKLLSMLEELKRR

SEQ ID NO: 12899 - protein, 6 aa, Artificial Sequence
  NLS variant
KRKALP

SEQ ID NO: 12900 - protein, 8 aa, Artificial Sequence
  NLS variant
KRKATTSG

SEQ ID NO: 12901 - protein, 6 aa, Artificial Sequence
  NLS variant
KRKAVD

SEQ ID NO: 12902 - protein, 5 aa, Artificial Sequence
  NLS variant
KRKCI

SEQ ID NO: 12903 - protein, 7 aa, Artificial Sequence
  NLS variant
KRKDREK

SEQ ID NO: 12904 - protein, 8 aa, Artificial Sequence
  NLS variant
KRKEHPDS

SEQ ID NO: 12905 - protein, 6 aa, Artificial Sequence
  NLS variant
KRKEKA

SEQ ID NO: 12906 - protein, 8 aa, Artificial Sequence
  NLS variant
KRKGKGGP

SEQ ID NO: 12907 - protein, 15 aa, Artificial Sequence
  NLS variant
KRKGKLKNKGSKRKK

SEQ ID NO: 12908 - protein, 16 aa, Artificial Sequence
  NLS variant
KRKGPDSLSDGPACKR

SEQ ID NO: 12909 - protein, 15 aa, Artificial Sequence
  NLS variant
KRKGRAKGKGNKRKT

SEQ ID NO: 12910 - protein, 6 aa, Artificial Sequence
  NLS variant
KRKHED

SEQ ID NO: 12911 - protein, 6 aa, Artificial Sequence
  NLS variant
KRKHES

SEQ ID NO: 12912 - protein, 6 aa, Artificial Sequence
  NLS variant
KRKHKR

SEQ ID NO: 12913 - protein, 7 aa, Artificial Sequence
  NLS variant
KRKHVVK

SEQ ID NO: 12914 - protein, 6 aa, Artificial Sequence
  NLS variant
KRKKAV

SEQ ID NO: 12915 - protein, 32 aa, Artificial Sequence
  NLS variant
KRKKGEKQAPGEEKGRKRRRVKEDKKKRDRDR

SEQ ID NO: 12916 - protein, 6 aa, Artificial Sequence
  NLS variant
KRKKGK

SEQ ID NO: 12917 - protein, 6 aa, Artificial Sequence
  NLS variant
KRKKKD

SEQ ID NO: 12918 - protein, 6 aa, Artificial Sequence
  NLS variant
KRKKKH

SEQ ID NO: 12919 - protein, 6 aa, Artificial Sequence
  NLS variant
KRKKKP

SEQ ID NO: 12920 - protein, 6 aa, Artificial Sequence
  NLS variant
KRKKLK

SEQ ID NO: 12921 - protein, 6 aa, Artificial Sequence
  NLS variant
KRKKLP

SEQ ID NO: 12922 - protein, 6 aa, Artificial Sequence
  NLS variant
KRKKMK

SEQ ID NO: 12923 - protein, 7 aa, Artificial Sequence
  NLS variant
KRKKRKK

SEQ ID NO: 12924 - protein, 7 aa, Artificial Sequence
  NLS variant
KRKKRRR

SEQ ID NO: 12925 - protein, 9 aa, Artificial Sequence
  NLS variant
KRKKRRRQK

SEQ ID NO: 12926 - protein, 6 aa, Artificial Sequence
  NLS variant
KRKLAE

SEQ ID NO: 12927 - protein, 6 aa, Artificial Sequence
  NLS variant
KRKLEH

SEQ ID NO: 12928 - protein, 6 aa, Artificial Sequence
  NLS variant
KRKLES

SEQ ID NO: 12929 - protein, 6 aa, Artificial Sequence
  NLS variant
KRKLKK

SEQ ID NO: 12930 - protein, 13 aa, Artificial Sequence
  NLS variant
KRKNEKAGSKRKK

SEQ ID NO: 12931 - protein, 6 aa, Artificial Sequence
  NLS variant
KRKNES

SEQ ID NO: 12932 - protein, 8 aa, Artificial Sequence
  NLS variant
KRKNSVEF

SEQ ID NO: 12933 - protein, 18 aa, Artificial Sequence
  NLS variant
KRKNTKIISNMEKKRQRL

SEQ ID NO: 12934 - protein, 6 aa, Artificial Sequence
  NLS variant
KRKPEE

SEQ ID NO: 12935 - protein, 6 aa, Artificial Sequence
  NLS variant
KRKPKE

SEQ ID NO: 12936 - protein, 28 aa, Artificial Sequence
  NLS variant
KRKPKEESEEGNSAESAAEERDQDKKRR

SEQ ID NO: 12937 - protein, 6 aa, Artificial Sequence
  NLS variant
KRKPKR

SEQ ID NO: 12938 - protein, 6 aa, Artificial Sequence
  NLS variant
KRKPLG

SEQ ID NO: 12939 - protein, 6 aa, Artificial Sequence
  NLS variant
KRKPLP

SEQ ID NO: 12940 - protein, 29 aa, Artificial Sequence
  NLS variant
KRKPQEESERAKSDESIKEEDKDQDEKRR

SEQ ID NO: 12941 - protein, 8 aa, Artificial Sequence
  NLS variant
KRKQNQVD

SEQ ID NO: 12942 - protein, 6 aa, Artificial Sequence
  NLS variant
KRKQRK

SEQ ID NO: 12943 - protein, 6 aa, Artificial Sequence
  NLS variant
KRKRAV

SEQ ID NO: 12944 - protein, 6 aa, Artificial Sequence
  NLS variant
KRKRDD

SEQ ID NO: 12945 - protein, 6 aa, Artificial Sequence
  NLS variant
KRKRDS

SEQ ID NO: 12946 - protein, 6 aa, Artificial Sequence
  NLS variant
KRKRDV

SEQ ID NO: 12947 - protein, 6 aa, Artificial Sequence
  NLS variant
KRKRGP

SEQ ID NO: 12948 - protein, 9 aa, Artificial Sequence
  NLS variant
KRKRGRPRK

SEQ ID NO: 12949 - protein, 6 aa, Artificial Sequence
  NLS variant
KRKRGS

SEQ ID NO: 12950 - protein, 6 aa, Artificial Sequence
  NLS variant
KRKRGT

SEQ ID NO: 12951 - protein, 6 aa, Artificial Sequence
  NLS variant
KRKRID

SEQ ID NO: 12952 - protein, 6 aa, Artificial Sequence
  NLS variant
KRKRKP

SEQ ID NO: 12953 - protein, 6 aa, Artificial Sequence
  NLS variant
KRKRKQ

SEQ ID NO: 12954 - protein, 6 aa, Artificial Sequence
  NLS variant
KRKRKR

SEQ ID NO: 12955 - protein, 6 aa, Artificial Sequence
  NLS variant
KRKRKS

SEQ ID NO: 12956 - protein, 8 aa, Artificial Sequence
  NLS variant
KRKRKTKA

SEQ ID NO: 12957 - protein, 6 aa, Artificial Sequence
  NLS variant
KRKRKV

SEQ ID NO: 12958 - protein, 7 aa, Artificial Sequence
  NLS variant
KRKRLLE

SEQ ID NO: 12959 - protein, 6 aa, Artificial Sequence
  NLS variant
KRKRLS

SEQ ID NO: 12960 - protein, 8 aa, Artificial Sequence
  NLS variant
KRKRMISN

SEQ ID NO: 12961 - protein, 6 aa, Artificial Sequence
  NLS variant
KRKRML

SEQ ID NO: 12962 - protein, 6 aa, Artificial Sequence
  NLS variant
KRKRNR

SEQ ID NO: 12963 - protein, 5 aa, Artificial Sequence
  NLS variant
KRKRP

SEQ ID NO: 12964 - protein, 16 aa, Artificial Sequence
  NLS variant
KRKRPLLLNTNGAQKK

SEQ ID NO: 12965 - protein, 6 aa, Artificial Sequence
  NLS variant
KRKRPR

SEQ ID NO: 12966 - protein, 6 aa, Artificial Sequence
  NLS variant
KRKRQE

SEQ ID NO: 12967 - protein, 6 aa, Artificial Sequence
  NLS variant
KRKRQK

SEQ ID NO: 12968 - protein, 6 aa, Artificial Sequence
  NLS variant
KRKRQR

SEQ ID NO: 12969 - protein, 7 aa, Artificial Sequence
  NLS variant
KRKRREE

SEQ ID NO: 12970 - protein, 7 aa, Artificial Sequence
  NLS variant
KRKRREK

SEQ ID NO: 12971 - protein, 6 aa, Artificial Sequence
  NLS variant
KRKRRL

SEQ ID NO: 12972 - protein, 6 aa, Artificial Sequence
  NLS variant
KRKRRR

SEQ ID NO: 12973 - protein, 6 aa, Artificial Sequence
  NLS variant
KRKRRV

SEQ ID NO: 12974 - protein, 6 aa, Artificial Sequence
  NLS variant
KRKRRY

SEQ ID NO: 12975 - protein, 6 aa, Artificial Sequence
  NLS variant
KRKRSE

SEQ ID NO: 12976 - protein, 6 aa, Artificial Sequence
  NLS variant
KRKRSV

SEQ ID NO: 12977 - protein, 6 aa, Artificial Sequence
  NLS variant
KRKRTK

SEQ ID NO: 12978 - protein, 6 aa, Artificial Sequence
  NLS variant
KRKRVD

SEQ ID NO: 12979 - protein, 6 aa, Artificial Sequence
  NLS variant
KRKRVK

SEQ ID NO: 12980 - protein, 6 aa, Artificial Sequence
  NLS variant
KRKRVL

SEQ ID NO: 12981 - protein, 6 aa, Artificial Sequence
  NLS variant
KRKRVN

SEQ ID NO: 12982 - protein, 6 aa, Artificial Sequence
  NLS variant
KRKRVT

SEQ ID NO: 12983 - protein, 5 aa, Artificial Sequence
  NLS variant
KRKRW

SEQ ID NO: 12984 - protein, 6 aa, Artificial Sequence
  NLS variant
KRKSED

SEQ ID NO: 12985 - protein, 6 aa, Artificial Sequence
  NLS variant
KRKSKS

SEQ ID NO: 12986 - protein, 6 aa, Artificial Sequence
  NLS variant
KRKSVE

SEQ ID NO: 12987 - protein, 6 aa, Artificial Sequence
  NLS variant
KRKTRK

SEQ ID NO: 12988 - protein, 6 aa, Artificial Sequence
  NLS variant
KRKVKD

SEQ ID NO: 12989 - protein, 15 aa, Artificial Sequence
  NLS variant
KRKVSSSKPEENKIR

SEQ ID NO: 12990 - protein, 5 aa, Artificial Sequence
  NLS variant
KRKYV

SEQ ID NO: 12991 - protein, 6 aa, Artificial Sequence
  NLS variant
KRLAER

SEQ ID NO: 12992 - protein, 6 aa, Artificial Sequence
  NLS variant
KRLKAK

SEQ ID NO: 12993 - protein, 5 aa, Artificial Sequence
  NLS variant
KRLKH

SEQ ID NO: 12994 - protein, 17 aa, Artificial Sequence
  NLS variant
KRLKLIGSKTADRPVKR

SEQ ID NO: 12995 - protein, 6 aa, Artificial Sequence
  NLS variant
KRLKRH

SEQ ID NO: 12996 - protein, 6 aa, Artificial Sequence
  NLS variant
KRLKRQ

SEQ ID NO: 12997 - protein, 6 aa, Artificial Sequence
  NLS variant
KRLKRV

SEQ ID NO: 12998 - protein, 6 aa, Artificial Sequence
  NLS variant
KRLKSD

SEQ ID NO: 12999 - protein, 6 aa, Artificial Sequence
  NLS variant
KRMKET

SEQ ID NO: 13000 - protein, 5 aa, Artificial Sequence
  NLS variant
KRMKR

SEQ ID NO: 13001 - protein, 6 aa, Artificial Sequence
  NLS variant
KRNARL

SEQ ID NO: 13002 - protein, 17 aa, Artificial Sequence
  NLS variant
KRNCLLTDGKAAKRRAR

SEQ ID NO: 13003 - protein, 18 aa, Artificial Sequence
  NLS variant
KRNYDTAFSTPMSNVRRR

SEQ ID NO: 13004 - protein, 16 aa, Artificial Sequence
  NLS variant
KRPAASKKAGQAKKKK

SEQ ID NO: 13005 - protein, 16 aa, Artificial Sequence
  NLS variant
KRPAASKKGSQAKKKK

SEQ ID NO: 13006 - protein, 20 aa, Artificial Sequence
  NLS variant
KRPASDMGKKPKTPKKKKKK

SEQ ID NO: 13007 - protein, 18 aa, Artificial Sequence
  NLS variant
KRPGDIIISTPGSKVRRR

SEQ ID NO: 13008 - protein, 18 aa, Artificial Sequence
  NLS variant
KRPGDIIISTPVSKVRRR

SEQ ID NO: 13009 - protein, 6 aa, Artificial Sequence
  NLS variant
KRPGRP

SEQ ID NO: 13010 - protein, 19 aa, Artificial Sequence
  NLS variant
KRPIEEDGDDKSPSKKKKK

SEQ ID NO: 13011 - protein, 19 aa, Artificial Sequence
  NLS variant
KRPIEEDGEDKSPSKKKKK

SEQ ID NO: 13012 - protein, 6 aa, Artificial Sequence
  NLS variant
KRPKEE

SEQ ID NO: 13013 - protein, 6 aa, Artificial Sequence
  NLS variant
KRPKKR

SEQ ID NO: 13014 - protein, 9 aa, Artificial Sequence
  NLS variant
KRPKKRGRK

SEQ ID NO: 13015 - protein, 5 aa, Artificial Sequence
  NLS variant
KRPKP

SEQ ID NO: 13016 - protein, 19 aa, Artificial Sequence
  NLS variant
KRPMEEDGEEKSPSKKKKK

SEQ ID NO: 13017 - protein, 5 aa, Artificial Sequence
  NLS variant
KRPRC

SEQ ID NO: 13018 - protein, 6 aa, Artificial Sequence
  NLS variant
KRPRGR

SEQ ID NO: 13019 - protein, 5 aa, Artificial Sequence
  NLS variant
KRPRI

SEQ ID NO: 13020 - protein, 6 aa, Artificial Sequence
  NLS variant
KRPRKK

SEQ ID NO: 13021 - protein, 9 aa, Artificial Sequence
  NLS variant
KRPRKRGRK

SEQ ID NO: 13022 - protein, 5 aa, Artificial Sequence
  NLS variant
KRPRN

SEQ ID NO: 13023 - protein, 6 aa, Artificial Sequence
  NLS variant
KRPRRR

SEQ ID NO: 13024 - protein, 5 aa, Artificial Sequence
  NLS variant
KRPRY

SEQ ID NO: 13025 - protein, 5 aa, Artificial Sequence
  NLS variant
KRPTR

SEQ ID NO: 13026 - protein, 17 aa, Artificial Sequence
  NLS variant
KRQEMESGITTPPKMRR

SEQ ID NO: 13027 - protein, 5 aa, Artificial Sequence
  NLS variant
KRQHI

SEQ ID NO: 13028 - protein, 6 aa, Artificial Sequence
  NLS variant
KRQQRL

SEQ ID NO: 13029 - protein, 6 aa, Artificial Sequence
  NLS variant
KRQRID

SEQ ID NO: 13030 - protein, 6 aa, Artificial Sequence
  NLS variant
KRQRLM

SEQ ID NO: 13031 - protein, 6 aa, Artificial Sequence
  NLS variant
KRQRLS

SEQ ID NO: 13032 - protein, 7 aa, Artificial Sequence
  NLS variant
KRQRRKQ

SEQ ID NO: 13033 - protein, 17 aa, Artificial Sequence
  NLS variant
KRQRRKQSNRESARRSR

SEQ ID NO: 13034 - protein, 19 aa, Artificial Sequence
  NLS variant
KRQRRSRGRPSGGARRRRR

SEQ ID NO: 13035 - protein, 18 aa, Artificial Sequence
  NLS variant
KRRGFDRFGPDGTGRKRK

SEQ ID NO: 13036 - protein, 6 aa, Artificial Sequence
  NLS variant
KRRGGR

SEQ ID NO: 13037 - protein, 6 aa, Artificial Sequence
  NLS variant
KRRGRG

SEQ ID NO: 13038 - protein, 6 aa, Artificial Sequence
  NLS variant
KRRGRK

SEQ ID NO: 13039 - protein, 6 aa, Artificial Sequence
  NLS variant
KRRGRP

SEQ ID NO: 13040 - protein, 6 aa, Artificial Sequence
  NLS variant
KRRHKK

SEQ ID NO: 13041 - protein, 18 aa, Artificial Sequence
  NLS variant
KRRHRSKVNGLQRGRKKD

SEQ ID NO: 13042 - protein, 6 aa, Artificial Sequence
  NLS variant
KRRIRK

SEQ ID NO: 13043 - protein, 6 aa, Artificial Sequence
  NLS variant
KRRIRR

SEQ ID NO: 13044 - protein, 6 aa, Artificial Sequence
  NLS variant
KRRKDR

SEQ ID NO: 13045 - protein, 6 aa, Artificial Sequence
  NLS variant
KRRKED

SEQ ID NO: 13046 - protein, 6 aa, Artificial Sequence
  NLS variant
KRRKEF

SEQ ID NO: 13047 - protein, 6 aa, Artificial Sequence
  NLS variant
KRRKET

SEQ ID NO: 13048 - protein, 6 aa, Artificial Sequence
  NLS variant
KRRKLE

SEQ ID NO: 13049 - protein, 6 aa, Artificial Sequence
  NLS variant
KRRKLT

SEQ ID NO: 13050 - protein, 6 aa, Artificial Sequence
  NLS variant
KRRKSR

SEQ ID NO: 13051 - protein, 6 aa, Artificial Sequence
  NLS variant
KRRKTK

SEQ ID NO: 13052 - protein, 6 aa, Artificial Sequence
  NLS variant
KRRKVD

SEQ ID NO: 13053 - protein, 6 aa, Artificial Sequence
  NLS variant
KRRKVE

SEQ ID NO: 13054 - protein, 6 aa, Artificial Sequence
  NLS variant
KRRKVI

SEQ ID NO: 13055 - protein, 6 aa, Artificial Sequence
  NLS variant
KRRKVR

SEQ ID NO: 13056 - protein, 6 aa, Artificial Sequence
  NLS variant
KRRKVS

SEQ ID NO: 13057 - protein, 6 aa, Artificial Sequence
  NLS variant
KRRLDD

SEQ ID NO: 13058 - protein, 16 aa, Artificial Sequence
  NLS variant
KRRPGPGPGVPPKRAR

SEQ ID NO: 13059 - protein, 6 aa, Artificial Sequence
  NLS variant
KRRPLP

SEQ ID NO: 13060 - protein, 6 aa, Artificial Sequence
  NLS variant
KRRRAQ

SEQ ID NO: 13061 - protein, 6 aa, Artificial Sequence
  NLS variant
KRRRDE

SEQ ID NO: 13062 - protein, 6 aa, Artificial Sequence
  NLS variant
KRRRGE

SEQ ID NO: 13063 - protein, 7 aa, Artificial Sequence
  NLS variant
KRRRGRP

SEQ ID NO: 13064 - protein, 6 aa, Artificial Sequence
  NLS variant
KRRRHR

SEQ ID NO: 13065 - protein, 6 aa, Artificial Sequence
  NLS variant
KRRRKR

SEQ ID NO: 13066 - protein, 6 aa, Artificial Sequence
  NLS variant
KRRRQK

SEQ ID NO: 13067 - protein, 14 aa, Artificial Sequence
  NLS variant
KRRRQKIRKYTMRR

SEQ ID NO: 13068 - protein, 6 aa, Artificial Sequence
  NLS variant
KRRRRA

SEQ ID NO: 13069 - protein, 7 aa, Artificial Sequence
  NLS variant
KRRRRDE

SEQ ID NO: 13070 - protein, 6 aa, Artificial Sequence
  NLS variant
KRRRRE

SEQ ID NO: 13071 - protein, 6 aa, Artificial Sequence
  NLS variant
KRRRRK

SEQ ID NO: 13072 - protein, 6 aa, Artificial Sequence
  NLS variant
KRRRRP

SEQ ID NO: 13073 - protein, 6 aa, Artificial Sequence
  NLS variant
KRRRRQ

SEQ ID NO: 13074 - protein, 7 aa, Artificial Sequence
  NLS variant
KRRRRRR

SEQ ID NO: 13075 - protein, 13 aa, Artificial Sequence
  NLS variant
KRRRRRRREKRKR

SEQ ID NO: 13076 - protein, 6 aa, Artificial Sequence
  NLS variant
KRRRSE

SEQ ID NO: 13077 - protein, 6 aa, Artificial Sequence
  NLS variant
KRRRTY

SEQ ID NO: 13078 - protein, 6 aa, Artificial Sequence
  NLS variant
KRRRVA

SEQ ID NO: 13079 - protein, 6 aa, Artificial Sequence
  NLS variant
KRRRVD

SEQ ID NO: 13080 - protein, 6 aa, Artificial Sequence
  NLS variant
KRRRVE

SEQ ID NO: 13081 - protein, 6 aa, Artificial Sequence
  NLS variant
KRRRVH

SEQ ID NO: 13082 - protein, 6 aa, Artificial Sequence
  NLS variant
KRRRVK

SEQ ID NO: 13083 - protein, 6 aa, Artificial Sequence
  NLS variant
KRRRVT

SEQ ID NO: 13084 - protein, 15 aa, Artificial Sequence
  NLS variant
KRRRWTNRPMWRKPR

SEQ ID NO: 13085 - protein, 5 aa, Artificial Sequence
  NLS variant
KRRSW

SEQ ID NO: 13086 - protein, 15 aa, Artificial Sequence
  NLS variant
KRRSWTYRPMYRKPR

SEQ ID NO: 13087 - protein, 18 aa, Artificial Sequence
  NLS variant
KRRTDPECTAPIKKQKKR

SEQ ID NO: 13088 - protein, 5 aa, Artificial Sequence
  NLS variant
KRRTY

SEQ ID NO: 13089 - protein, 6 aa, Artificial Sequence
  NLS variant
KRRVVD

SEQ ID NO: 13090 - protein, 19 aa, Artificial Sequence
  NLS variant
KRRVVDEGEEADKAVKKKK

SEQ ID NO: 13091 - protein, 6 aa, Artificial Sequence
  NLS variant
KRSAKR

SEQ ID NO: 13092 - protein, 5 aa, Artificial Sequence
  NLS variant
KRSCR

SEQ ID NO: 13093 - protein, 17 aa, Artificial Sequence
  NLS variant
KRSCRKRLADHNRRRRK

SEQ ID NO: 13094 - protein, 17 aa, Artificial Sequence
  NLS variant
KRSCRRKLERHNNRRKR

SEQ ID NO: 13095 - protein, 17 aa, Artificial Sequence
  NLS variant
KRSCRRRLACHNERRRK

SEQ ID NO: 13096 - protein, 17 aa, Artificial Sequence
  NLS variant
KRSCRRRLAGHNERRRK

SEQ ID NO: 13097 - protein, 17 aa, Artificial Sequence
  NLS variant
KRSCRRRLAGHNRRRRK

SEQ ID NO: 13098 - protein, 19 aa, Artificial Sequence
  NLS variant
KRSESWTLKKPKSVSKKLK

SEQ ID NO: 13099 - protein, 6 aa, Artificial Sequence
  NLS variant
KRSKRS

SEQ ID NO: 13100 - protein, 6 aa, Artificial Sequence
  NLS variant
KRSKSR

SEQ ID NO: 13101 - protein, 18 aa, Artificial Sequence
  NLS variant
KRSNDRTYSPEEEKQRRA

SEQ ID NO: 13102 - protein, 6 aa, Artificial Sequence
  NLS variant
KRSRDD

SEQ ID NO: 13103 - protein, 6 aa, Artificial Sequence
  NLS variant
KRSRKP

SEQ ID NO: 13104 - protein, 6 aa, Artificial Sequence
  NLS variant
KRSRNT

SEQ ID NO: 13105 - protein, 18 aa, Artificial Sequence
  NLS variant
KRSVVSFDKVKEPRKSRD

SEQ ID NO: 13106 - protein, 6 aa, Artificial Sequence
  NLS variant
KRTRKR

SEQ ID NO: 13107 - protein, 16 aa, Artificial Sequence
  NLS variant
KRTSSPHKEESPKKTK

SEQ ID NO: 13108 - protein, 21 aa, Artificial Sequence
  NLS variant
KRTVATNGDASGAHRAKKMSK

SEQ ID NO: 13109 - protein, 6 aa, Artificial Sequence
  NLS variant
KRVKKK

SEQ ID NO: 13110 - protein, 6 aa, Artificial Sequence
  NLS variant
KRVKKS

SEQ ID NO: 13111 - protein, 15 aa, Artificial Sequence
  NLS variant
KRVKPEEEEERDMKK

SEQ ID NO: 13112 - protein, 12 aa, Artificial Sequence
  NLS variant
KRVLQVWFQNAR

SEQ ID NO: 13113 - protein, 17 aa, Artificial Sequence
  NLS variant
KRVLQVWFQNARAKFRR

SEQ ID NO: 13114 - protein, 6 aa, Artificial Sequence
  NLS variant
KRVVRE

SEQ ID NO: 13115 - protein, 20 aa, Artificial Sequence
  NLS variant
KRVYNKGEDEQEHLPKGKKR

SEQ ID NO: 13116 - protein, 5 aa, Artificial Sequence
  NLS variant
KRWKV

SEQ ID NO: 13117 - protein, 6 aa, Artificial Sequence
  NLS variant
KRWQQR

SEQ ID NO: 13118 - protein, 25 aa, Artificial Sequence
  NLS variant
KRWQQRGRKANTRPLKRRRKRGPRI

SEQ ID NO: 13119 - protein, 5 aa, Artificial Sequence
  NLS variant
KRWRV

SEQ ID NO: 13120 - protein, 6 aa, Artificial Sequence
  NLS variant
KSAKKK

SEQ ID NO: 13121 - protein, 5 aa, Artificial Sequence
  NLS variant
KSCRK

SEQ ID NO: 13122 - protein, 6 aa, Artificial Sequence
  NLS variant
KSDKKK

SEQ ID NO: 13123 - protein, 6 aa, Artificial Sequence
  NLS variant
KSDKRK

SEQ ID NO: 13124 - protein, 6 aa, Artificial Sequence
  NLS variant
KSEKRR

SEQ ID NO: 13125 - protein, 18 aa, Artificial Sequence
  NLS variant
KSGKAPRRRAVSMDNSNK

SEQ ID NO: 13126 - protein, 6 aa, Artificial Sequence
  NLS variant
KSKHKK

SEQ ID NO: 13127 - protein, 6 aa, Artificial Sequence
  NLS variant
KSKKHK

SEQ ID NO: 13128 - protein, 7 aa, Artificial Sequence
  NLS variant
KSKKKSK

SEQ ID NO: 13129 - protein, 13 aa, Artificial Sequence
  NLS variant
KSKKKSRKGRPRK

SEQ ID NO: 13130 - protein, 6 aa, Artificial Sequence
  NLS variant
KSKKQK

SEQ ID NO: 13131 - protein, 6 aa, Artificial Sequence
  NLS variant
KSKKSR

SEQ ID NO: 13132 - protein, 6 aa, Artificial Sequence
  NLS variant
KSKRKR

SEQ ID NO: 13133 - protein, 6 aa, Artificial Sequence
  NLS variant
KSKRSR

SEQ ID NO: 13134 - protein, 6 aa, Artificial Sequence
  NLS variant
KSKRVK

SEQ ID NO: 13135 - protein, 6 aa, Artificial Sequence
  NLS variant
KSLKRR

SEQ ID NO: 13136 - protein, 5 aa, Artificial Sequence
  NLS variant
KSNKR

SEQ ID NO: 13137 - protein, 6 aa, Artificial Sequence
  NLS variant
KSPKKK

SEQ ID NO: 13138 - protein, 6 aa, Artificial Sequence
  NLS variant
KSPKQK

SEQ ID NO: 13139 - protein, 6 aa, Artificial Sequence
  NLS variant
KSRKGR

SEQ ID NO: 13140 - protein, 6 aa, Artificial Sequence
  NLS variant
KSRKKD

SEQ ID NO: 13141 - protein, 6 aa, Artificial Sequence
  NLS variant
KSRKRP

SEQ ID NO: 13142 - protein, 6 aa, Artificial Sequence
  NLS variant
KSRLKR

SEQ ID NO: 13143 - protein, 6 aa, Artificial Sequence
  NLS variant
KSRRGS

SEQ ID NO: 13144 - protein, 6 aa, Artificial Sequence
  NLS variant
KSSKKR

SEQ ID NO: 13145 - protein, 6 aa, Artificial Sequence
  NLS variant
KSSVKR

SEQ ID NO: 13146 - protein, 6 aa, Artificial Sequence
  NLS variant
KSTKKT

SEQ ID NO: 13147 - protein, 6 aa, Artificial Sequence
  NLS variant
KTGKRK

SEQ ID NO: 13148 - protein, 6 aa, Artificial Sequence
  NLS variant
KTKKRE

SEQ ID NO: 13149 - protein, 6 aa, Artificial Sequence
  NLS variant
KTKKRK

SEQ ID NO: 13150 - protein, 6 aa, Artificial Sequence
  NLS variant
KTKKRR

SEQ ID NO: 13151 - protein, 6 aa, Artificial Sequence
  NLS variant
KTKKRS

SEQ ID NO: 13152 - protein, 6 aa, Artificial Sequence
  NLS variant
KTKRSR

SEQ ID NO: 13153 - protein, 5 aa, Artificial Sequence
  NLS variant
KTNRK

SEQ ID NO: 13154 - protein, 6 aa, Artificial Sequence
  NLS variant
KTPKKK

SEQ ID NO: 13155 - protein, 5 aa, Artificial Sequence
  NLS variant
KTQKR

SEQ ID NO: 13156 - protein, 6 aa, Artificial Sequence
  NLS variant
KTSKRK

SEQ ID NO: 13157 - protein, 12 aa, Artificial Sequence
  NLS variant
KTSKRKTKISRK

SEQ ID NO: 13158 - protein, 6 aa, Artificial Sequence
  NLS variant
KTTRRR

SEQ ID NO: 13159 - protein, 6 aa, Artificial Sequence
  NLS variant
KVKDEK

SEQ ID NO: 13160 - protein, 6 aa, Artificial Sequence
  NLS variant
KVKDKG

SEQ ID NO: 13161 - protein, 6 aa, Artificial Sequence
  NLS variant
KVKKKR

SEQ ID NO: 13162 - protein, 6 aa, Artificial Sequence
  NLS variant
KVKKRA

SEQ ID NO: 13163 - protein, 9 aa, Artificial Sequence
  NLS variant
KVKTKKSTK

SEQ ID NO: 13164 - protein, 19 aa, Artificial Sequence
  NLS variant
KVNFLDMSLDDIIIYKELE

SEQ ID NO: 13165 - protein, 6 aa, Artificial Sequence
  NLS variant
KVPKKK

SEQ ID NO: 13166 - protein, 15 aa, Artificial Sequence
  NLS variant
KVQHRIAKKTTRRRR

SEQ ID NO: 13167 - protein, 5 aa, Artificial Sequence
  NLS variant
KWKLR

SEQ ID NO: 13168 - protein, 5 aa, Artificial Sequence
  NLS variant
KWKRK

SEQ ID NO: 13169 - protein, 5 aa, Artificial Sequence
  NLS variant
KWLRK

SEQ ID NO: 13170 - protein, 6 aa, Artificial Sequence
  NLS variant
KYGKKK

SEQ ID NO: 13171 - protein, 11 aa, Artificial Sequence
  NLS variant
KYGKKKKIKGG

SEQ ID NO: 13172 - protein, 6 aa, Artificial Sequence
  NLS variant
KYKEAK

SEQ ID NO: 13173 - protein, 6 aa, Artificial Sequence
  NLS variant
KYKEGK

SEQ ID NO: 13174 - protein, 6 aa, Artificial Sequence
  NLS variant
KYKENK

SEQ ID NO: 13175 - protein, 6 aa, Artificial Sequence
  NLS variant
KYKKIK

SEQ ID NO: 13176 - protein, 5 aa, Artificial Sequence
  NLS variant
KYLRH

SEQ ID NO: 13177 - protein, 6 aa, Artificial Sequence
  NLS variant
KYRKNI

SEQ ID NO: 13178 - protein, 10 aa, Artificial Sequence
  NLS variant
KYRKNIWIKR

SEQ ID NO: 13179 - protein, 16 aa, Artificial Sequence
  NLS variant
KYTKNKSNSFSQFVKK

SEQ ID NO: 13180 - protein, 6 aa, Artificial Sequence
  NLS variant
LAKRAR

SEQ ID NO: 13181 - protein, 6 aa, Artificial Sequence
  NLS variant
LARARR

SEQ ID NO: 13182 - protein, 6 aa, Artificial Sequence
  NLS variant
LCKKRL

SEQ ID NO: 13183 - protein, 6 aa, Artificial Sequence
  NLS variant
LCRKKV

SEQ ID NO: 13184 - protein, 6 aa, Artificial Sequence
  NLS variant
LDKEKR

SEQ ID NO: 13185 - protein, 6 aa, Artificial Sequence
  NLS variant
LERKTK

SEQ ID NO: 13186 - protein, 7 aa, Artificial Sequence
  NLS variant
LGLPSEE

SEQ ID NO: 13187 - protein, 40 aa, Artificial Sequence
  NLS variant
LGYKASTSLQDPLDKTGENKGWSGPKPGFPEPTNNTPKGI

SEQ ID NO: 13188 - protein, 5 aa, Artificial Sequence
  NLS variant
LHKRS

SEQ ID NO: 13189 - protein, 5 aa, Artificial Sequence
  NLS variant
LIHKR

SEQ ID NO: 13190 - protein, 5 aa, Artificial Sequence
  NLS variant
LKHKR

SEQ ID NO: 13191 - protein, 6 aa, Artificial Sequence
  NLS variant
LKKGSK

SEQ ID NO: 13192 - protein, 8 aa, Artificial Sequence
  NLS variant
LKKINGLL

SEQ ID NO: 13193 - protein, 7 aa, Artificial Sequence
  NLS variant
LKKKKKG

SEQ ID NO: 13194 - protein, 7 aa, Artificial Sequence
  NLS variant
LKKKKKP

SEQ ID NO: 13195 - protein, 7 aa, Artificial Sequence
  NLS variant
LKKKKKR

SEQ ID NO: 13196 - protein, 6 aa, Artificial Sequence
  NLS variant
LKKKKM

SEQ ID NO: 13197 - protein, 6 aa, Artificial Sequence
  NLS variant
LKKRKK

SEQ ID NO: 13198 - protein, 7 aa, Artificial Sequence
  NLS variant
LKKRKKG

SEQ ID NO: 13199 - protein, 6 aa, Artificial Sequence
  NLS variant
LKKRKP

SEQ ID NO: 13200 - protein, 6 aa, Artificial Sequence
  NLS variant
LKKRLP

SEQ ID NO: 13201 - protein, 6 aa, Artificial Sequence
  NLS variant
LKKSRR

SEQ ID NO: 13202 - protein, 8 aa, Artificial Sequence
  NLS variant
LKKVKEHH

SEQ ID NO: 13203 - protein, 6 aa, Artificial Sequence
  NLS variant
LKNKSK

SEQ ID NO: 13204 - protein, 6 aa, Artificial Sequence
  NLS variant
LKRGGR

SEQ ID NO: 13205 - protein, 6 aa, Artificial Sequence
  NLS variant
LKRKKR

SEQ ID NO: 13206 - protein, 5 aa, Artificial Sequence
  NLS variant
LKRKM

SEQ ID NO: 13207 - protein, 6 aa, Artificial Sequence
  NLS variant
LKRKQV

SEQ ID NO: 13208 - protein, 8 aa, Artificial Sequence
  NLS variant
LKRKQVTA

SEQ ID NO: 13209 - protein, 6 aa, Artificial Sequence
  NLS variant
LKRKRR

SEQ ID NO: 13210 - protein, 6 aa, Artificial Sequence
  NLS variant
LKRKRS

SEQ ID NO: 13211 - protein, 8 aa, Artificial Sequence
  NLS variant
LKRLAYAL

SEQ ID NO: 13212 - protein, 8 aa, Artificial Sequence
  NLS variant
LKRLDAER

SEQ ID NO: 13213 - protein, 6 aa, Artificial Sequence
  NLS variant
LKRQRD

SEQ ID NO: 13214 - protein, 6 aa, Artificial Sequence
  NLS variant
LKRQRK

SEQ ID NO: 13215 - protein, 6 aa, Artificial Sequence
  NLS variant
LKSRRR

SEQ ID NO: 13216 - protein, 6 aa, Artificial Sequence
  NLS variant
LNKKRK

SEQ ID NO: 13217 - protein, 6 aa, Artificial Sequence
  NLS variant
LPKKKR

SEQ ID NO: 13218 - protein, 6 aa, Artificial Sequence
  NLS variant
LPKRRR

SEQ ID NO: 13219 - protein, 15 aa, Artificial Sequence
  NLS variant
LQANGPVAKKAKKKA

SEQ ID NO: 13220 - protein, 6 aa, Artificial Sequence
  NLS variant
LRKAKS

SEQ ID NO: 13221 - protein, 6 aa, Artificial Sequence
  NLS variant
LRKKKP

SEQ ID NO: 13222 - protein, 6 aa, Artificial Sequence
  NLS variant
LRKKRK

SEQ ID NO: 13223 - protein, 9 aa, Artificial Sequence
  NLS variant
LRKKTKSKR

SEQ ID NO: 13224 - protein, 6 aa, Artificial Sequence
  NLS variant
LRKRKR

SEQ ID NO: 13225 - protein, 8 aa, Artificial Sequence
  NLS variant
LRRLAQNR

SEQ ID NO: 13226 - protein, 6 aa, Artificial Sequence
  NLS variant
LRRRKN

SEQ ID NO: 13227 - protein, 8 aa, Artificial Sequence
  NLS variant
LSPSLSPL

SEQ ID NO: 13228 - protein, 6 aa, Artificial Sequence
  NLS variant
LTKRKR

SEQ ID NO: 13229 - protein, 10 aa, Artificial Sequence
  NLS variant
MANKRMKVKH

SEQ ID NO: 13230 - protein, 6 aa, Artificial Sequence
  NLS variant
MARKKR

SEQ ID NO: 13231 - protein, 18 aa, Artificial Sequence
  NLS variant
MASQGTKRSYEQMETDGE

SEQ ID NO: 13232 - protein, 30 aa, Artificial Sequence
  NLS variant
MDSLLMNRRKFLYQFKNVRWAKGRRETYLC

SEQ ID NO: 13233 - protein, 5 aa, Artificial Sequence
  NLS variant
MGKRK

SEQ ID NO: 13234 - protein, 6 aa, Artificial Sequence
  NLS variant
MGRKRK

SEQ ID NO: 13235 - protein, 5 aa, Artificial Sequence
  NLS variant
MHKRI

SEQ ID NO: 13236 - protein, 5 aa, Artificial Sequence
  NLS variant
MKHKK

SEQ ID NO: 13237 - protein, 6 aa, Artificial Sequence
  NLS variant
MKKRKK

SEQ ID NO: 13238 - protein, 5 aa, Artificial Sequence
  NLS variant
MKRAR

SEQ ID NO: 13239 - protein, 8 aa, Artificial Sequence
  NLS variant
MKRMGYNR

SEQ ID NO: 13240 - protein, 5 aa, Artificial Sequence
  NLS variant
MKRNR

SEQ ID NO: 13241 - protein, 6 aa, Artificial Sequence
  NLS variant
MLKKLR

SEQ ID NO: 13242 - protein, 9 aa, Artificial Sequence
  NLS variant
MLRKRRKRL

SEQ ID NO: 13243 - protein, 5 aa, Artificial Sequence
  NLS variant
MPKRK

SEQ ID NO: 13244 - protein, 52 aa, Artificial Sequence
  NLS variant
MPQNEYIELHRKRYGYRLDYHEKKRKKESREAHERSKKAKKMIGLKAKLYHK

SEQ ID NO: 13245 - protein, 8 aa, Artificial Sequence
  NLS variant
MQDPAAQS

SEQ ID NO: 13246 - protein, 5 aa, Artificial Sequence
  NLS variant
MRHKR

SEQ ID NO: 13247 - protein, 13 aa, Artificial Sequence
  NLS variant
MRHKRSAKRTKRA

SEQ ID NO: 13248 - protein, 16 aa, Artificial Sequence
  NLS variant
MRKELEEFVSKKRRRR

SEQ ID NO: 13249 - protein, 6 aa, Artificial Sequence
  NLS variant
MRKKRR

SEQ ID NO: 13250 - protein, 5 aa, Artificial Sequence
  NLS variant
MRKPR

SEQ ID NO: 13251 - protein, 5 aa, Artificial Sequence
  NLS variant
MRKRD

SEQ ID NO: 13252 - protein, 6 aa, Artificial Sequence
  NLS variant
MRKRKR

SEQ ID NO: 13253 - protein, 8 aa, Artificial Sequence
  NLS variant
MRRVESLE

SEQ ID NO: 13254 - protein, 5 aa, Artificial Sequence
  NLS variant
MTKRK

SEQ ID NO: 13255 - protein, 10 aa, Artificial Sequence
  NLS variant
MVQLRPRASR

SEQ ID NO: 13256 - protein, 6 aa, Artificial Sequence
  NLS variant
NARAKR

SEQ ID NO: 13257 - protein, 6 aa, Artificial Sequence
  NLS variant
NCRKRK

SEQ ID NO: 13258 - protein, 6 aa, Artificial Sequence
  NLS variant
NEKKRQ

SEQ ID NO: 13259 - protein, 6 aa, Artificial Sequence
  NLS variant
NERKRK

SEQ ID NO: 13260 - protein, 6 aa, Artificial Sequence
  NLS variant
NKEKRK

SEQ ID NO: 13261 - protein, 6 aa, Artificial Sequence
  NLS variant
NKGKRK

SEQ ID NO: 13262 - protein, 6 aa, Artificial Sequence
  NLS variant
NKGSKR

SEQ ID NO: 13263 - protein, 6 aa, Artificial Sequence
  NLS variant
NKKKKT

SEQ ID NO: 13264 - protein, 8 aa, Artificial Sequence
  NLS variant
NKKKKTRM

SEQ ID NO: 13265 - protein, 6 aa, Artificial Sequence
  NLS variant
NKKKRK

SEQ ID NO: 13266 - protein, 5 aa, Artificial Sequence
  NLS variant
NKKRH

SEQ ID NO: 13267 - protein, 6 aa, Artificial Sequence
  NLS variant
NKKRKK

SEQ ID NO: 13268 - protein, 6 aa, Artificial Sequence
  NLS variant
NKLKRK

SEQ ID NO: 13269 - protein, 6 aa, Artificial Sequence
  NLS variant
NKPKRK

SEQ ID NO: 13270 - protein, 6 aa, Artificial Sequence
  NLS variant
NKRKKD

SEQ ID NO: 13271 - protein, 6 aa, Artificial Sequence
  NLS variant
NKRKRK

SEQ ID NO: 13272 - protein, 6 aa, Artificial Sequence
  NLS variant
NKRKRQ

SEQ ID NO: 13273 - protein, 36 aa, Artificial Sequence
  NLS variant
NKRKRQKQTSDSDSSTDNNRGNECSQKFRKSKKKKR

SEQ ID NO: 13274 - protein, 6 aa, Artificial Sequence
  NLS variant
NKRKRR

SEQ ID NO: 13275 - protein, 6 aa, Artificial Sequence
  NLS variant
NKRKRS

SEQ ID NO: 13276 - protein, 6 aa, Artificial Sequence
  NLS variant
NKRKRT

SEQ ID NO: 13277 - protein, 6 aa, Artificial Sequence
  NLS variant
NKRKRV

SEQ ID NO: 13278 - protein, 5 aa, Artificial Sequence
  NLS variant
NKRPK

SEQ ID NO: 13279 - protein, 6 aa, Artificial Sequence
  NLS variant
NKRPRK

SEQ ID NO: 13280 - protein, 6 aa, Artificial Sequence
  NLS variant
NKRRRK

SEQ ID NO: 13281 - protein, 6 aa, Artificial Sequence
  NLS variant
NKSEKK

SEQ ID NO: 13282 - protein, 6 aa, Artificial Sequence
  NLS variant
NKSEKR

SEQ ID NO: 13283 - protein, 6 aa, Artificial Sequence
  NLS variant
NLKRKH

SEQ ID NO: 13284 - protein, 6 aa, Artificial Sequence
  NLS variant
NNKKRN

SEQ ID NO: 13285 - protein, 24 aa, Artificial Sequence
  NLS variant
NNKLLAKRRKGGASPKDDPMDDIK

SEQ ID NO: 13286 - protein, 6 aa, Artificial Sequence
  NLS variant
NNRKRK

SEQ ID NO: 13287 - protein, 6 aa, Artificial Sequence
  NLS variant
NPKKKK

SEQ ID NO: 13288 - protein, 6 aa, Artificial Sequence
  NLS variant
NREARR

SEQ ID NO: 13289 - protein, 7 aa, Artificial Sequence
  NLS variant
NRESARR

SEQ ID NO: 13290 - protein, 5 aa, Artificial Sequence
  NLS variant
NRGKK

SEQ ID NO: 13291 - protein, 6 aa, Artificial Sequence
  NLS variant
NRGKSK

SEQ ID NO: 13292 - protein, 8 aa, Artificial Sequence
  NLS variant
NRKGFVSS

SEQ ID NO: 13293 - protein, 6 aa, Artificial Sequence
  NLS variant
NRKRKR

SEQ ID NO: 13294 - protein, 8 aa, Artificial Sequence
  NLS variant
NRKRLKPG

SEQ ID NO: 13295 - protein, 6 aa, Artificial Sequence
  NLS variant
NRKRRR

SEQ ID NO: 13296 - protein, 6 aa, Artificial Sequence
  NLS variant
NRKRSR

SEQ ID NO: 13297 - protein, 8 aa, Artificial Sequence
  NLS variant
NRKTTMLE

SEQ ID NO: 13298 - protein, 6 aa, Artificial Sequence
  NLS variant
NRRKRK

SEQ ID NO: 13299 - protein, 8 aa, Artificial Sequence
  NLS variant
NRRQNNQV

SEQ ID NO: 13300 - protein, 5 aa, Artificial Sequence
  NLS variant
NYKRH

SEQ ID NO: 13301 - protein, 20 aa, Artificial Sequence
  NLS variant
NYKRHMDGMYGPPAKRHEGD

SEQ ID NO: 13302 - protein, 20 aa, Artificial Sequence
  NLS variant
NYKRPMDGTYGPPAKRHEGE

SEQ ID NO: 13303 - protein, 6 aa, Artificial Sequence
  NLS variant
PAKKAK

SEQ ID NO: 13304 - protein, 6 aa, Artificial Sequence
  NLS variant
PAKKAR

SEQ ID NO: 13305 - protein, 6 aa, Artificial Sequence
  NLS variant
PAKKLR

SEQ ID NO: 13306 - protein, 6 aa, Artificial Sequence
  NLS variant
PAKKRG

SEQ ID NO: 13307 - protein, 6 aa, Artificial Sequence
  NLS variant
PAKKRK

SEQ ID NO: 13308 - protein, 6 aa, Artificial Sequence
  NLS variant
PAKKRP

SEQ ID NO: 13309 - protein, 7 aa, Artificial Sequence
  NLS variant
PAKKRPR

SEQ ID NO: 13310 - protein, 6 aa, Artificial Sequence
  NLS variant
PAKKTR

SEQ ID NO: 13311 - protein, 6 aa, Artificial Sequence
  NLS variant
PAKRGR

SEQ ID NO: 13312 - protein, 6 aa, Artificial Sequence
  NLS variant
PAKRRK

SEQ ID NO: 13313 - protein, 6 aa, Artificial Sequence
  NLS variant
PAKRTR

SEQ ID NO: 13314 - protein, 9 aa, Artificial Sequence
  NLS variant
PAPKKLKTS

SEQ ID NO: 13315 - protein, 9 aa, Artificial Sequence
  NLS variant
PAPKKMKTS

SEQ ID NO: 13316 - protein, 5 aa, Artificial Sequence
  NLS variant
PCKKR

SEQ ID NO: 13317 - protein, 7 aa, Artificial Sequence
  NLS variant
PCKKSRK

SEQ ID NO: 13318 - protein, 7 aa, Artificial Sequence
  NLS variant
PDKKRKE

SEQ ID NO: 13319 - protein, 19 aa, Artificial Sequence
  NLS variant
PDTKRAKLDSSETTMVKKK

SEQ ID NO: 13320 - protein, 7 aa, Artificial Sequence
  NLS variant
PEKKKGR

SEQ ID NO: 13321 - protein, 7 aa, Artificial Sequence
  NLS variant
PEKRTKI

SEQ ID NO: 13322 - protein, 6 aa, Artificial Sequence
  NLS variant
PEQKRK

SEQ ID NO: 13323 - protein, 8 aa, Artificial Sequence
  NLS variant
PGGRGKKK

SEQ ID NO: 13324 - protein, 18 aa, Artificial Sequence
  NLS variant
PGKMDKGEHRQERRDRPY

SEQ ID NO: 13325 - protein, 6 aa, Artificial Sequence
  NLS variant
PGKRKR

SEQ ID NO: 13326 - protein, 6 aa, Artificial Sequence
  NLS variant
PGKRSR

SEQ ID NO: 13327 - protein, 11 aa, Artificial Sequence
  NLS variant
PGLTKRVKKSK

SEQ ID NO: 13328 - protein, 25 aa, Artificial Sequence
  NLS variant
PGPLRRREAAAEARKSHSPVKRPRK

SEQ ID NO: 13329 - protein, 6 aa, Artificial Sequence
  NLS variant
PGPRRR

SEQ ID NO: 13330 - protein, 7 aa, Artificial Sequence
  NLS variant
PGRKRKR

SEQ ID NO: 13331 - protein, 7 aa, Artificial Sequence
  NLS variant
PGRKRKW

SEQ ID NO: 13332 - protein, 6 aa, Artificial Sequence
  NLS variant
PGRRGR

SEQ ID NO: 13333 - protein, 6 aa, Artificial Sequence
  NLS variant
PGSKRR

SEQ ID NO: 13334 - protein, 5 aa, Artificial Sequence
  NLS variant
PHKRI

SEQ ID NO: 13335 - protein, 5 aa, Artificial Sequence
  NLS variant
PHKRR

SEQ ID NO: 13336 - protein, 9 aa, Artificial Sequence
  NLS variant
PIKKKRPPV

SEQ ID NO: 13337 - protein, 6 aa, Artificial Sequence
  NLS variant
PIKKQK

SEQ ID NO: 13338 - protein, 6 aa, Artificial Sequence
  NLS variant
PKARPS

SEQ ID NO: 13339 - protein, 10 aa, Artificial Sequence
  NLS variant
PKCKCYKKIK

SEQ ID NO: 13340 - protein, 6 aa, Artificial Sequence
  NLS variant
PKGKKR

SEQ ID NO: 13341 - protein, 6 aa, Artificial Sequence
  NLS variant
PKGKRK

SEQ ID NO: 13342 - protein, 6 aa, Artificial Sequence
  NLS variant
PKGRGR

SEQ ID NO: 13343 - protein, 6 aa, Artificial Sequence
  NLS variant
PKGRKK

SEQ ID NO: 13344 - protein, 7 aa, Artificial Sequence
  NLS variant
PKGRQRK

SEQ ID NO: 13345 - protein, 8 aa, Artificial Sequence
  NLS variant
PKKACDRK

SEQ ID NO: 13346 - protein, 7 aa, Artificial Sequence
  NLS variant
PKKAKAP

SEQ ID NO: 13347 - protein, 6 aa, Artificial Sequence
  NLS variant
PKKAKP

SEQ ID NO: 13348 - protein, 6 aa, Artificial Sequence
  NLS variant
PKKAKS

SEQ ID NO: 13349 - protein, 17 aa, Artificial Sequence
  NLS variant
PKKAKSRLITSGCKVKK

SEQ ID NO: 13350 - protein, 6 aa, Artificial Sequence
  NLS variant
PKKAKV

SEQ ID NO: 13351 - protein, 6 aa, Artificial Sequence
  NLS variant
PKKDRI

SEQ ID NO: 13352 - protein, 7 aa, Artificial Sequence
  NLS variant
PKKFRFQ

SEQ ID NO: 13353 - protein, 11 aa, Artificial Sequence
  NLS variant
PKKGDKYDKTD

SEQ ID NO: 13354 - protein, 6 aa, Artificial Sequence
  NLS variant
PKKGRK

SEQ ID NO: 13355 - protein, 6 aa, Artificial Sequence
  NLS variant
PKKKAK

SEQ ID NO: 13356 - protein, 6 aa, Artificial Sequence
  NLS variant
PKKKKN

SEQ ID NO: 13357 - protein, 8 aa, Artificial Sequence
  NLS variant
PKKKRHKV

SEQ ID NO: 13358 - protein, 6 aa, Artificial Sequence
  NLS variant
PKKKRK

SEQ ID NO: 13359 - protein, 14 aa, Artificial Sequence
  NLS variant
PKKKRKKRSSKANK

SEQ ID NO: 13360 - protein, 7 aa, Artificial Sequence
  NLS variant
PKKKRLR

SEQ ID NO: 13361 - protein, 6 aa, Artificial Sequence
  NLS variant
PKKKRS

SEQ ID NO: 13362 - protein, 7 aa, Artificial Sequence
  NLS variant
PKKKSRK

SEQ ID NO: 13363 - protein, 6 aa, Artificial Sequence
  NLS variant
PKKKTK

SEQ ID NO: 13364 - protein, 6 aa, Artificial Sequence
  NLS variant
PKKKTR

SEQ ID NO: 13365 - protein, 7 aa, Artificial Sequence
  NLS variant
PKKNKPE

SEQ ID NO: 13366 - protein, 6 aa, Artificial Sequence
  NLS variant
PKKPKP

SEQ ID NO: 13367 - protein, 7 aa, Artificial Sequence
  NLS variant
PKKRAKV

SEQ ID NO: 13368 - protein, 6 aa, Artificial Sequence
  NLS variant
PKKRGP

SEQ ID NO: 13369 - protein, 6 aa, Artificial Sequence
  NLS variant
PKKRGR

SEQ ID NO: 13370 - protein, 5 aa, Artificial Sequence
  NLS variant
PKKRH

SEQ ID NO: 13371 - protein, 6 aa, Artificial Sequence
  NLS variant
PKKRKA

SEQ ID NO: 13372 - protein, 7 aa, Artificial Sequence
  NLS variant
PKKRKAP

SEQ ID NO: 13373 - protein, 7 aa, Artificial Sequence
  NLS variant
PKKRKGR

SEQ ID NO: 13374 - protein, 6 aa, Artificial Sequence
  NLS variant
PKKRKR

SEQ ID NO: 13375 - protein, 6 aa, Artificial Sequence
  NLS variant
PKKRKT

SEQ ID NO: 13376 - protein, 6 aa, Artificial Sequence
  NLS variant
PKKRRK

SEQ ID NO: 13377 - protein, 7 aa, Artificial Sequence
  NLS variant
PKKRRKT

SEQ ID NO: 13378 - protein, 6 aa, Artificial Sequence
  NLS variant
PKKRRT

SEQ ID NO: 13379 - protein, 6 aa, Artificial Sequence
  NLS variant
PKKRTR

SEQ ID NO: 13380 - protein, 6 aa, Artificial Sequence
  NLS variant
PKKSGK

SEQ ID NO: 13381 - protein, 6 aa, Artificial Sequence
  NLS variant
PKKSKK

SEQ ID NO: 13382 - protein, 6 aa, Artificial Sequence
  NLS variant
PKKSVK

SEQ ID NO: 13383 - protein, 7 aa, Artificial Sequence
  NLS variant
PKKTQRR

SEQ ID NO: 13384 - protein, 6 aa, Artificial Sequence
  NLS variant
PKKVKR

SEQ ID NO: 13385 - protein, 6 aa, Artificial Sequence
  NLS variant
PKLFKK

SEQ ID NO: 13386 - protein, 9 aa, Artificial Sequence
  NLS variant
PKPKKLKVE

SEQ ID NO: 13387 - protein, 6 aa, Artificial Sequence
  NLS variant
PKPRGR

SEQ ID NO: 13388 - protein, 6 aa, Artificial Sequence
  NLS variant
PKQAHR

SEQ ID NO: 13389 - protein, 6 aa, Artificial Sequence
  NLS variant
PKQKPK

SEQ ID NO: 13390 - protein, 6 aa, Artificial Sequence
  NLS variant
PKQKRH

SEQ ID NO: 13391 - protein, 6 aa, Artificial Sequence
  NLS variant
PKQKRK

SEQ ID NO: 13392 - protein, 6 aa, Artificial Sequence
  NLS variant
PKQKRR

SEQ ID NO: 13393 - protein, 7 aa, Artificial Sequence
  NLS variant
PKRGRGR

SEQ ID NO: 13394 - protein, 6 aa, Artificial Sequence
  NLS variant
PKRGRP

SEQ ID NO: 13395 - protein, 6 aa, Artificial Sequence
  NLS variant
PKRKKD

SEQ ID NO: 13396 - protein, 6 aa, Artificial Sequence
  NLS variant
PKRKLE

SEQ ID NO: 13397 - protein, 6 aa, Artificial Sequence
  NLS variant
PKRKPR

SEQ ID NO: 13398 - protein, 6 aa, Artificial Sequence
  NLS variant
PKRKRG

SEQ ID NO: 13399 - protein, 8 aa, Artificial Sequence
  NLS variant
PKRKRKRV

SEQ ID NO: 13400 - protein, 7 aa, Artificial Sequence
  NLS variant
PKRKRRK

SEQ ID NO: 13401 - protein, 20 aa, Artificial Sequence
  NLS variant
PKRKRRKKRGHGWSRMRMRR

SEQ ID NO: 13402 - protein, 6 aa, Artificial Sequence
  NLS variant
PKRNKD

SEQ ID NO: 13403 - protein, 6 aa, Artificial Sequence
  NLS variant
PKRQRL

SEQ ID NO: 13404 - protein, 8 aa, Artificial Sequence
  NLS variant
PKRQRQRQ

SEQ ID NO: 13405 - protein, 6 aa, Artificial Sequence
  NLS variant
PKRRKT

SEQ ID NO: 13406 - protein, 9 aa, Artificial Sequence
  NLS variant
PKRRLVDDA

SEQ ID NO: 13407 - protein, 6 aa, Artificial Sequence
  NLS variant
PKRRRH

SEQ ID NO: 13408 - protein, 24 aa, Artificial Sequence
  NLS variant
PKRRRHRQDALPGPCIASTPKKHR

SEQ ID NO: 13409 - protein, 6 aa, Artificial Sequence
  NLS variant
PKRRRK

SEQ ID NO: 13410 - protein, 6 aa, Artificial Sequence
  NLS variant
PKRRRQ

SEQ ID NO: 13411 - protein, 7 aa, Artificial Sequence
  NLS variant
PKRRRTY

SEQ ID NO: 13412 - protein, 6 aa, Artificial Sequence
  NLS variant
PKRRRY

SEQ ID NO: 13413 - protein, 8 aa, Artificial Sequence
  NLS variant
PKRTNVPG

SEQ ID NO: 13414 - protein, 5 aa, Artificial Sequence
  NLS variant
PKRVR

SEQ ID NO: 13415 - protein, 6 aa, Artificial Sequence
  NLS variant
PKTKKK

SEQ ID NO: 13416 - protein, 6 aa, Artificial Sequence
  NLS variant
PKTPKK

SEQ ID NO: 13417 - protein, 6 aa, Artificial Sequence
  NLS variant
PLAKRR

SEQ ID NO: 13418 - protein, 6 aa, Artificial Sequence
  NLS variant
PLFKRR

SEQ ID NO: 13419 - protein, 6 aa, Artificial Sequence
  NLS variant
PLGRRR

SEQ ID NO: 13420 - protein, 7 aa, Artificial Sequence
  NLS variant
PLGRRRV

SEQ ID NO: 13421 - protein, 6 aa, Artificial Sequence
  NLS variant
PLKKRR

SEQ ID NO: 13422 - protein, 6 aa, Artificial Sequence
  NLS variant
PLKRPR

SEQ ID NO: 13423 - protein, 6 aa, Artificial Sequence
  NLS variant
PLKRRK

SEQ ID NO: 13424 - protein, 6 aa, Artificial Sequence
  NLS variant
PLKRRR

SEQ ID NO: 13425 - protein, 6 aa, Artificial Sequence
  NLS variant
PLLKKR

SEQ ID NO: 13426 - protein, 7 aa, Artificial Sequence
  NLS variant
PLRKAKR

SEQ ID NO: 13427 - protein, 6 aa, Artificial Sequence
  NLS variant
PLRKRP

SEQ ID NO: 13428 - protein, 8 aa, Artificial Sequence
  NLS variant
PLRKRPRR

SEQ ID NO: 13429 - protein, 6 aa, Artificial Sequence
  NLS variant
PLVKRR

SEQ ID NO: 13430 - protein, 6 aa, Artificial Sequence
  NLS variant
PNAKKR

SEQ ID NO: 13431 - protein, 7 aa, Artificial Sequence
  NLS variant
PNQKNRT

SEQ ID NO: 13432 - protein, 6 aa, Artificial Sequence
  NLS variant
PPAKRH

SEQ ID NO: 13433 - protein, 9 aa, Artificial Sequence
  NLS variant
PPAKRKCIF

SEQ ID NO: 13434 - protein, 6 aa, Artificial Sequence
  NLS variant
PPAKRR

SEQ ID NO: 13435 - protein, 8 aa, Artificial Sequence
  NLS variant
PPARRRRL

SEQ ID NO: 13436 - protein, 10 aa, Artificial Sequence
  NLS variant
PPASRKSRRK

SEQ ID NO: 13437 - protein, 7 aa, Artificial Sequence
  NLS variant
PPGKKMR

SEQ ID NO: 13438 - protein, 6 aa, Artificial Sequence
  NLS variant
PPGKKR

SEQ ID NO: 13439 - protein, 6 aa, Artificial Sequence
  NLS variant
PPKKKM

SEQ ID NO: 13440 - protein, 6 aa, Artificial Sequence
  NLS variant
PPKKKR

SEQ ID NO: 13441 - protein, 8 aa, Artificial Sequence
  NLS variant
PPKKKRKV

SEQ ID NO: 13442 - protein, 8 aa, Artificial Sequence
  NLS variant
PPKKKRRV

SEQ ID NO: 13443 - protein, 6 aa, Artificial Sequence
  NLS variant
PPKKMK

SEQ ID NO: 13444 - protein, 6 aa, Artificial Sequence
  NLS variant
PPKKTR

SEQ ID NO: 13445 - protein, 6 aa, Artificial Sequence
  NLS variant
PPKKVK

SEQ ID NO: 13446 - protein, 6 aa, Artificial Sequence
  NLS variant
PPKRGR

SEQ ID NO: 13447 - protein, 8 aa, Artificial Sequence
  NLS variant
PPKRKKRK

SEQ ID NO: 13448 - protein, 6 aa, Artificial Sequence
  NLS variant
PPKRPR

SEQ ID NO: 13449 - protein, 6 aa, Artificial Sequence
  NLS variant
PPKRRT

SEQ ID NO: 13450 - protein, 10 aa, Artificial Sequence
  NLS variant
PPNKRMKVKH

SEQ ID NO: 13451 - protein, 10 aa, Artificial Sequence
  NLS variant
PPPKDKKKKD

SEQ ID NO: 13452 - protein, 7 aa, Artificial Sequence
  NLS variant
PPRGRGR

SEQ ID NO: 13453 - protein, 13 aa, Artificial Sequence
  NLS variant
PPRIYPQLPSAPT

SEQ ID NO: 13454 - protein, 6 aa, Artificial Sequence
  NLS variant
PPRRGR

SEQ ID NO: 13455 - protein, 6 aa, Artificial Sequence
  NLS variant
PPRRRR

SEQ ID NO: 13456 - protein, 8 aa, Artificial Sequence
  NLS variant
PPSKRPKA

SEQ ID NO: 13457 - protein, 8 aa, Artificial Sequence
  NLS variant
PPTKRPKS

SEQ ID NO: 13458 - protein, 6 aa, Artificial Sequence
  NLS variant
PQKKVK

SEQ ID NO: 13459 - protein, 13 aa, Artificial Sequence
  NLS variant
PQRSPFPKSSVKR

SEQ ID NO: 13460 - protein, 6 aa, Artificial Sequence
  NLS variant
PRARRE

SEQ ID NO: 13461 - protein, 6 aa, Artificial Sequence
  NLS variant
PRARRG

SEQ ID NO: 13462 - protein, 6 aa, Artificial Sequence
  NLS variant
PRARRT

SEQ ID NO: 13463 - protein, 6 aa, Artificial Sequence
  NLS variant
PRGPRK

SEQ ID NO: 13464 - protein, 6 aa, Artificial Sequence
  NLS variant
PRGRKP

SEQ ID NO: 13465 - protein, 6 aa, Artificial Sequence
  NLS variant
PRGRPK

SEQ ID NO: 13466 - protein, 6 aa, Artificial Sequence
  NLS variant
PRKAKR

SEQ ID NO: 13467 - protein, 5 aa, Artificial Sequence
  NLS variant
PRKGK

SEQ ID NO: 13468 - protein, 6 aa, Artificial Sequence
  NLS variant
PRKGRK

SEQ ID NO: 13469 - protein, 5 aa, Artificial Sequence
  NLS variant
PRKKD

SEQ ID NO: 13470 - protein, 7 aa, Artificial Sequence
  NLS variant
PRKKRGR

SEQ ID NO: 13471 - protein, 6 aa, Artificial Sequence
  NLS variant
PRKKRP

SEQ ID NO: 13472 - protein, 6 aa, Artificial Sequence
  NLS variant
PRKLRR

SEQ ID NO: 13473 - protein, 6 aa, Artificial Sequence
  NLS variant
PRKRGR

SEQ ID NO: 13474 - protein, 6 aa, Artificial Sequence
  NLS variant
PRKRKG

SEQ ID NO: 13475 - protein, 6 aa, Artificial Sequence
  NLS variant
PRKRKS

SEQ ID NO: 13476 - protein, 6 aa, Artificial Sequence
  NLS variant
PRKRLK

SEQ ID NO: 13477 - protein, 6 aa, Artificial Sequence
  NLS variant
PRKRPG

SEQ ID NO: 13478 - protein, 6 aa, Artificial Sequence
  NLS variant
PRKRQR

SEQ ID NO: 13479 - protein, 6 aa, Artificial Sequence
  NLS variant
PRKRRR

SEQ ID NO: 13480 - protein, 6 aa, Artificial Sequence
  NLS variant
PRKRSR

SEQ ID NO: 13481 - protein, 8 aa, Artificial Sequence
  NLS variant
PRKSENET

SEQ ID NO: 13482 - protein, 6 aa, Artificial Sequence
  NLS variant
PRPRKV

SEQ ID NO: 13483 - protein, 8 aa, Artificial Sequence
  NLS variant
PRPRKVPR

SEQ ID NO: 13484 - protein, 6 aa, Artificial Sequence
  NLS variant
PRPTKR

SEQ ID NO: 13485 - protein, 8 aa, Artificial Sequence
  NLS variant
PRRGKSPA

SEQ ID NO: 13486 - protein, 6 aa, Artificial Sequence
  NLS variant
PRRGPK

SEQ ID NO: 13487 - protein, 6 aa, Artificial Sequence
  NLS variant
PRRGQK

SEQ ID NO: 13488 - protein, 8 aa, Artificial Sequence
  NLS variant
PRRIPRKI

SEQ ID NO: 13489 - protein, 6 aa, Artificial Sequence
  NLS variant
PRRKRL

SEQ ID NO: 13490 - protein, 6 aa, Artificial Sequence
  NLS variant
PRRKRR

SEQ ID NO: 13491 - protein, 8 aa, Artificial Sequence
  NLS variant
PRRLRSPP

SEQ ID NO: 13492 - protein, 7 aa, Artificial Sequence
  NLS variant
PRRQRSG

SEQ ID NO: 13493 - protein, 6 aa, Artificial Sequence
  NLS variant
PRRRAG

SEQ ID NO: 13494 - protein, 6 aa, Artificial Sequence
  NLS variant
PRRRGR

SEQ ID NO: 13495 - protein, 7 aa, Artificial Sequence
  NLS variant
PRRRRSP

SEQ ID NO: 13496 - protein, 7 aa, Artificial Sequence
  NLS variant
PRRRSPS

SEQ ID NO: 13497 - protein, 6 aa, Artificial Sequence
  NLS variant
PRRRVQ

SEQ ID NO: 13498 - protein, 9 aa, Artificial Sequence
  NLS variant
PRRRVQRKR

SEQ ID NO: 13499 - protein, 6 aa, Artificial Sequence
  NLS variant
PRRSRP

SEQ ID NO: 13500 - protein, 7 aa, Artificial Sequence
  NLS variant
PRRSRSP

SEQ ID NO: 13501 - protein, 6 aa, Artificial Sequence
  NLS variant
PRRVPK

SEQ ID NO: 13502 - protein, 7 aa, Artificial Sequence
  NLS variant
PRRVRLK

SEQ ID NO: 13503 - protein, 8 aa, Artificial Sequence
  NLS variant
PRRYRSPP

SEQ ID NO: 13504 - protein, 6 aa, Artificial Sequence
  NLS variant
PRVRRT

SEQ ID NO: 13505 - protein, 7 aa, Artificial Sequence
  NLS variant
PSAKRPK

SEQ ID NO: 13506 - protein, 7 aa, Artificial Sequence
  NLS variant
PSKKKKK

SEQ ID NO: 13507 - protein, 6 aa, Artificial Sequence
  NLS variant
PSKKRA

SEQ ID NO: 13508 - protein, 6 aa, Artificial Sequence
  NLS variant
PSKKRK

SEQ ID NO: 13509 - protein, 6 aa, Artificial Sequence
  NLS variant
PSKRAR

SEQ ID NO: 13510 - protein, 6 aa, Artificial Sequence
  NLS variant
PSKRKR

SEQ ID NO: 13511 - protein, 6 aa, Artificial Sequence
  NLS variant
PSKSKR

SEQ ID NO: 13512 - protein, 6 aa, Artificial Sequence
  NLS variant
PSPKRR

SEQ ID NO: 13513 - protein, 7 aa, Artificial Sequence
  NLS variant
PSPRRRR

SEQ ID NO: 13514 - protein, 6 aa, Artificial Sequence
  NLS variant
PSRKRA

SEQ ID NO: 13515 - protein, 7 aa, Artificial Sequence
  NLS variant
PSRKRPR

SEQ ID NO: 13516 - protein, 6 aa, Artificial Sequence
  NLS variant
PSSKKK

SEQ ID NO: 13517 - protein, 6 aa, Artificial Sequence
  NLS variant
PSSKKR

SEQ ID NO: 13518 - protein, 8 aa, Artificial Sequence
  NLS variant
PSSKKRKV

SEQ ID NO: 13519 - protein, 6 aa, Artificial Sequence
  NLS variant
PSTKKR

SEQ ID NO: 13520 - protein, 7 aa, Artificial Sequence
  NLS variant
PSTKKRE

SEQ ID NO: 13521 - protein, 6 aa, Artificial Sequence
  NLS variant
PTKKKK

SEQ ID NO: 13522 - protein, 6 aa, Artificial Sequence
  NLS variant
PTKKRR

SEQ ID NO: 13523 - protein, 7 aa, Artificial Sequence
  NLS variant
PTKKRVK

SEQ ID NO: 13524 - protein, 6 aa, Artificial Sequence
  NLS variant
PTKRRK

SEQ ID NO: 13525 - protein, 7 aa, Artificial Sequence
  NLS variant
PTRGRGR

SEQ ID NO: 13526 - protein, 6 aa, Artificial Sequence
  NLS variant
PTRGRR

SEQ ID NO: 13527 - protein, 6 aa, Artificial Sequence
  NLS variant
PVAKKK

SEQ ID NO: 13528 - protein, 6 aa, Artificial Sequence
  NLS variant
PVKKAK

SEQ ID NO: 13529 - protein, 7 aa, Artificial Sequence
  NLS variant
PVKKKKK

SEQ ID NO: 13530 - protein, 6 aa, Artificial Sequence
  NLS variant
PVKKPK

SEQ ID NO: 13531 - protein, 21 aa, Artificial Sequence
  NLS variant
PVKKRQQGRQPKVPKPKKPKK

SEQ ID NO: 13532 - protein, 7 aa, Artificial Sequence
  NLS variant
PVKKSIR

SEQ ID NO: 13533 - protein, 6 aa, Artificial Sequence
  NLS variant
PVKRRK

SEQ ID NO: 13534 - protein, 7 aa, Artificial Sequence
  NLS variant
PVKRRRM

SEQ ID NO: 13535 - protein, 6 aa, Artificial Sequence
  NLS variant
PVPRKK

SEQ ID NO: 13536 - protein, 6 aa, Artificial Sequence
  NLS variant
PVRRRR

SEQ ID NO: 13537 - protein, 7 aa, Artificial Sequence
  NLS variant
PYFRKRM

SEQ ID NO: 13538 - protein, 6 aa, Artificial Sequence
  NLS variant
QAKKKK

SEQ ID NO: 13539 - protein, 6 aa, Artificial Sequence
  NLS variant
QAKKTR

SEQ ID NO: 13540 - protein, 6 aa, Artificial Sequence
  NLS variant
QEKKKG

SEQ ID NO: 13541 - protein, 5 aa, Artificial Sequence
  NLS variant
QGRKK

SEQ ID NO: 13542 - protein, 5 aa, Artificial Sequence
  NLS variant
QHKRR

SEQ ID NO: 13543 - protein, 5 aa, Artificial Sequence
  NLS variant
QIRKH

SEQ ID NO: 13544 - protein, 5 aa, Artificial Sequence
  NLS variant
QIRRH

SEQ ID NO: 13545 - protein, 7 aa, Artificial Sequence
  NLS variant
QKGGRKK

SEQ ID NO: 13546 - protein, 6 aa, Artificial Sequence
  NLS variant
QKHKRK

SEQ ID NO: 13547 - protein, 5 aa, Artificial Sequence
  NLS variant
QKKGR

SEQ ID NO: 13548 - protein, 7 aa, Artificial Sequence
  NLS variant
QKKKKKA

SEQ ID NO: 13549 - protein, 6 aa, Artificial Sequence
  NLS variant
QKKKKR

SEQ ID NO: 13550 - protein, 6 aa, Artificial Sequence
  NLS variant
QKKKKT

SEQ ID NO: 13551 - protein, 8 aa, Artificial Sequence
  NLS variant
QKKKNKKK

SEQ ID NO: 13552 - protein, 8 aa, Artificial Sequence
  NLS variant
QKKLPKVK

SEQ ID NO: 13553 - protein, 6 aa, Artificial Sequence
  NLS variant
QKKPKV

SEQ ID NO: 13554 - protein, 6 aa, Artificial Sequence
  NLS variant
QKKRKK

SEQ ID NO: 13555 - protein, 6 aa, Artificial Sequence
  NLS variant
QKKRKR

SEQ ID NO: 13556 - protein, 5 aa, Artificial Sequence
  NLS variant
QKKRP

SEQ ID NO: 13557 - protein, 5 aa, Artificial Sequence
  NLS variant
QKRCK

SEQ ID NO: 13558 - protein, 8 aa, Artificial Sequence
  NLS variant
QKRCKIVI

SEQ ID NO: 13559 - protein, 6 aa, Artificial Sequence
  NLS variant
QKRKKK

SEQ ID NO: 13560 - protein, 6 aa, Artificial Sequence
  NLS variant
QKRKLE

SEQ ID NO: 13561 - protein, 8 aa, Artificial Sequence
  NLS variant
QKRTNVPG

SEQ ID NO: 13562 - protein, 6 aa, Artificial Sequence
  NLS variant
QLKKLR

SEQ ID NO: 13563 - protein, 5 aa, Artificial Sequence
  NLS variant
QPRKR

SEQ ID NO: 13564 - protein, 6 aa, Artificial Sequence
  NLS variant
QPSKRR

SEQ ID NO: 13565 - protein, 6 aa, Artificial Sequence
  NLS variant
QQVRKK

SEQ ID NO: 13566 - protein, 7 aa, Artificial Sequence
  NLS variant
QRGGKKK

SEQ ID NO: 13567 - protein, 5 aa, Artificial Sequence
  NLS variant
QRKKD

SEQ ID NO: 13568 - protein, 6 aa, Artificial Sequence
  NLS variant
QRKRKR

SEQ ID NO: 13569 - protein, 6 aa, Artificial Sequence
  NLS variant
QRKRRK

SEQ ID NO: 13570 - protein, 9 aa, Artificial Sequence
  NLS variant
QRPGPYDRP

SEQ ID NO: 13571 - protein, 6 aa, Artificial Sequence
  NLS variant
QRPRRR

SEQ ID NO: 13572 - protein, 6 aa, Artificial Sequence
  NLS variant
QRRKQS

SEQ ID NO: 13573 - protein, 6 aa, Artificial Sequence
  NLS variant
QRRPSR

SEQ ID NO: 13574 - protein, 10 aa, Artificial Sequence
  NLS variant
QRRPSRPFRK

SEQ ID NO: 13575 - protein, 6 aa, Artificial Sequence
  NLS variant
QRRTRK

SEQ ID NO: 13576 - protein, 8 aa, Artificial Sequence
  NLS variant
QRRTRKSQ

SEQ ID NO: 13577 - protein, 8 aa, Artificial Sequence
  NLS variant
QRRTRKVA

SEQ ID NO: 13578 - protein, 16 aa, Artificial Sequence
  NLS variant
QSGRSHSSGSSSSSSS

SEQ ID NO: 13579 - protein, 7 aa, Artificial Sequence
  NLS variant
QSKKKKK

SEQ ID NO: 13580 - protein, 6 aa, Artificial Sequence
  NLS variant
QSKRRK

SEQ ID NO: 13581 - protein, 6 aa, Artificial Sequence
  NLS variant
QSKRRR

SEQ ID NO: 13582 - protein, 6 aa, Artificial Sequence
  NLS variant
QVKGKK

SEQ ID NO: 13583 - protein, 6 aa, Artificial Sequence
  NLS variant
RAEKKL

SEQ ID NO: 13584 - protein, 8 aa, Artificial Sequence
  NLS variant
RAERKGKR

SEQ ID NO: 13585 - protein, 6 aa, Artificial Sequence
  NLS variant
RAKRAR

SEQ ID NO: 13586 - protein, 6 aa, Artificial Sequence
  NLS variant
RAKRGR

SEQ ID NO: 13587 - protein, 6 aa, Artificial Sequence
  NLS variant
RAKRIR

SEQ ID NO: 13588 - protein, 6 aa, Artificial Sequence
  NLS variant
RAKRKR

SEQ ID NO: 13589 - protein, 6 aa, Artificial Sequence
  NLS variant
RAKRRR

SEQ ID NO: 13590 - protein, 5 aa, Artificial Sequence
  NLS variant
RAKYR

SEQ ID NO: 13591 - protein, 5 aa, Artificial Sequence
  NLS variant
RATKK

SEQ ID NO: 13592 - protein, 6 aa, Artificial Sequence
  NLS variant
RATKRK

SEQ ID NO: 13593 - protein, 5 aa, Artificial Sequence
  NLS variant
RCRKR

SEQ ID NO: 13594 - protein, 5 aa, Artificial Sequence
  NLS variant
RCRQR

SEQ ID NO: 13595 - protein, 11 aa, Artificial Sequence
  NLS variant
RCRRTDGKKWR

SEQ ID NO: 13596 - protein, 7 aa, Artificial Sequence
  NLS variant
RDGFRRK

SEQ ID NO: 13597 - protein, 5 aa, Artificial Sequence
  NLS variant
RDRGK

SEQ ID NO: 13598 - protein, 6 aa, Artificial Sequence
  NLS variant
RDRKRR

SEQ ID NO: 13599 - protein, 6 aa, Artificial Sequence
  NLS variant
REEKLR

SEQ ID NO: 13600 - protein, 6 aa, Artificial Sequence
  NLS variant
REKRRR

SEQ ID NO: 13601 - protein, 6 aa, Artificial Sequence
  NLS variant
RELYRR

SEQ ID NO: 13602 - protein, 6 aa, Artificial Sequence
  NLS variant
RERKPK

SEQ ID NO: 13603 - protein, 7 aa, Artificial Sequence
  NLS variant
RESARRS

SEQ ID NO: 13604 - protein, 7 aa, Artificial Sequence
  NLS variant
RFGKRPR

SEQ ID NO: 13605 - protein, 7 aa, Artificial Sequence
  NLS variant
RFRKEKK

SEQ ID NO: 13606 - protein, 6 aa, Artificial Sequence
  NLS variant
RFRPRR

SEQ ID NO: 13607 - protein, 6 aa, Artificial Sequence
  NLS variant
RGGKKK

SEQ ID NO: 13608 - protein, 11 aa, Artificial Sequence
  NLS variant
RGGRRRRRRRR

SEQ ID NO: 13609 - protein, 18 aa, Artificial Sequence
  NLS variant
RGKGGKGLGKGGAKRHRK

SEQ ID NO: 13610 - protein, 5 aa, Artificial Sequence
  NLS variant
RGKHK

SEQ ID NO: 13611 - protein, 6 aa, Artificial Sequence
  NLS variant
RGKKGK

SEQ ID NO: 13612 - protein, 6 aa, Artificial Sequence
  NLS variant
RGKKMA

SEQ ID NO: 13613 - protein, 6 aa, Artificial Sequence
  NLS variant
RGKLKN

SEQ ID NO: 13614 - protein, 8 aa, Artificial Sequence
  NLS variant
RGKNRSRK

SEQ ID NO: 13615 - protein, 6 aa, Artificial Sequence
  NLS variant
RGKRKA

SEQ ID NO: 13616 - protein, 6 aa, Artificial Sequence
  NLS variant
RGKRKR

SEQ ID NO: 13617 - protein, 6 aa, Artificial Sequence
  NLS variant
RGKRPR

SEQ ID NO: 13618 - protein, 6 aa, Artificial Sequence
  NLS variant
RGNGRK

SEQ ID NO: 13619 - protein, 7 aa, Artificial Sequence
  NLS variant
RGRGRPK

SEQ ID NO: 13620 - protein, 7 aa, Artificial Sequence
  NLS variant
RGRGRPR

SEQ ID NO: 13621 - protein, 6 aa, Artificial Sequence
  NLS variant
RGRKGK

SEQ ID NO: 13622 - protein, 6 aa, Artificial Sequence
  NLS variant
RGRKKA

SEQ ID NO: 13623 - protein, 6 aa, Artificial Sequence
  NLS variant
RGRKKD

SEQ ID NO: 13624 - protein, 6 aa, Artificial Sequence
  NLS variant
RGRKRA

SEQ ID NO: 13625 - protein, 6 aa, Artificial Sequence
  NLS variant
RGRPAK

SEQ ID NO: 13626 - protein, 6 aa, Artificial Sequence
  NLS variant
RGRPKK

SEQ ID NO: 13627 - protein, 6 aa, Artificial Sequence
  NLS variant
RGRPKR

SEQ ID NO: 13628 - protein, 6 aa, Artificial Sequence
  NLS variant
RGRPPK

SEQ ID NO: 13629 - protein, 6 aa, Artificial Sequence
  NLS variant
RGRPRK

SEQ ID NO: 13630 - protein, 10 aa, Artificial Sequence
  NLS variant
RGRPRKRQRL

SEQ ID NO: 13631 - protein, 6 aa, Artificial Sequence
  NLS variant
RGRRKR

SEQ ID NO: 13632 - protein, 6 aa, Artificial Sequence
  NLS variant
RGRRPK

SEQ ID NO: 13633 - protein, 6 aa, Artificial Sequence
  NLS variant
RGVRRR

SEQ ID NO: 13634 - protein, 5 aa, Artificial Sequence
  NLS variant
RHGPK

SEQ ID NO: 13635 - protein, 6 aa, Artificial Sequence
  NLS variant
RHGVNR

SEQ ID NO: 13636 - protein, 5 aa, Artificial Sequence
  NLS variant
RHKRI

SEQ ID NO: 13637 - protein, 5 aa, Artificial Sequence
  NLS variant
RHRAC

SEQ ID NO: 13638 - protein, 7 aa, Artificial Sequence
  NLS variant
RHRGRRR

SEQ ID NO: 13639 - protein, 5 aa, Artificial Sequence
  NLS variant
RHRID

SEQ ID NO: 13640 - protein, 7 aa, Artificial Sequence
  NLS variant
RHRKRRR

SEQ ID NO: 13641 - protein, 5 aa, Artificial Sequence
  NLS variant
RHSKV

SEQ ID NO: 13642 - protein, 5 aa, Artificial Sequence
  NLS variant
RHVNR

SEQ ID NO: 13643 - protein, 5 aa, Artificial Sequence
  NLS variant
RHVQR

SEQ ID NO: 13644 - protein, 5 aa, Artificial Sequence
  NLS variant
RHVSK

SEQ ID NO: 13645 - protein, 6 aa, Artificial Sequence
  NLS variant
RIAKKT

SEQ ID NO: 13646 - protein, 6 aa, Artificial Sequence
  NLS variant
RICLRR

SEQ ID NO: 13647 - protein, 6 aa, Artificial Sequence
  NLS variant
RIKRKR

SEQ ID NO: 13648 - protein, 5 aa, Artificial Sequence
  NLS variant
RIKRR

SEQ ID NO: 13649 - protein, 6 aa, Artificial Sequence
  NLS variant
RIRKPR

SEQ ID NO: 13650 - protein, 6 aa, Artificial Sequence
  NLS variant
RIVRLK

SEQ ID NO: 13651 - protein, 17 aa, Artificial Sequence
  NLS variant
RKAANICHVCGKKIKDK

SEQ ID NO: 13652 - protein, 20 aa, Artificial Sequence
  NLS variant
RKAEDPEPGRCRRTDGKKWR

SEQ ID NO: 13653 - protein, 21 aa, Artificial Sequence
  NLS variant
RKAEHWKHKKEESGRERKKNW

SEQ ID NO: 13654 - protein, 24 aa, Artificial Sequence
  NLS variant
RKAGKGGGGHKTTKKRSAKDEKVP

SEQ ID NO: 13655 - protein, 6 aa, Artificial Sequence
  NLS variant
RKAKTK

SEQ ID NO: 13656 - protein, 5 aa, Artificial Sequence
  NLS variant
RKCRR

SEQ ID NO: 13657 - protein, 17 aa, Artificial Sequence
  NLS variant
RKDGFLHETLLDRRAKL

SEQ ID NO: 13658 - protein, 23 aa, Artificial Sequence
  NLS variant
RKDPNNLSNQLETLTGSIRHRLK

SEQ ID NO: 13659 - protein, 6 aa, Artificial Sequence
  NLS variant
RKDRDS

SEQ ID NO: 13660 - protein, 8 aa, Artificial Sequence
  NLS variant
RKDSKKKK

SEQ ID NO: 13661 - protein, 6 aa, Artificial Sequence
  NLS variant
RKEKEQ

SEQ ID NO: 13662 - protein, 6 aa, Artificial Sequence
  NLS variant
RKEKKR

SEQ ID NO: 13663 - protein, 6 aa, Artificial Sequence
  NLS variant
RKEKSR

SEQ ID NO: 13664 - protein, 6 aa, Artificial Sequence
  NLS variant
RKFGIK

SEQ ID NO: 13665 - protein, 6 aa, Artificial Sequence
  NLS variant
RKFGPK

SEQ ID NO: 13666 - protein, 5 aa, Artificial Sequence
  NLS variant
RKFHC

SEQ ID NO: 13667 - protein, 18 aa, Artificial Sequence
  NLS variant
RKFHCWAPWQVVPKVRKD

SEQ ID NO: 13668 - protein, 15 aa, Artificial Sequence
  NLS variant
RKFVAEYFAPNAKKR

SEQ ID NO: 13669 - protein, 6 aa, Artificial Sequence
  NLS variant
RKGKHK

SEQ ID NO: 13670 - protein, 5 aa, Artificial Sequence
  NLS variant
RKGRA

SEQ ID NO: 13671 - protein, 6 aa, Artificial Sequence
  NLS variant
RKGRPP

SEQ ID NO: 13672 - protein, 6 aa, Artificial Sequence
  NLS variant
RKHKKK

SEQ ID NO: 13673 - protein, 6 aa, Artificial Sequence
  NLS variant
RKHKRK

SEQ ID NO: 13674 - protein, 17 aa, Artificial Sequence
  NLS variant
RKHVKAHSAKEQQVRKK

SEQ ID NO: 13675 - protein, 17 aa, Artificial Sequence
  NLS variant
RKHVKAHSSREQQARKK

SEQ ID NO: 13676 - protein, 6 aa, Artificial Sequence
  NLS variant
RKIKKK

SEQ ID NO: 13677 - protein, 9 aa, Artificial Sequence
  NLS variant
RKIKLKRAK

SEQ ID NO: 13678 - protein, 6 aa, Artificial Sequence
  NLS variant
RKIKRK

SEQ ID NO: 13679 - protein, 9 aa, Artificial Sequence
  NLS variant
RKIKRKRAK

SEQ ID NO: 13680 - protein, 6 aa, Artificial Sequence
  NLS variant
RKIRRR

SEQ ID NO: 13681 - protein, 9 aa, Artificial Sequence
  NLS variant
RKKAQEKKR

SEQ ID NO: 13682 - protein, 17 aa, Artificial Sequence
  NLS variant
RKKEAPGPREELRSRGR

SEQ ID NO: 13683 - protein, 6 aa, Artificial Sequence
  NLS variant
RKKFGR

SEQ ID NO: 13684 - protein, 6 aa, Artificial Sequence
  NLS variant
RKKKDR

SEQ ID NO: 13685 - protein, 6 aa, Artificial Sequence
  NLS variant
RKKKIK

SEQ ID NO: 13686 - protein, 17 aa, Artificial Sequence
  NLS variant
RKKKINEQEREIEKLKR

SEQ ID NO: 13687 - protein, 7 aa, Artificial Sequence
  NLS variant
RKKKKKI

SEQ ID NO: 13688 - protein, 7 aa, Artificial Sequence
  NLS variant
RKKKKKQ

SEQ ID NO: 13689 - protein, 7 aa, Artificial Sequence
  NLS variant
RKKKKKR

SEQ ID NO: 13690 - protein, 8 aa, Artificial Sequence
  NLS variant
RKKKKKTK

SEQ ID NO: 13691 - protein, 6 aa, Artificial Sequence
  NLS variant
RKKLVK

SEQ ID NO: 13692 - protein, 6 aa, Artificial Sequence
  NLS variant
RKKNKI

SEQ ID NO: 13693 - protein, 6 aa, Artificial Sequence
  NLS variant
RKKPKK

SEQ ID NO: 13694 - protein, 5 aa, Artificial Sequence
  NLS variant
RKKPR

SEQ ID NO: 13695 - protein, 6 aa, Artificial Sequence
  NLS variant
RKKQKT

SEQ ID NO: 13696 - protein, 6 aa, Artificial Sequence
  NLS variant
RKKRDN

SEQ ID NO: 13697 - protein, 6 aa, Artificial Sequence
  NLS variant
RKKRDR

SEQ ID NO: 13698 - protein, 6 aa, Artificial Sequence
  NLS variant
RKKRGK

SEQ ID NO: 13699 - protein, 6 aa, Artificial Sequence
  NLS variant
RKKRKG

SEQ ID NO: 13700 - protein, 7 aa, Artificial Sequence
  NLS variant
RKKRKGK

SEQ ID NO: 13701 - protein, 6 aa, Artificial Sequence
  NLS variant
RKKRKP

SEQ ID NO: 13702 - protein, 6 aa, Artificial Sequence
  NLS variant
RKKRKR

SEQ ID NO: 13703 - protein, 6 aa, Artificial Sequence
  NLS variant
RKKRKS

SEQ ID NO: 13704 - protein, 6 aa, Artificial Sequence
  NLS variant
RKKRKT

SEQ ID NO: 13705 - protein, 6 aa, Artificial Sequence
  NLS variant
RKKRNR

SEQ ID NO: 13706 - protein, 6 aa, Artificial Sequence
  NLS variant
RKKRPR

SEQ ID NO: 13707 - protein, 6 aa, Artificial Sequence
  NLS variant
RKKRRQ

SEQ ID NO: 13708 - protein, 9 aa, Artificial Sequence
  NLS variant
RKKRRQRRR

SEQ ID NO: 13709 - protein, 10 aa, Artificial Sequence
  NLS variant
RKKRRRRHRK

SEQ ID NO: 13710 - protein, 6 aa, Artificial Sequence
  NLS variant
RKKRTK

SEQ ID NO: 13711 - protein, 6 aa, Artificial Sequence
  NLS variant
RKKSGK

SEQ ID NO: 13712 - protein, 25 aa, Artificial Sequence
  NLS variant
RKKSIPLSIKNLKRKHKRKKNKITR

SEQ ID NO: 13713 - protein, 5 aa, Artificial Sequence
  NLS variant
RKKTA

SEQ ID NO: 13714 - protein, 18 aa, Artificial Sequence
  NLS variant
RKKTDKLKKKKKRKRRDS

SEQ ID NO: 13715 - protein, 6 aa, Artificial Sequence
  NLS variant
RKKTKL

SEQ ID NO: 13716 - protein, 6 aa, Artificial Sequence
  NLS variant
RKKYKK

SEQ ID NO: 13717 - protein, 6 aa, Artificial Sequence
  NLS variant
RKLKAK

SEQ ID NO: 13718 - protein, 6 aa, Artificial Sequence
  NLS variant
RKLKKR

SEQ ID NO: 13719 - protein, 7 aa, Artificial Sequence
  NLS variant
RKLKLKK

SEQ ID NO: 13720 - protein, 6 aa, Artificial Sequence
  NLS variant
RKLPRQ

SEQ ID NO: 13721 - protein, 6 aa, Artificial Sequence
  NLS variant
RKLRRQ

SEQ ID NO: 13722 - protein, 6 aa, Artificial Sequence
  NLS variant
RKLRRR

SEQ ID NO: 13723 - protein, 6 aa, Artificial Sequence
  NLS variant
RKLVKK

SEQ ID NO: 13724 - protein, 20 aa, Artificial Sequence
  NLS variant
RKLVKPKNTKMKTKLRTNPY

SEQ ID NO: 13725 - protein, 17 aa, Artificial Sequence
  NLS variant
RKLVQIVEDQLCKKRLP

SEQ ID NO: 13726 - protein, 10 aa, Artificial Sequence
  NLS variant
RKLYQVKGKK

SEQ ID NO: 13727 - protein, 6 aa, Artificial Sequence
  NLS variant
RKMKTK

SEQ ID NO: 13728 - protein, 17 aa, Artificial Sequence
  NLS variant
RKNDAESKTGLDVSKKK

SEQ ID NO: 13729 - protein, 5 aa, Artificial Sequence
  NLS variant
RKNKD

SEQ ID NO: 13730 - protein, 5 aa, Artificial Sequence
  NLS variant
RKPDR

SEQ ID NO: 13731 - protein, 6 aa, Artificial Sequence
  NLS variant
RKPEKE

SEQ ID NO: 13732 - protein, 6 aa, Artificial Sequence
  NLS variant
RKPKEE

SEQ ID NO: 13733 - protein, 6 aa, Artificial Sequence
  NLS variant
RKPKES

SEQ ID NO: 13734 - protein, 6 aa, Artificial Sequence
  NLS variant
RKPKSK

SEQ ID NO: 13735 - protein, 21 aa, Artificial Sequence
  NLS variant
RKPLAGPKAAVLPPRPPTKRK

SEQ ID NO: 13736 - protein, 6 aa, Artificial Sequence
  NLS variant
RKPRRR

SEQ ID NO: 13737 - protein, 35 aa, Artificial Sequence
  NLS variant
RKPVTAQERQREREEKRRRRQERAKEREKRRQERE

SEQ ID NO: 13738 - protein, 6 aa, Artificial Sequence
  NLS variant
RKQKKK

SEQ ID NO: 13739 - protein, 6 aa, Artificial Sequence
  NLS variant
RKQKRK

SEQ ID NO: 13740 - protein, 6 aa, Artificial Sequence
  NLS variant
RKRAAP

SEQ ID NO: 13741 - protein, 17 aa, Artificial Sequence
  NLS variant
RKRAAPEDFLGKGPNKK

SEQ ID NO: 13742 - protein, 6 aa, Artificial Sequence
  NLS variant
RKRALE

SEQ ID NO: 13743 - protein, 17 aa, Artificial Sequence
  NLS variant
RKRARAEKKALKKKKKI

SEQ ID NO: 13744 - protein, 15 aa, Artificial Sequence
  NLS variant
RKRAWVNRPMYRKPT

SEQ ID NO: 13745 - protein, 18 aa, Artificial Sequence
  NLS variant
RKRCVTAHWLNTVLKKKK

SEQ ID NO: 13746 - protein, 6 aa, Artificial Sequence
  NLS variant
RKREEK

SEQ ID NO: 13747 - protein, 33 aa, Artificial Sequence
  NLS variant
RKRGKPASGAGAGAGAGKRRRKADSAGDRGKSK

SEQ ID NO: 13748 - protein, 6 aa, Artificial Sequence
  NLS variant
RKRGKS

SEQ ID NO: 13749 - protein, 6 aa, Artificial Sequence
  NLS variant
RKRGPK

SEQ ID NO: 13750 - protein, 6 aa, Artificial Sequence
  NLS variant
RKRGRK

SEQ ID NO: 13751 - protein, 8 aa, Artificial Sequence
  NLS variant
RKRGRNTK

SEQ ID NO: 13752 - protein, 5 aa, Artificial Sequence
  NLS variant
RKRHA

SEQ ID NO: 13753 - protein, 8 aa, Artificial Sequence
  NLS variant
RKRHSASP

SEQ ID NO: 13754 - protein, 5 aa, Artificial Sequence
  NLS variant
RKRHW

SEQ ID NO: 13755 - protein, 6 aa, Artificial Sequence
  NLS variant
RKRKEA

SEQ ID NO: 13756 - protein, 6 aa, Artificial Sequence
  NLS variant
RKRKGK

SEQ ID NO: 13757 - protein, 6 aa, Artificial Sequence
  NLS variant
RKRKGS

SEQ ID NO: 13758 - protein, 6 aa, Artificial Sequence
  NLS variant
RKRKKA

SEQ ID NO: 13759 - protein, 7 aa, Artificial Sequence
  NLS variant
RKRKKEK

SEQ ID NO: 13760 - protein, 7 aa, Artificial Sequence
  NLS variant
RKRKKKK

SEQ ID NO: 13761 - protein, 6 aa, Artificial Sequence
  NLS variant
RKRKKM

SEQ ID NO: 13762 - protein, 16 aa, Artificial Sequence
  NLS variant
RKRKKMPASQRSKRRK

SEQ ID NO: 13763 - protein, 7 aa, Artificial Sequence
  NLS variant
RKRKKSK

SEQ ID NO: 13764 - protein, 7 aa, Artificial Sequence
  NLS variant
RKRKMEH

SEQ ID NO: 13765 - protein, 6 aa, Artificial Sequence
  NLS variant
RKRKNE

SEQ ID NO: 13766 - protein, 6 aa, Artificial Sequence
  NLS variant
RKRKNS

SEQ ID NO: 13767 - protein, 6 aa, Artificial Sequence
  NLS variant
RKRKPK

SEQ ID NO: 13768 - protein, 6 aa, Artificial Sequence
  NLS variant
RKRKRV

SEQ ID NO: 13769 - protein, 6 aa, Artificial Sequence
  NLS variant
RKRKSE

SEQ ID NO: 13770 - protein, 7 aa, Artificial Sequence
  NLS variant
RKRKSES

SEQ ID NO: 13771 - protein, 6 aa, Artificial Sequence
  NLS variant
RKRKSK

SEQ ID NO: 13772 - protein, 6 aa, Artificial Sequence
  NLS variant
RKRKSR

SEQ ID NO: 13773 - protein, 37 aa, Artificial Sequence
  NLS variant
RKRKSRSRGDGTTVAERLKRWKEYNETVEEVSTKKRK

SEQ ID NO: 13774 - protein, 6 aa, Artificial Sequence
  NLS variant
RKRLAD

SEQ ID NO: 13775 - protein, 16 aa, Artificial Sequence
  NLS variant
RKRLEHTERQFRNRRK

SEQ ID NO: 13776 - protein, 16 aa, Artificial Sequence
  NLS variant
RKRLILSDKGQLDWKK

SEQ ID NO: 13777 - protein, 6 aa, Artificial Sequence
  NLS variant
RKRLKS

SEQ ID NO: 13778 - protein, 7 aa, Artificial Sequence
  NLS variant
RKRLKSK

SEQ ID NO: 13779 - protein, 6 aa, Artificial Sequence
  NLS variant
RKRLSK

SEQ ID NO: 13780 - protein, 6 aa, Artificial Sequence
  NLS variant
RKRLTG

SEQ ID NO: 13781 - protein, 6 aa, Artificial Sequence
  NLS variant
RKRLVK

SEQ ID NO: 13782 - protein, 6 aa, Artificial Sequence
  NLS variant
RKRMIS

SEQ ID NO: 13783 - protein, 6 aa, Artificial Sequence
  NLS variant
RKRMLS

SEQ ID NO: 13784 - protein, 6 aa, Artificial Sequence
  NLS variant
RKRPLK

SEQ ID NO: 13785 - protein, 6 aa, Artificial Sequence
  NLS variant
RKRPLL

SEQ ID NO: 13786 - protein, 6 aa, Artificial Sequence
  NLS variant
RKRPLR

SEQ ID NO: 13787 - protein, 6 aa, Artificial Sequence
  NLS variant
RKRPLV

SEQ ID NO: 13788 - protein, 24 aa, Artificial Sequence
  NLS variant
RKRPLVKTETGPESELLPEKRTKI

SEQ ID NO: 13789 - protein, 6 aa, Artificial Sequence
  NLS variant
RKRPRE

SEQ ID NO: 13790 - protein, 6 aa, Artificial Sequence
  NLS variant
RKRPRL

SEQ ID NO: 13791 - protein, 6 aa, Artificial Sequence
  NLS variant
RKRPRM

SEQ ID NO: 13792 - protein, 6 aa, Artificial Sequence
  NLS variant
RKRPRR

SEQ ID NO: 13793 - protein, 6 aa, Artificial Sequence
  NLS variant
RKRPSR

SEQ ID NO: 13794 - protein, 5 aa, Artificial Sequence
  NLS variant
RKRPW

SEQ ID NO: 13795 - protein, 5 aa, Artificial Sequence
  NLS variant
RKRQD

SEQ ID NO: 13796 - protein, 6 aa, Artificial Sequence
  NLS variant
RKRQEK

SEQ ID NO: 13797 - protein, 8 aa, Artificial Sequence
  NLS variant
RKRQHIDD

SEQ ID NO: 13798 - protein, 6 aa, Artificial Sequence
  NLS variant
RKRQKG

SEQ ID NO: 13799 - protein, 6 aa, Artificial Sequence
  NLS variant
RKRQRD

SEQ ID NO: 13800 - protein, 7 aa, Artificial Sequence
  NLS variant
RKRQRDD

SEQ ID NO: 13801 - protein, 6 aa, Artificial Sequence
  NLS variant
RKRQTG

SEQ ID NO: 13802 - protein, 6 aa, Artificial Sequence
  NLS variant
RKRRAK

SEQ ID NO: 13803 - protein, 6 aa, Artificial Sequence
  NLS variant
RKRRDR

SEQ ID NO: 13804 - protein, 6 aa, Artificial Sequence
  NLS variant
RKRRGG

SEQ ID NO: 13805 - protein, 6 aa, Artificial Sequence
  NLS variant
RKRRGR

SEQ ID NO: 13806 - protein, 7 aa, Artificial Sequence
  NLS variant
RKRRGRK

SEQ ID NO: 13807 - protein, 6 aa, Artificial Sequence
  NLS variant
RKRRKK

SEQ ID NO: 13808 - protein, 6 aa, Artificial Sequence
  NLS variant
RKRRRL

SEQ ID NO: 13809 - protein, 9 aa, Artificial Sequence
  NLS variant
RKRRVRDNM

SEQ ID NO: 13810 - protein, 6 aa, Artificial Sequence
  NLS variant
RKRSAS

SEQ ID NO: 13811 - protein, 6 aa, Artificial Sequence
  NLS variant
RKRSEK

SEQ ID NO: 13812 - protein, 6 aa, Artificial Sequence
  NLS variant
RKRSKS

SEQ ID NO: 13813 - protein, 6 aa, Artificial Sequence
  NLS variant
RKRSPK

SEQ ID NO: 13814 - protein, 22 aa, Artificial Sequence
  NLS variant
RKRSPKDKKEKDLDGAGKRRKT

SEQ ID NO: 13815 - protein, 6 aa, Artificial Sequence
  NLS variant
RKRSSE

SEQ ID NO: 13816 - protein, 5 aa, Artificial Sequence
  NLS variant
RKRSW

SEQ ID NO: 13817 - protein, 22 aa, Artificial Sequence
  NLS variant
RKRTPRVDGQTGENDMNKRRRK

SEQ ID NO: 13818 - protein, 6 aa, Artificial Sequence
  NLS variant
RKRTPV

SEQ ID NO: 13819 - protein, 6 aa, Artificial Sequence
  NLS variant
RKRTSE

SEQ ID NO: 13820 - protein, 6 aa, Artificial Sequence
  NLS variant
RKSKTK

SEQ ID NO: 13821 - protein, 6 aa, Artificial Sequence
  NLS variant
RKSRRK

SEQ ID NO: 13822 - protein, 6 aa, Artificial Sequence
  NLS variant
RKSRRR

SEQ ID NO: 13823 - protein, 18 aa, Artificial Sequence
  NLS variant
RKSSHHRKAGESHRRRAG

SEQ ID NO: 13824 - protein, 17 aa, Artificial Sequence
  NLS variant
RKSSSSPTRIPPKQKRK

SEQ ID NO: 13825 - protein, 17 aa, Artificial Sequence
  NLS variant
RKSTKKTNQSSKNIRKK

SEQ ID NO: 13826 - protein, 6 aa, Artificial Sequence
  NLS variant
RKTKGK

SEQ ID NO: 13827 - protein, 6 aa, Artificial Sequence
  NLS variant
RKTKRK

SEQ ID NO: 13828 - protein, 6 aa, Artificial Sequence
  NLS variant
RKTKRP

SEQ ID NO: 13829 - protein, 6 aa, Artificial Sequence
  NLS variant
RKTKSK

SEQ ID NO: 13830 - protein, 6 aa, Artificial Sequence
  NLS variant
RKTLRK

SEQ ID NO: 13831 - protein, 5 aa, Artificial Sequence
  NLS variant
RKTMR

SEQ ID NO: 13832 - protein, 18 aa, Artificial Sequence
  NLS variant
RKVHECTASTKRRKKKKK

SEQ ID NO: 13833 - protein, 6 aa, Artificial Sequence
  NLS variant
RKVKRK

SEQ ID NO: 13834 - protein, 6 aa, Artificial Sequence
  NLS variant
RKVRKP

SEQ ID NO: 13835 - protein, 6 aa, Artificial Sequence
  NLS variant
RKWLKS

SEQ ID NO: 13836 - protein, 6 aa, Artificial Sequence
  NLS variant
RKYGPK

SEQ ID NO: 13837 - protein, 6 aa, Artificial Sequence
  NLS variant
RKYGQK

SEQ ID NO: 13838 - protein, 6 aa, Artificial Sequence
  NLS variant
RLKRKR

SEQ ID NO: 13839 - protein, 6 aa, Artificial Sequence
  NLS variant
RLNKRS

SEQ ID NO: 13840 - protein, 10 aa, Artificial Sequence
  NLS variant
RLPVRRRRRR

SEQ ID NO: 13841 - protein, 6 aa, Artificial Sequence
  NLS variant
RLQRKR

SEQ ID NO: 13842 - protein, 10 aa, Artificial Sequence
  NLS variant
RLRFRKPKSK

SEQ ID NO: 13843 - protein, 5 aa, Artificial Sequence
  NLS variant
RLRHN

SEQ ID NO: 13844 - protein, 6 aa, Artificial Sequence
  NLS variant
RLRKMK

SEQ ID NO: 13845 - protein, 5 aa, Artificial Sequence
  NLS variant
RMHPY

SEQ ID NO: 13846 - protein, 5 aa, Artificial Sequence
  NLS variant
RMKKH

SEQ ID NO: 13847 - protein, 5 aa, Artificial Sequence
  NLS variant
RMKMK

SEQ ID NO: 13848 - protein, 5 aa, Artificial Sequence
  NLS variant
RMKRV

SEQ ID NO: 13849 - protein, 5 aa, Artificial Sequence
  NLS variant
RMKWK

SEQ ID NO: 13850 - protein, 9 aa, Artificial Sequence
  NLS variant
RMPKRQRIP

SEQ ID NO: 13851 - protein, 18 aa, Artificial Sequence
  NLS variant
RNFHCWAPGKVVPKVRKD

SEQ ID NO: 13852 - protein, 6 aa, Artificial Sequence
  NLS variant
RNKLRL

SEQ ID NO: 13853 - protein, 5 aa, Artificial Sequence
  NLS variant
RNKRN

SEQ ID NO: 13854 - protein, 6 aa, Artificial Sequence
  NLS variant
RNKSEK

SEQ ID NO: 13855 - protein, 6 aa, Artificial Sequence
  NLS variant
RNNKKR

SEQ ID NO: 13856 - protein, 6 aa, Artificial Sequence
  NLS variant
RNQKKK

SEQ ID NO: 13857 - protein, 6 aa, Artificial Sequence
  NLS variant
RNRKEK

SEQ ID NO: 13858 - protein, 6 aa, Artificial Sequence
  NLS variant
RNSEKK

SEQ ID NO: 13859 - protein, 7 aa, Artificial Sequence
  NLS variant
RPGKRKR

SEQ ID NO: 13860 - protein, 7 aa, Artificial Sequence
  NLS variant
RPGPYDR

SEQ ID NO: 13861 - protein, 6 aa, Artificial Sequence
  NLS variant
RPGRKR

SEQ ID NO: 13862 - protein, 7 aa, Artificial Sequence
  NLS variant
RPGRPRK

SEQ ID NO: 13863 - protein, 6 aa, Artificial Sequence
  NLS variant
RPKKRG

SEQ ID NO: 13864 - protein, 6 aa, Artificial Sequence
  NLS variant
RPKRRR

SEQ ID NO: 13865 - protein, 6 aa, Artificial Sequence
  NLS variant
RPLKRR

SEQ ID NO: 13866 - protein, 6 aa, Artificial Sequence
  NLS variant
RPPKRK

SEQ ID NO: 13867 - protein, 6 aa, Artificial Sequence
  NLS variant
RPPRRR

SEQ ID NO: 13868 - protein, 6 aa, Artificial Sequence
  NLS variant
RPRASR

SEQ ID NO: 13869 - protein, 7 aa, Artificial Sequence
  NLS variant
RPRGRPR

SEQ ID NO: 13870 - protein, 5 aa, Artificial Sequence
  NLS variant
RPRKD

SEQ ID NO: 13871 - protein, 6 aa, Artificial Sequence
  NLS variant
RPRKRG

SEQ ID NO: 13872 - protein, 6 aa, Artificial Sequence
  NLS variant
RPRKRQ

SEQ ID NO: 13873 - protein, 6 aa, Artificial Sequence
  NLS variant
RPRKVP

SEQ ID NO: 13874 - protein, 6 aa, Artificial Sequence
  NLS variant
RPRRRA

SEQ ID NO: 13875 - protein, 15 aa, Artificial Sequence
  NLS variant
RPRRRAGRSGGMDPR

SEQ ID NO: 13876 - protein, 7 aa, Artificial Sequence
  NLS variant
RPRRRRR

SEQ ID NO: 13877 - protein, 8 aa, Artificial Sequence
  NLS variant
RPRRRSRR

SEQ ID NO: 13878 - protein, 6 aa, Artificial Sequence
  NLS variant
RPSKRK

SEQ ID NO: 13879 - protein, 6 aa, Artificial Sequence
  NLS variant
RQARKR

SEQ ID NO: 13880 - protein, 5 aa, Artificial Sequence
  NLS variant
RQHKR

SEQ ID NO: 13881 - protein, 6 aa, Artificial Sequence
  NLS variant
RQKKKK

SEQ ID NO: 13882 - protein, 6 aa, Artificial Sequence
  NLS variant
RQKKRR

SEQ ID NO: 13883 - protein, 6 aa, Artificial Sequence
  NLS variant
RQKRKG

SEQ ID NO: 13884 - protein, 6 aa, Artificial Sequence
  NLS variant
RQKRKK

SEQ ID NO: 13885 - protein, 6 aa, Artificial Sequence
  NLS variant
RQKRKR

SEQ ID NO: 13886 - protein, 6 aa, Artificial Sequence
  NLS variant
RQKRRR

SEQ ID NO: 13887 - protein, 6 aa, Artificial Sequence
  NLS variant
RQLRRR

SEQ ID NO: 13888 - protein, 6 aa, Artificial Sequence
  NLS variant
RQQRKR

SEQ ID NO: 13889 - protein, 5 aa, Artificial Sequence
  NLS variant
RQRKN

SEQ ID NO: 13890 - protein, 5 aa, Artificial Sequence
  NLS variant
RRADH

SEQ ID NO: 13891 - protein, 5 aa, Artificial Sequence
  NLS variant
RRAKW

SEQ ID NO: 13892 - protein, 27 aa, Artificial Sequence
  NLS variant
RRAMKRNARLRCPFRKGACEITRKTRR

SEQ ID NO: 13893 - protein, 6 aa, Artificial Sequence
  NLS variant
RRCRSR

SEQ ID NO: 13894 - protein, 16 aa, Artificial Sequence
  NLS variant
RRDLNSSFETSPKKVK

SEQ ID NO: 13895 - protein, 8 aa, Artificial Sequence
  NLS variant
RRDRAKLR

SEQ ID NO: 13896 - protein, 18 aa, Artificial Sequence
  NLS variant
RREELAQIRKEEKEKKRR

SEQ ID NO: 13897 - protein, 17 aa, Artificial Sequence
  NLS variant
RREFGDSKRVFGERRRN

SEQ ID NO: 13898 - protein, 6 aa, Artificial Sequence
  NLS variant
RREKKR

SEQ ID NO: 13899 - protein, 6 aa, Artificial Sequence
  NLS variant
RREKQR

SEQ ID NO: 13900 - protein, 6 aa, Artificial Sequence
  NLS variant
RREKRK

SEQ ID NO: 13901 - protein, 30 aa, Artificial Sequence
  NLS variant
RRELVYFAWEHFKPRREFVWGPRDKLRRFK

SEQ ID NO: 13902 - protein, 8 aa, Artificial Sequence
  NLS variant
RRGDGRRR

SEQ ID NO: 13903 - protein, 6 aa, Artificial Sequence
  NLS variant
RRGRKK

SEQ ID NO: 13904 - protein, 6 aa, Artificial Sequence
  NLS variant
RRGRKP

SEQ ID NO: 13905 - protein, 11 aa, Artificial Sequence
  NLS variant
RRGRKRKAEKQ

SEQ ID NO: 13906 - protein, 6 aa, Artificial Sequence
  NLS variant
RRGRPP

SEQ ID NO: 13907 - protein, 6 aa, Artificial Sequence
  NLS variant
RRGRPS

SEQ ID NO: 13908 - protein, 6 aa, Artificial Sequence
  NLS variant
RRGRRK

SEQ ID NO: 13909 - protein, 6 aa, Artificial Sequence
  NLS variant
RRGRRR

SEQ ID NO: 13910 - protein, 6 aa, Artificial Sequence
  NLS variant
RRGTRG

SEQ ID NO: 13911 - protein, 5 aa, Artificial Sequence
  NLS variant
RRHGM

SEQ ID NO: 13912 - protein, 18 aa, Artificial Sequence
  NLS variant
RRHQQGQGDDSSHKKERK

SEQ ID NO: 13913 - protein, 5 aa, Artificial Sequence
  NLS variant
RRHSK

SEQ ID NO: 13914 - protein, 5 aa, Artificial Sequence
  NLS variant
RRHSY

SEQ ID NO: 13915 - protein, 18 aa, Artificial Sequence
  NLS variant
RRIQPAFGADHDVPKRKK

SEQ ID NO: 13916 - protein, 6 aa, Artificial Sequence
  NLS variant
RRKALE

SEQ ID NO: 13917 - protein, 8 aa, Artificial Sequence
  NLS variant
RRKALEVE

SEQ ID NO: 13918 - protein, 6 aa, Artificial Sequence
  NLS variant
RRKDRD

SEQ ID NO: 13919 - protein, 6 aa, Artificial Sequence
  NLS variant
RRKDRR

SEQ ID NO: 13920 - protein, 16 aa, Artificial Sequence
  NLS variant
RRKEKSKRDREKDKKR

SEQ ID NO: 13921 - protein, 5 aa, Artificial Sequence
  NLS variant
RRKFR

SEQ ID NO: 13922 - protein, 5 aa, Artificial Sequence
  NLS variant
RRKGG

SEQ ID NO: 13923 - protein, 6 aa, Artificial Sequence
  NLS variant
RRKKEK

SEQ ID NO: 13924 - protein, 7 aa, Artificial Sequence
  NLS variant
RRKKKKK

SEQ ID NO: 13925 - protein, 6 aa, Artificial Sequence
  NLS variant
RRKKLR

SEQ ID NO: 13926 - protein, 6 aa, Artificial Sequence
  NLS variant
RRKKMK

SEQ ID NO: 13927 - protein, 6 aa, Artificial Sequence
  NLS variant
RRKKRG

SEQ ID NO: 13928 - protein, 6 aa, Artificial Sequence
  NLS variant
RRKKRR

SEQ ID NO: 13929 - protein, 6 aa, Artificial Sequence
  NLS variant
RRKKRT

SEQ ID NO: 13930 - protein, 6 aa, Artificial Sequence
  NLS variant
RRKQSN

SEQ ID NO: 13931 - protein, 6 aa, Artificial Sequence
  NLS variant
RRKRAV

SEQ ID NO: 13932 - protein, 6 aa, Artificial Sequence
  NLS variant
RRKRKA

SEQ ID NO: 13933 - protein, 6 aa, Artificial Sequence
  NLS variant
RRKRLR

SEQ ID NO: 13934 - protein, 6 aa, Artificial Sequence
  NLS variant
RRKRNR

SEQ ID NO: 13935 - protein, 6 aa, Artificial Sequence
  NLS variant
RRKRRK

SEQ ID NO: 13936 - protein, 6 aa, Artificial Sequence
  NLS variant
RRKRSK

SEQ ID NO: 13937 - protein, 19 aa, Artificial Sequence
  NLS variant
RRKRSKSEDMDNVQSKRRR

SEQ ID NO: 13938 - protein, 19 aa, Artificial Sequence
  NLS variant
RRKRSKSEDMDSVESKRRR

SEQ ID NO: 13939 - protein, 6 aa, Artificial Sequence
  NLS variant
RRKRSR

SEQ ID NO: 13940 - protein, 6 aa, Artificial Sequence
  NLS variant
RRKSAS

SEQ ID NO: 13941 - protein, 9 aa, Artificial Sequence
  NLS variant
RRKSIKKKR

SEQ ID NO: 13942 - protein, 5 aa, Artificial Sequence
  NLS variant
RRKVP

SEQ ID NO: 13943 - protein, 19 aa, Artificial Sequence
  NLS variant
RRLGPTGKEVHALKRLRDS

SEQ ID NO: 13944 - protein, 6 aa, Artificial Sequence
  NLS variant
RRLRQR

SEQ ID NO: 13945 - protein, 6 aa, Artificial Sequence
  NLS variant
RRMKSK

SEQ ID NO: 13946 - protein, 7 aa, Artificial Sequence
  NLS variant
RRMKWKK

SEQ ID NO: 13947 - protein, 18 aa, Artificial Sequence
  NLS variant
RRNNKKRNREYYNYKRKA

SEQ ID NO: 13948 - protein, 14 aa, Artificial Sequence
  NLS variant
RRPKGKTLQKRKPK

SEQ ID NO: 13949 - protein, 6 aa, Artificial Sequence
  NLS variant
RRPLVK

SEQ ID NO: 13950 - protein, 5 aa, Artificial Sequence
  NLS variant
RRPRC

SEQ ID NO: 13951 - protein, 6 aa, Artificial Sequence
  NLS variant
RRQERK

SEQ ID NO: 13952 - protein, 8 aa, Artificial Sequence
  NLS variant
RRQERKPK

SEQ ID NO: 13953 - protein, 5 aa, Artificial Sequence
  NLS variant
RRQGM

SEQ ID NO: 13954 - protein, 6 aa, Artificial Sequence
  NLS variant
RRRAGR

SEQ ID NO: 13955 - protein, 6 aa, Artificial Sequence
  NLS variant
RRRAQK

SEQ ID NO: 13956 - protein, 15 aa, Artificial Sequence
  NLS variant
RRRCLDFEMPGKRKK

SEQ ID NO: 13957 - protein, 6 aa, Artificial Sequence
  NLS variant
RRRDRR

SEQ ID NO: 13958 - protein, 6 aa, Artificial Sequence
  NLS variant
RRREKR

SEQ ID NO: 13959 - protein, 8 aa, Artificial Sequence
  NLS variant
RRRESLRI

SEQ ID NO: 13960 - protein, 18 aa, Artificial Sequence
  NLS variant
RRRGFERFGPDNMGRKRK

SEQ ID NO: 13961 - protein, 15 aa, Artificial Sequence
  NLS variant
RRRGKNKVAAQNCRK

SEQ ID NO: 13962 - protein, 6 aa, Artificial Sequence
  NLS variant
RRRGPR

SEQ ID NO: 13963 - protein, 14 aa, Artificial Sequence
  NLS variant
RRRGTRGKGRRIRR

SEQ ID NO: 13964 - protein, 6 aa, Artificial Sequence
  NLS variant
RRRHRK

SEQ ID NO: 13965 - protein, 6 aa, Artificial Sequence
  NLS variant
RRRHRR

SEQ ID NO: 13966 - protein, 6 aa, Artificial Sequence
  NLS variant
RRRHSD

SEQ ID NO: 13967 - protein, 18 aa, Artificial Sequence
  NLS variant
RRRHSDENDGGQPHKRRK

SEQ ID NO: 13968 - protein, 18 aa, Artificial Sequence
  NLS variant
RRRHSYENDGGQPHKRRK

SEQ ID NO: 13969 - protein, 6 aa, Artificial Sequence
  NLS variant
RRRHYN

SEQ ID NO: 13970 - protein, 6 aa, Artificial Sequence
  NLS variant
RRRKRF

SEQ ID NO: 13971 - protein, 6 aa, Artificial Sequence
  NLS variant
RRRKRR

SEQ ID NO: 13972 - protein, 6 aa, Artificial Sequence
  NLS variant
RRRKRS

SEQ ID NO: 13973 - protein, 6 aa, Artificial Sequence
  NLS variant
RRRPLP

SEQ ID NO: 13974 - protein, 6 aa, Artificial Sequence
  NLS variant
RRRPPK

SEQ ID NO: 13975 - protein, 6 aa, Artificial Sequence
  NLS variant
RRRQKQ

SEQ ID NO: 13976 - protein, 14 aa, Artificial Sequence
  NLS variant
RRRQKQKGGASRRR

SEQ ID NO: 13977 - protein, 8 aa, Artificial Sequence
  NLS variant
RRRQLPPF

SEQ ID NO: 13978 - protein, 6 aa, Artificial Sequence
  NLS variant
RRRQRK

SEQ ID NO: 13979 - protein, 6 aa, Artificial Sequence
  NLS variant
RRRRAG

SEQ ID NO: 13980 - protein, 6 aa, Artificial Sequence
  NLS variant
RRRRAS

SEQ ID NO: 13981 - protein, 19 aa, Artificial Sequence
  NLS variant
RRRRASAPISQWSSSRRSR

SEQ ID NO: 13982 - protein, 7 aa, Artificial Sequence
  NLS variant
RRRREGP

SEQ ID NO: 13983 - protein, 13 aa, Artificial Sequence
  NLS variant
RRRREGPRARRRR

SEQ ID NO: 13984 - protein, 7 aa, Artificial Sequence
  NLS variant
RRRRRRL

SEQ ID NO: 13985 - protein, 8 aa, Artificial Sequence
  NLS variant
RRRRRRRE

SEQ ID NO: 13986 - protein, 27 aa, Artificial Sequence
  NLS variant
RRRRRVVEPVEATLQRWEEEGLARARR

SEQ ID NO: 13987 - protein, 7 aa, Artificial Sequence
  NLS variant
RRRRSPS

SEQ ID NO: 13988 - protein, 7 aa, Artificial Sequence
  NLS variant
RRRRSSR

SEQ ID NO: 13989 - protein, 7 aa, Artificial Sequence
  NLS variant
RRRRVVE

SEQ ID NO: 13990 - protein, 5 aa, Artificial Sequence
  NLS variant
RRRSM

SEQ ID NO: 13991 - protein, 8 aa, Artificial Sequence
  NLS variant
RRRSPLPR

SEQ ID NO: 13992 - protein, 6 aa, Artificial Sequence
  NLS variant
RRRSPP

SEQ ID NO: 13993 - protein, 7 aa, Artificial Sequence
  NLS variant
RRRSPSP

SEQ ID NO: 13994 - protein, 18 aa, Artificial Sequence
  NLS variant
RRRTVQEARALLRCRRAG

SEQ ID NO: 13995 - protein, 18 aa, Artificial Sequence
  NLS variant
RRRVNIFGEELERLLKKK

SEQ ID NO: 13996 - protein, 6 aa, Artificial Sequence
  NLS variant
RRSKLR

SEQ ID NO: 13997 - protein, 16 aa, Artificial Sequence
  NLS variant
RRSKLRKPKPVPLRKK

SEQ ID NO: 13998 - protein, 6 aa, Artificial Sequence
  NLS variant
RRSLRK

SEQ ID NO: 13999 - protein, 6 aa, Artificial Sequence
  NLS variant
RRSLRY

SEQ ID NO: 14000 - protein, 18 aa, Artificial Sequence
  NLS variant
RRSLRYSGDPGAKRSRNT

SEQ ID NO: 14001 - protein, 7 aa, Artificial Sequence
  NLS variant
RRSPPPR

SEQ ID NO: 14002 - protein, 6 aa, Artificial Sequence
  NLS variant
RRSPPR

SEQ ID NO: 14003 - protein, 7 aa, Artificial Sequence
  NLS variant
RRSPSPR

SEQ ID NO: 14004 - protein, 6 aa, Artificial Sequence
  NLS variant
RRSPSR

SEQ ID NO: 14005 - protein, 61 aa, Artificial Sequence
  NLS variant
RRTIRLKLVYDKCDRSCKIQKKNRNKCQYCRFHKCLSVGMSHNAIRFGRMPRSEKAKLKAE

SEQ ID NO: 14006 - protein, 6 aa, Artificial Sequence
  NLS variant
RRTPPR

SEQ ID NO: 14007 - protein, 18 aa, Artificial Sequence
  NLS variant
RRTPSPRRRRSPSPRRRR

SEQ ID NO: 14008 - protein, 6 aa, Artificial Sequence
  NLS variant
RRTRGK

SEQ ID NO: 14009 - protein, 6 aa, Artificial Sequence
  NLS variant
RRTRSR

SEQ ID NO: 14010 - protein, 6 aa, Artificial Sequence
  NLS variant
RRVKEE

SEQ ID NO: 14011 - protein, 18 aa, Artificial Sequence
  NLS variant
RRVKEEVLKLLPPKKDRI

SEQ ID NO: 14012 - protein, 17 aa, Artificial Sequence
  NLS variant
RRVPQRKEVSRCRKCRK

SEQ ID NO: 14013 - protein, 6 aa, Artificial Sequence
  NLS variant
RRVQRK

SEQ ID NO: 14014 - protein, 5 aa, Artificial Sequence
  NLS variant
RRVRC

SEQ ID NO: 14015 - protein, 6 aa, Artificial Sequence
  NLS variant
RRVRLR

SEQ ID NO: 14016 - protein, 6 aa, Artificial Sequence
  NLS variant
RRVRQR

SEQ ID NO: 14017 - protein, 6 aa, Artificial Sequence
  NLS variant
RRVRSK

SEQ ID NO: 14018 - protein, 18 aa, Artificial Sequence
  NLS variant
RRVRVVPVKKQPQTKGKK

SEQ ID NO: 14019 - protein, 6 aa, Artificial Sequence
  NLS variant
RRWNKL

SEQ ID NO: 14020 - protein, 16 aa, Artificial Sequence
  NLS variant
RRWNKLRLQDKEKRLK

SEQ ID NO: 14021 - protein, 5 aa, Artificial Sequence
  NLS variant
RRWTR

SEQ ID NO: 14022 - protein, 6 aa, Artificial Sequence
  NLS variant
RSAGRK

SEQ ID NO: 14023 - protein, 6 aa, Artificial Sequence
  NLS variant
RSAKRK

SEQ ID NO: 14024 - protein, 6 aa, Artificial Sequence
  NLS variant
RSARAR

SEQ ID NO: 14025 - protein, 7 aa, Artificial Sequence
  NLS variant
RSARARR

SEQ ID NO: 14026 - protein, 6 aa, Artificial Sequence
  NLS variant
RSGKKK

SEQ ID NO: 14027 - protein, 8 aa, Artificial Sequence
  NLS variant
RSGRNRKK

SEQ ID NO: 14028 - protein, 6 aa, Artificial Sequence
  NLS variant
RSKDKK

SEQ ID NO: 14029 - protein, 6 aa, Artificial Sequence
  NLS variant
RSKLRP

SEQ ID NO: 14030 - protein, 15 aa, Artificial Sequence
  NLS variant
RSKPKKKSKKHKDKE

SEQ ID NO: 14031 - protein, 6 aa, Artificial Sequence
  NLS variant
RSPKKK

SEQ ID NO: 14032 - protein, 6 aa, Artificial Sequence
  NLS variant
RSPPRR

SEQ ID NO: 14033 - protein, 6 aa, Artificial Sequence
  NLS variant
RSPRGR

SEQ ID NO: 14034 - protein, 6 aa, Artificial Sequence
  NLS variant
RSPRKR

SEQ ID NO: 14035 - protein, 7 aa, Artificial Sequence
  NLS variant
RSPSPRR

SEQ ID NO: 14036 - protein, 7 aa, Artificial Sequence
  NLS variant
RSRGRPS

SEQ ID NO: 14037 - protein, 6 aa, Artificial Sequence
  NLS variant
RSRRGK

SEQ ID NO: 14038 - protein, 6 aa, Artificial Sequence
  NLS variant
RSRRGR

SEQ ID NO: 14039 - protein, 6 aa, Artificial Sequence
  NLS variant
RSSRAR

SEQ ID NO: 14040 - protein, 6 aa, Artificial Sequence
  NLS variant
RSTKRK

SEQ ID NO: 14041 - protein, 6 aa, Artificial Sequence
  NLS variant
RSVRRR

SEQ ID NO: 14042 - protein, 5 aa, Artificial Sequence
  NLS variant
RTCRR

SEQ ID NO: 14043 - protein, 6 aa, Artificial Sequence
  NLS variant
RTGKRK

SEQ ID NO: 14044 - protein, 7 aa, Artificial Sequence
  NLS variant
RTGKRKR

SEQ ID NO: 14045 - protein, 6 aa, Artificial Sequence
  NLS variant
RTIGKK

SEQ ID NO: 14046 - protein, 14 aa, Artificial Sequence
  NLS variant
RTIGKKKQRLNKRS

SEQ ID NO: 14047 - protein, 6 aa, Artificial Sequence
  NLS variant
RTKEKK

SEQ ID NO: 14048 - protein, 6 aa, Artificial Sequence
  NLS variant
RTKRLK

SEQ ID NO: 14049 - protein, 6 aa, Artificial Sequence
  NLS variant
RTKRQR

SEQ ID NO: 14050 - protein, 5 aa, Artificial Sequence
  NLS variant
RTKRR

SEQ ID NO: 14051 - protein, 6 aa, Artificial Sequence
  NLS variant
RTKRRK

SEQ ID NO: 14052 - protein, 5 aa, Artificial Sequence
  NLS variant
RTRKQ

SEQ ID NO: 14053 - protein, 6 aa, Artificial Sequence
  NLS variant
RTRKVA

SEQ ID NO: 14054 - protein, 5 aa, Artificial Sequence
  NLS variant
RTRQR

SEQ ID NO: 14055 - protein, 32 aa, Artificial Sequence
  NLS variant
RVGGRRQAVECIEDLLNEPGQPLDLSCKRPRP

SEQ ID NO: 14056 - protein, 7 aa, Artificial Sequence
  NLS variant
RVHPYQR

SEQ ID NO: 14057 - protein, 6 aa, Artificial Sequence
  NLS variant
RVKKKK

SEQ ID NO: 14058 - protein, 6 aa, Artificial Sequence
  NLS variant
RVKRRR

SEQ ID NO: 14059 - protein, 13 aa, Artificial Sequence
  NLS variant
RVLQVWFQNARAK

SEQ ID NO: 14060 - protein, 11 aa, Artificial Sequence
  NLS variant
RVPVRTRPPRN

SEQ ID NO: 14061 - protein, 6 aa, Artificial Sequence
  NLS variant
RVVKLR

SEQ ID NO: 14062 - protein, 9 aa, Artificial Sequence
  NLS variant
RVVKLRIAP

SEQ ID NO: 14063 - protein, 6 aa, Artificial Sequence
  NLS variant
RVVRRR

SEQ ID NO: 14064 - protein, 5 aa, Artificial Sequence
  NLS variant
RWRSR

SEQ ID NO: 14065 - protein, 6 aa, Artificial Sequence
  NLS variant
SAKKPK

SEQ ID NO: 14066 - protein, 6 aa, Artificial Sequence
  NLS variant
SAKKQK

SEQ ID NO: 14067 - protein, 6 aa, Artificial Sequence
  NLS variant
SAKPKK

SEQ ID NO: 14068 - protein, 6 aa, Artificial Sequence
  NLS variant
SAKRPK

SEQ ID NO: 14069 - protein, 6 aa, Artificial Sequence
  NLS variant
SAKRRR

SEQ ID NO: 14070 - protein, 6 aa, Artificial Sequence
  NLS variant
SDKKKK

SEQ ID NO: 14071 - protein, 6 aa, Artificial Sequence
  NLS variant
SEKKRR

SEQ ID NO: 14072 - protein, 6 aa, Artificial Sequence
  NLS variant
SGGKKK

SEQ ID NO: 14073 - protein, 6 aa, Artificial Sequence
  NLS variant
SGKRRR

SEQ ID NO: 14074 - protein, 6 aa, Artificial Sequence
  NLS variant
SGRERK

SEQ ID NO: 14075 - protein, 6 aa, Artificial Sequence
  NLS variant
SGSKRR

SEQ ID NO: 14076 - protein, 6 aa, Artificial Sequence
  NLS variant
SHKKRK

SEQ ID NO: 14077 - protein, 5 aa, Artificial Sequence
  NLS variant
SHKRR

SEQ ID NO: 14078 - protein, 16 aa, Artificial Sequence
  NLS variant
SIAKKKKVEKEEDETV

SEQ ID NO: 14079 - protein, 6 aa, Artificial Sequence
  NLS variant
SILKKK

SEQ ID NO: 14080 - protein, 48 aa, Artificial Sequence
  NLS variant
SKFYRVNNYVVYNHQEAAKYENHTENALLLYMACTHASNPVYATLKIR

SEQ ID NO: 14081 - protein, 6 aa, Artificial Sequence
  NLS variant
SKKAPR

SEQ ID NO: 14082 - protein, 6 aa, Artificial Sequence
  NLS variant
SKKEPR

SEQ ID NO: 14083 - protein, 7 aa, Artificial Sequence
  NLS variant
SKKKKKL

SEQ ID NO: 14084 - protein, 7 aa, Artificial Sequence
  NLS variant
SKKKKSK

SEQ ID NO: 14085 - protein, 6 aa, Artificial Sequence
  NLS variant
SKKKRR

SEQ ID NO: 14086 - protein, 6 aa, Artificial Sequence
  NLS variant
SKKQKE

SEQ ID NO: 14087 - protein, 6 aa, Artificial Sequence
  NLS variant
SKKQKL

SEQ ID NO: 14088 - protein, 6 aa, Artificial Sequence
  NLS variant
SKKQKT

SEQ ID NO: 14089 - protein, 6 aa, Artificial Sequence
  NLS variant
SKKRAR

SEQ ID NO: 14090 - protein, 6 aa, Artificial Sequence
  NLS variant
SKKRGR

SEQ ID NO: 14091 - protein, 6 aa, Artificial Sequence
  NLS variant
SKKRIR

SEQ ID NO: 14092 - protein, 6 aa, Artificial Sequence
  NLS variant
SKKRKP

SEQ ID NO: 14093 - protein, 29 aa, Artificial Sequence
  NLS variant
SKKRKRPHCFETNPSVRKRQQNRLLRKLR

SEQ ID NO: 14094 - protein, 6 aa, Artificial Sequence
  NLS variant
SKKRKS

SEQ ID NO: 14095 - protein, 6 aa, Artificial Sequence
  NLS variant
SKKRKT

SEQ ID NO: 14096 - protein, 6 aa, Artificial Sequence
  NLS variant
SKKRPL

SEQ ID NO: 14097 - protein, 6 aa, Artificial Sequence
  NLS variant
SKKRPQ

SEQ ID NO: 14098 - protein, 6 aa, Artificial Sequence
  NLS variant
SKKRPR

SEQ ID NO: 14099 - protein, 6 aa, Artificial Sequence
  NLS variant
SKKRRK

SEQ ID NO: 14100 - protein, 7 aa, Artificial Sequence
  NLS variant
SKKRRRR

SEQ ID NO: 14101 - protein, 6 aa, Artificial Sequence
  NLS variant
SKKRRT

SEQ ID NO: 14102 - protein, 8 aa, Artificial Sequence
  NLS variant
SKKSKSKR

SEQ ID NO: 14103 - protein, 6 aa, Artificial Sequence
  NLS variant
SKKSRK

SEQ ID NO: 14104 - protein, 8 aa, Artificial Sequence
  NLS variant
SKKVTAKK

SEQ ID NO: 14105 - protein, 6 aa, Artificial Sequence
  NLS variant
SKPKKK

SEQ ID NO: 14106 - protein, 6 aa, Artificial Sequence
  NLS variant
SKPSKK

SEQ ID NO: 14107 - protein, 6 aa, Artificial Sequence
  NLS variant
SKRERR

SEQ ID NO: 14108 - protein, 7 aa, Artificial Sequence
  NLS variant
SKRKKKK

SEQ ID NO: 14109 - protein, 6 aa, Artificial Sequence
  NLS variant
SKRKPK

SEQ ID NO: 14110 - protein, 6 aa, Artificial Sequence
  NLS variant
SKRKRK

SEQ ID NO: 14111 - protein, 6 aa, Artificial Sequence
  NLS variant
SKRKRS

SEQ ID NO: 14112 - protein, 12 aa, Artificial Sequence
  NLS variant
SKRKTKISRKTR

SEQ ID NO: 14113 - protein, 6 aa, Artificial Sequence
  NLS variant
SKRQRK

SEQ ID NO: 14114 - protein, 6 aa, Artificial Sequence
  NLS variant
SKRRFQ

SEQ ID NO: 14115 - protein, 6 aa, Artificial Sequence
  NLS variant
SKRRKT

SEQ ID NO: 14116 - protein, 8 aa, Artificial Sequence
  NLS variant
SKRRRRDE

SEQ ID NO: 14117 - protein, 6 aa, Artificial Sequence
  NLS variant
SKRVKP

SEQ ID NO: 14118 - protein, 6 aa, Artificial Sequence
  NLS variant
SKRVKT

SEQ ID NO: 14119 - protein, 5 aa, Artificial Sequence
  NLS variant
SKVKR

SEQ ID NO: 14120 - protein, 6 aa, Artificial Sequence
  NLS variant
SLKRKR

SEQ ID NO: 14121 - protein, 6 aa, Artificial Sequence
  NLS variant
SLRKRS

SEQ ID NO: 14122 - protein, 6 aa, Artificial Sequence
  NLS variant
SNKEKK

SEQ ID NO: 14123 - protein, 6 aa, Artificial Sequence
  NLS variant
SNKRPR

SEQ ID NO: 14124 - protein, 7 aa, Artificial Sequence
  NLS variant
SPKKKKK

SEQ ID NO: 14125 - protein, 6 aa, Artificial Sequence
  NLS variant
SPKKKS

SEQ ID NO: 14126 - protein, 6 aa, Artificial Sequence
  NLS variant
SPKKSK

SEQ ID NO: 14127 - protein, 6 aa, Artificial Sequence
  NLS variant
SPKRPR

SEQ ID NO: 14128 - protein, 6 aa, Artificial Sequence
  NLS variant
SPKRQR

SEQ ID NO: 14129 - protein, 6 aa, Artificial Sequence
  NLS variant
SPKSKR

SEQ ID NO: 14130 - protein, 6 aa, Artificial Sequence
  NLS variant
SPPKRR

SEQ ID NO: 14131 - protein, 6 aa, Artificial Sequence
  NLS variant
SPRKGR

SEQ ID NO: 14132 - protein, 6 aa, Artificial Sequence
  NLS variant
SPRKRG

SEQ ID NO: 14133 - protein, 6 aa, Artificial Sequence
  NLS variant
SPRKRR

SEQ ID NO: 14134 - protein, 6 aa, Artificial Sequence
  NLS variant
SPSKRR

SEQ ID NO: 14135 - protein, 7 aa, Artificial Sequence
  NLS variant
SPSPRRR

SEQ ID NO: 14136 - protein, 6 aa, Artificial Sequence
  NLS variant
SPVKRK

SEQ ID NO: 14137 - protein, 6 aa, Artificial Sequence
  NLS variant
SPVKRR

SEQ ID NO: 14138 - protein, 7 aa, Artificial Sequence
  NLS variant
SQKKKKK

SEQ ID NO: 14139 - protein, 6 aa, Artificial Sequence
  NLS variant
SQKRKK

SEQ ID NO: 14140 - protein, 6 aa, Artificial Sequence
  NLS variant
SQKRRR

SEQ ID NO: 14141 - protein, 6 aa, Artificial Sequence
  NLS variant
SQRSKR

SEQ ID NO: 14142 - protein, 6 aa, Artificial Sequence
  NLS variant
SQSKKK

SEQ ID NO: 14143 - protein, 6 aa, Artificial Sequence
  NLS variant
SRARRR

SEQ ID NO: 14144 - protein, 17 aa, Artificial Sequence
  NLS variant
SRCAGSERQKHKRKKLP

SEQ ID NO: 14145 - protein, 6 aa, Artificial Sequence
  NLS variant
SRGGKK

SEQ ID NO: 14146 - protein, 6 aa, Artificial Sequence
  NLS variant
SRGKKP

SEQ ID NO: 14147 - protein, 6 aa, Artificial Sequence
  NLS variant
SRGRPR

SEQ ID NO: 14148 - protein, 5 aa, Artificial Sequence
  NLS variant
SRHDE

SEQ ID NO: 14149 - protein, 6 aa, Artificial Sequence
  NLS variant
SRHRRR

SEQ ID NO: 14150 - protein, 6 aa, Artificial Sequence
  NLS variant
SRKARR

SEQ ID NO: 14151 - protein, 8 aa, Artificial Sequence
  NLS variant
SRKGGMTG

SEQ ID NO: 14152 - protein, 9 aa, Artificial Sequence
  NLS variant
SRKKRAPHI

SEQ ID NO: 14153 - protein, 6 aa, Artificial Sequence
  NLS variant
SRKKRK

SEQ ID NO: 14154 - protein, 6 aa, Artificial Sequence
  NLS variant
SRKKRR

SEQ ID NO: 14155 - protein, 8 aa, Artificial Sequence
  NLS variant
SRKLLELG

SEQ ID NO: 14156 - protein, 8 aa, Artificial Sequence
  NLS variant
SRKLVSPE

SEQ ID NO: 14157 - protein, 6 aa, Artificial Sequence
  NLS variant
SRKRAR

SEQ ID NO: 14158 - protein, 6 aa, Artificial Sequence
  NLS variant
SRKRGS

SEQ ID NO: 14159 - protein, 6 aa, Artificial Sequence
  NLS variant
SRKRHR

SEQ ID NO: 14160 - protein, 6 aa, Artificial Sequence
  NLS variant
SRKRKR

SEQ ID NO: 14161 - protein, 6 aa, Artificial Sequence
  NLS variant
SRKRRQ

SEQ ID NO: 14162 - protein, 6 aa, Artificial Sequence
  NLS variant
SRKRRR

SEQ ID NO: 14163 - protein, 6 aa, Artificial Sequence
  NLS variant
SRKRRS

SEQ ID NO: 14164 - protein, 6 aa, Artificial Sequence
  NLS variant
SRKRSR

SEQ ID NO: 14165 - protein, 6 aa, Artificial Sequence
  NLS variant
SRKSPK

SEQ ID NO: 14166 - protein, 8 aa, Artificial Sequence
  NLS variant
SRRFTSPP

SEQ ID NO: 14167 - protein, 6 aa, Artificial Sequence
  NLS variant
SRRGRK

SEQ ID NO: 14168 - protein, 8 aa, Artificial Sequence
  NLS variant
SRRGRKKD

SEQ ID NO: 14169 - protein, 8 aa, Artificial Sequence
  NLS variant
SRRMLSNR

SEQ ID NO: 14170 - protein, 21 aa, Artificial Sequence
  NLS variant
SRRQRISSNTTDSPRHTHGTR

SEQ ID NO: 14171 - protein, 6 aa, Artificial Sequence
  NLS variant
SRRRPR

SEQ ID NO: 14172 - protein, 6 aa, Artificial Sequence
  NLS variant
SRRRSP

SEQ ID NO: 14173 - protein, 6 aa, Artificial Sequence
  NLS variant
SRSKRR

SEQ ID NO: 14174 - protein, 6 aa, Artificial Sequence
  NLS variant
SRTRRR

SEQ ID NO: 14175 - protein, 6 aa, Artificial Sequence
  NLS variant
SSHKRK

SEQ ID NO: 14176 - protein, 6 aa, Artificial Sequence
  NLS variant
SSKKRK

SEQ ID NO: 14177 - protein, 6 aa, Artificial Sequence
  NLS variant
SSKSKR

SEQ ID NO: 14178 - protein, 7 aa, Artificial Sequence
  NLS variant
SSSRRSR

SEQ ID NO: 14179 - protein, 6 aa, Artificial Sequence
  NLS variant
STKKRA

SEQ ID NO: 14180 - protein, 6 aa, Artificial Sequence
  NLS variant
STKRKK

SEQ ID NO: 14181 - protein, 6 aa, Artificial Sequence
  NLS variant
STKRRK

SEQ ID NO: 14182 - protein, 6 aa, Artificial Sequence
  NLS variant
STSKRK

SEQ ID NO: 14183 - protein, 6 aa, Artificial Sequence
  NLS variant
SVQRKK

SEQ ID NO: 14184 - protein, 16 aa, Artificial Sequence
  NLS variant
SYVKTVPNRTRTYIKL

SEQ ID NO: 14185 - protein, 6 aa, Artificial Sequence
  NLS variant
TAQKRK

SEQ ID NO: 14186 - protein, 6 aa, Artificial Sequence
  NLS variant
TASKRK

SEQ ID NO: 14187 - protein, 12 aa, Artificial Sequence
  NLS variant
TGKNEAKKRKIA

SEQ ID NO: 14188 - protein, 6 aa, Artificial Sequence
  NLS variant
TGKRKK

SEQ ID NO: 14189 - protein, 6 aa, Artificial Sequence
  NLS variant
TGKRKR

SEQ ID NO: 14190 - protein, 5 aa, Artificial Sequence
  NLS variant
TGRKK

SEQ ID NO: 14191 - protein, 5 aa, Artificial Sequence
  NLS variant
THKRI

SEQ ID NO: 14192 - protein, 5 aa, Artificial Sequence
  NLS variant
THKRK

SEQ ID NO: 14193 - protein, 6 aa, Artificial Sequence
  NLS variant
TIGKKK

SEQ ID NO: 14194 - protein, 5 aa, Artificial Sequence
  NLS variant
TIKKK

SEQ ID NO: 14195 - protein, 6 aa, Artificial Sequence
  NLS variant
TKKRER

SEQ ID NO: 14196 - protein, 8 aa, Artificial Sequence
  NLS variant
TKKRERDE

SEQ ID NO: 14197 - protein, 6 aa, Artificial Sequence
  NLS variant
TKKRKR

SEQ ID NO: 14198 - protein, 6 aa, Artificial Sequence
  NLS variant
TKKRKV

SEQ ID NO: 14199 - protein, 6 aa, Artificial Sequence
  NLS variant
TKKRVK

SEQ ID NO: 14200 - protein, 204 aa, Artificial Sequence
  NLS variant
TKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRK

SEQ ID NO: 14201 - protein, 6 aa, Artificial Sequence
  NLS variant
TKQKRK

SEQ ID NO: 14202 - protein, 5 aa, Artificial Sequence
  NLS variant
TKRHK

SEQ ID NO: 14203 - protein, 5 aa, Artificial Sequence
  NLS variant
TKRKG

SEQ ID NO: 14204 - protein, 6 aa, Artificial Sequence
  NLS variant
TKRKKS

SEQ ID NO: 14205 - protein, 6 aa, Artificial Sequence
  NLS variant
TKRKPK

SEQ ID NO: 14206 - protein, 6 aa, Artificial Sequence
  NLS variant
TKRKRV

SEQ ID NO: 14207 - protein, 6 aa, Artificial Sequence
  NLS variant
TKRKTK

SEQ ID NO: 14208 - protein, 6 aa, Artificial Sequence
  NLS variant
TKRPKS

SEQ ID NO: 14209 - protein, 5 aa, Artificial Sequence
  NLS variant
TKRPR

SEQ ID NO: 14210 - protein, 6 aa, Artificial Sequence
  NLS variant
TKRQRR

SEQ ID NO: 14211 - protein, 6 aa, Artificial Sequence
  NLS variant
TKRRKK

SEQ ID NO: 14212 - protein, 7 aa, Artificial Sequence
  NLS variant
TLRLKAK

SEQ ID NO: 14213 - protein, 30 aa, Artificial Sequence
  NLS variant
TLSPASSPSSVSCPVIPASTDESPGSALNI

SEQ ID NO: 14214 - protein, 6 aa, Artificial Sequence
  NLS variant
TPKKHR

SEQ ID NO: 14215 - protein, 6 aa, Artificial Sequence
  NLS variant
TPKKVK

SEQ ID NO: 14216 - protein, 6 aa, Artificial Sequence
  NLS variant
TPPRRR

SEQ ID NO: 14217 - protein, 7 aa, Artificial Sequence
  NLS variant
TPRSRPR

SEQ ID NO: 14218 - protein, 6 aa, Artificial Sequence
  NLS variant
TPSRRR

SEQ ID NO: 14219 - protein, 6 aa, Artificial Sequence
  NLS variant
TRKRKG

SEQ ID NO: 14220 - protein, 6 aa, Artificial Sequence
  NLS variant
TRKRRR

SEQ ID NO: 14221 - protein, 6 aa, Artificial Sequence
  NLS variant
TRRKRR

SEQ ID NO: 14222 - protein, 17 aa, Artificial Sequence
  NLS variant
TRSAGCRKGKHKRKKLP

SEQ ID NO: 14223 - protein, 6 aa, Artificial Sequence
  NLS variant
TSKKTK

SEQ ID NO: 14224 - protein, 6 aa, Artificial Sequence
  NLS variant
TSKRKT

SEQ ID NO: 14225 - protein, 6 aa, Artificial Sequence
  NLS variant
TSPKKK

SEQ ID NO: 14226 - protein, 8 aa, Artificial Sequence
  NLS variant
TSTAQKRK

SEQ ID NO: 14227 - protein, 6 aa, Artificial Sequence
  NLS variant
TTKKRS

SEQ ID NO: 14228 - protein, 6 aa, Artificial Sequence
  NLS variant
VAKKAK

SEQ ID NO: 14229 - protein, 6 aa, Artificial Sequence
  NLS variant
VEKRRR

SEQ ID NO: 14230 - protein, 6 aa, Artificial Sequence
  NLS variant
VGRKRK

SEQ ID NO: 14231 - protein, 6 aa, Artificial Sequence
  NLS variant
VGRKRR

SEQ ID NO: 14232 - protein, 6 aa, Artificial Sequence
  NLS variant
VKAKKK

SEQ ID NO: 14233 - protein, 5 aa, Artificial Sequence
  NLS variant
VKEHH

SEQ ID NO: 14234 - protein, 8 aa, Artificial Sequence
  NLS variant
VKKAHIET

SEQ ID NO: 14235 - protein, 6 aa, Artificial Sequence
  NLS variant
VKKKRR

SEQ ID NO: 14236 - protein, 6 aa, Artificial Sequence
  NLS variant
VKKPKI

SEQ ID NO: 14237 - protein, 6 aa, Artificial Sequence
  NLS variant
VKKRKK

SEQ ID NO: 14238 - protein, 6 aa, Artificial Sequence
  NLS variant
VKKRKP

SEQ ID NO: 14239 - protein, 6 aa, Artificial Sequence
  NLS variant
VKKRRR

SEQ ID NO: 14240 - protein, 6 aa, Artificial Sequence
  NLS variant
VKPKTK

SEQ ID NO: 14241 - protein, 6 aa, Artificial Sequence
  NLS variant
VKQKRK

SEQ ID NO: 14242 - protein, 6 aa, Artificial Sequence
  NLS variant
VKRGRG

SEQ ID NO: 14243 - protein, 6 aa, Artificial Sequence
  NLS variant
VKRKAD

SEQ ID NO: 14244 - protein, 8 aa, Artificial Sequence
  NLS variant
VKRMLSNR

SEQ ID NO: 14245 - protein, 5 aa, Artificial Sequence
  NLS variant
VKRPR

SEQ ID NO: 14246 - protein, 6 aa, Artificial Sequence
  NLS variant
VKRRRM

SEQ ID NO: 14247 - protein, 6 aa, Artificial Sequence
  NLS variant
VLKRKR

SEQ ID NO: 14248 - protein, 8 aa, Artificial Sequence
  NLS variant
VNFSEFSK

SEQ ID NO: 14249 - protein, 6 aa, Artificial Sequence
  NLS variant
VRGRGR

SEQ ID NO: 14250 - protein, 7 aa, Artificial Sequence
  NLS variant
VRKKRKP

SEQ ID NO: 14251 - protein, 7 aa, Artificial Sequence
  NLS variant
VRKKRKT

SEQ ID NO: 14252 - protein, 6 aa, Artificial Sequence
  NLS variant
VRKRRR

SEQ ID NO: 14253 - protein, 6 aa, Artificial Sequence
  NLS variant
VRKRVQ

SEQ ID NO: 14254 - protein, 8 aa, Artificial Sequence
  NLS variant
VRRAKYDE

SEQ ID NO: 14255 - protein, 8 aa, Artificial Sequence
  NLS variant
VRRARALE

SEQ ID NO: 14256 - protein, 8 aa, Artificial Sequence
  NLS variant
VSGSKRRS

SEQ ID NO: 14257 - protein, 12 aa, Artificial Sequence
  NLS variant
VSKKQRTGKKIH

SEQ ID NO: 14258 - protein, 8 aa, Artificial Sequence
  NLS variant
WKKQLVAA

SEQ ID NO: 14259 - protein, 6 aa, Artificial Sequence
  NLS variant
WKKRKK

SEQ ID NO: 14260 - protein, 5 aa, Artificial Sequence
  NLS variant
WKQKK

SEQ ID NO: 14261 - protein, 5 aa, Artificial Sequence
  NLS variant
WKQRK

SEQ ID NO: 14262 - protein, 46 aa, Artificial Sequence
  NLS variant
WPLQSEGAAALVTKECQRLAAQGARPEAPKRKWAKDGGDAPSPSKR

SEQ ID NO: 14263 - protein, 7 aa, Artificial Sequence
  NLS variant
WRDASPP

SEQ ID NO: 14264 - protein, 8 aa, Artificial Sequence
  NLS variant
WRKPEKEQ

SEQ ID NO: 14265 - protein, 5 aa, Artificial Sequence
  NLS variant
WRKTK

SEQ ID NO: 14266 - protein, 7 aa, Artificial Sequence
  NLS variant
YEKAKKK

SEQ ID NO: 14267 - protein, 6 aa, Artificial Sequence
  NLS variant
YGKKKK

SEQ ID NO: 14268 - protein, 5 aa, Artificial Sequence
  NLS variant
YHKNR

SEQ ID NO: 14269 - protein, 6 aa, Artificial Sequence
  NLS variant
YKKKKK

SEQ ID NO: 14270 - protein, 5 aa, Artificial Sequence
  NLS variant
YKRKA

SEQ ID NO: 14271 - protein, 14 aa, Artificial Sequence
  NLS variant
YLRPVKKPKIRRKK

SEQ ID NO: 14272 - protein, 5 aa, Artificial Sequence
  NLS variant
YNKRK

SEQ ID NO: 14273 - protein, 8 aa, Artificial Sequence
  NLS variant
YRKLECLS

SEQ ID NO: 14274 - RNA, 4530 nt, Artificial Sequence; identical to SEQ ID NO: 418
  Cas9 mRNA product

SEQ ID NO: 14275 - RNA, 4484 nt, Artificial Sequence; identical to SEQ ID NO: 420
  Cas9 mRNA product

SEQ ID NO: 14276 - RNA, 4517 nt, Artificial Sequence; identical to SEQ ID NO: 422
  Cas9 mRNA product

SEQ ID NO: 14277 - RNA, 4581 nt, Artificial Sequence; identical to SEQ ID NO: 421
  Cas9 mRNA product

SEQ ID NO: 14278 - RNA, 4466 nt, Artificial Sequence; identical to SEQ ID NO: 423
  Cas9 mRNA product

SEQ ID NO: 14279 - RNA, 4452 nt, Artificial Sequence; identical to SEQ ID NO: 424
  Cas9 mRNA product

SEQ ID NO: 14280 - RNA, 4439 nt, Artificial Sequence; identical to SEQ ID NO: 416
  Cas9 mRNA product

SEQ ID NO: 14281 - RNA, 4420 nt, Artificial Sequence; identical to SEQ ID NO: 417
  Cas9 mRNA product

SEQ ID NO: 14282 - RNA, 4433 nt, Artificial Sequence; identical to SEQ ID NO: 425
  Cas9 mRNA product

SEQ ID NO: 14283 - RNA, 4599 nt, Artificial Sequence
  Cas9 mRNA product
gggagaggcgcugccuacggagguggcagccaucuccuucucggcaucaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 14284 - RNA, 4489 nt, Artificial Sequence
  Cas9 mRNA product
gggagagucccgcagucggcguccagcggcucugcuuguucgugugugugucguugcaggccuuauucaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 14285 - RNA, 4508 nt, Artificial Sequence
  Cas9 mRNA product
gggagaguccgcucagccagguugcagaagcggcuuagcguguguccuaaucuucucucugcguguagguaggccugugccgcaaacaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 14286 - RNA, 4785 nt, Artificial Sequence
  Cas9 mRNA product
gggagagucccgcagucggcguccagcggcucugcuuguucgugugugugucguugcaggccuuauucaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14287 - RNA, 4882 nt, Artificial Sequence
  Cas9 mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 14288 - RNA, 4566 nt, Artificial Sequence
  Cas9 mRNA product
gggagagcggcucggccauuuugucccagucaguccggaggcugcggcugcagaaguaccgccugcggaguaacugcaaagaagcuuaccauggacuauaaggaccacgacggagacuacaaggaucaugauauugauuacaaagacgaugacgauaagauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaaugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 14289 - RNA, 4623 nt, Artificial Sequence
  Cpf1 variant mRNA product
gggagacuuucccauucuguagcagaauuugguguugccuguggucuuggucccgcggagaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14290 - RNA, 4354 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14291 - RNA, 4631 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14292 - RNA, 4335 nt, Artificial Sequence
  Cpf1 variant mRNA product
gggagagucccgcagucggcguccagcggcucugcuuguucgugugugugucguugcaggccuuauucaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14293 - RNA, 4484 nt, Artificial Sequence
  Cpf1 variant mRNA product
gggagaguccgcucagccagguugcagaagcggcuuagcguguguccuaaucuucucucugcguguagguaggccugugccgcaaacaagcuuaccaugacacaguucgagggcuuuaccaaccuguaucaggugagcaagacacugcgguuugagcugaucccacagggcaagacccugaagcacauccaggagcagggcuucaucgaggaggacaaggcccgcaaugaucacuacaaggagcugaagcccaucaucgaucggaucuacaagaccuaugccgaccagugccugcagcuggugcagcuggauugggagaaccugagcgccgccaucgacuccuauagaaaggagaaaaccgaggagacaaggaacgcccugaucgaggagcaggccacauaucgcaaugccauccacgacuacuucaucggccggacagacaaccugaccgaugccaucaauaagagacacgccgagaucuacaagggccuguucaaggccgagcuguuuaauggcaaggugcugaagcagcugggcaccgugaccacaaccgagcacgagaacgcccugcugcggagcuucgacaaguuuacaaccuacuucuccggcuuuuaugagaacaggaagaacguguucagcgccgaggauaucagcacagccaucccacaccgcaucgugcaggacaacuuccccaaguuuaaggagaauugucacaucuucacacgccugaucaccgccgugcccagccugcgggagcacuuugagaacgugaagaaggccaucggcaucuucgugagcaccuccaucgaggagguguuuuccuucccuuuuuauaaccagcugcugacacagacccagaucgaccuguauaaccagcugcugggaggaaucucucgggaggcaggcaccgagaagaucaagggccugaacgaggugcugaaucuggccauccagaagaaugaugagacagcccacaucaucgccucccugccacacagauucaucccccuguuuaagcagauccuguccgauaggaacacccugucuuucauccuggaggaguuuaagagcgacgaggaagugauccaguccuucugcaaguacaagacacugcugagaaacgagaacgugcuggagacagccgaggcccuguuuaacgagcugaacagcaucgaccugacacacaucuucaucagccacaagaagcuggagacaaucagcagcgcccugugcgaccacugggauacacugaggaaugcccuguaugagcggagaaucuccgagcugacaggcaagaucaccaagucugccaaggagaaggugcagcgcagccugaagcacgaggauaucaaccugcaggagaucaucucugccgcaggcaaggagcugagcgaggccuucaagcagaaaaccagcgagauccugucccacgcacacgccgcccuggaucagccacugccuacaacccugaagaagcaggaggagaaggagauccugaagucucagcuggacagccugcugggccuguaccaccuccuggacugguuugccguggaugaguccaacgagguggaccccgaguucucugcccggcugaccggcaucaagcuggagauggagccuucucugagcuucuacaacaaggccagaaauuaugccaccaagaagcccuacuccguggagaaguucaagcugaacuuucagaugccuacacuggccucuggcugggacgugaauaaggagaagaacaauggcgccauccuguuugugaagaacggccuguacuaucugggcaucaugccaaagcagaagggcagguauaaggcccugagcuucgagcccacagagaaaaccagcgagggcuuugauaagauguacuaugacuacuucccugaugccgccaagaugaucccaaagugcagcacccagcugaaggccgugacagcccacuuucagacccacacaacccccauccugcuguccaacaauuucaucgagccucuggagaucacaaaggagaucuacgaccugaacaauccugagaaggagccaaagaaguuucagacagccuacgccaagaaaaccggcgaccagaagggcuacagagaggcccugugcaaguggaucgacuucacaagggauuuucuguccaaguauaccaagacaaccucuaucgaucugucuagccugcggccauccucucaguauaaggaccugggcgaguacuaugccgagcugaauccccugcuguaccacaucagcuuccagagaaucgccgagaaggagaucauggaugccguggagacaggcaagcuguaccuguuccagaucuauaacaaggacuuugccaagggccaccacggcaagccuaaucugcacacacuguauuggaccggccuguuuucuccagagaaccuggccaagacaagcaucaagcugaauggccaggccgagcuguucuaccgcccuaaguccaggaugaagaggauggcacaccggcugggagagaagaugcugaacaagaagcugaaggaucagaaaaccccaauccccgacacccuguaccaggagcuguacgacuaugugaaucacagacugucccacgaccugucugaugaggccagggcccugcugcccaacgugaucaccaaggaggugucucacgagaucaucaaggauaggcgcuuuaccagcgacaaguucuuuuuccacgugccuaucacacugaacuaucaggccgccaauuccccaucuaaguucaaccagagggugaaugccuaccugaaggagcaccccgagacaccuaucaucggcaucgaucggggcgagagaaaccugaucuauaucacagugaucgacuccaccggcaagauccuggagcagcggagccugaacaccauccagcaguuugauuaccagaagaagcuggacaacagggagaaggagaggguggcagcaaggcaggccuggucuguggugggcacaaucaaggaucugaagcagggcuaucugagccaggucauccacgagaucguggaccugaugauccacuaccaggccgugguggugcuggagaaccugaauuucggcuuuaagagcaagaggaccggcaucgccgagaaggccguguaccagcaguucgagaagaugcugaucgauaagcugaauugccuggugcugaaggacuauccagcagagaaagugggaggcgugcugaacccauaccagcugacagaccaguucaccuccuuugccaagaugggcacccagucuggcuuccuguuuuacgugccugccccauauacaucuaagaucgauccccugaccggcuucguggaccccuucguguggaaaaccaucaagaaucacgagagccgcaagcacuuccuggagggcuucgacuuucugcacuacgacgugaaaaccggcgacuucauccugcacuuuaagaugaacagaaaucuguccuuccagaggggccugcccggcuuuaugccugcaugggauaucguguucgagaagaacgagacacaguuugacgccaagggcaccccuuucaucgccggcaagagaaucgugccagugaucgagaaucacagauucaccggcagauaccgggaccuguauccugccaacgagcugaucgcccugcuggaggagaagggcaucguguucagggauggcuccaacauccugccaaagcugcuggagaaugacgauucucacgccaucgacaccaugguggcccugauccgcagcgugcugcagaugcggaacuccaaugccgccacaggcgaggacuauaucaacagccccgugcgcgaucugaauggcgugugcuucgacucccgguuucagaacccagaguggcccauggacgccgaugccaauggcgccuaccacaucgcccugaagggccagcugcugcugaaucaccugaaggagagcaaggaucugaagcugcagaacggcaucuccaaucaggacuggcuggccuacauccaggagcugcgcaacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14294 - protein, 955 aa, Artificial Sequence
  Cas13d variant__Anaerobic digester metagenome 15706__AdmCas13d-HA
MNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTNDYPYDVPDYA

SEQ ID NO: 14295 - protein, 955 aa, Artificial Sequence
  Cas13d variant__Anaerobic digester metagenome 15706__dAdmCas13d-HA
MNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVAQSIMANDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYANQVTALNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTNDYPYDVPDYA

SEQ ID NO: 14296 - protein, 979 aa, Artificial Sequence
  Cas13d variant__Anaerobic digester metagenome 15706__NLS-AdmCas13d-NLS-HA
MSPKKKRKVEASNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTNDGSGPKKKRKVAAAYPYDVPDYA

SEQ ID NO: 14297 - protein, 979 aa, Artificial Sequence
  Cas13d variant__Anaerobic digester metagenome 15706__NLS-dAdmCas13d-NLS-HA
MSPKKKRKVEASNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVAQSIMANDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYANQVTALNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTNDGSGPKKKRKVAAAYPYDVPDYA

SEQ ID NO: 14298 - protein, 963 aa, Artificial Sequence
  Cas13d variant__Eubacterium siraeum DSM15702__EsCas13d-HA
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQKYPYDVPDYA

SEQ ID NO: 14299 - protein, 963 aa, Artificial Sequence
  Cas13d variant__Eubacterium siraeum DSM15702__dEsCas13d-HA
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLAHWCVASEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFANTVCALNAIRNININIKEIKEVENYFALYHYLIQKHLENRFADKKVERDTGDFISKLEEHKTYCKDFVKAYCTPFGYNLVRYKNLTIDGLFDKNYPGKDDSDEQKYPYDVPDYA

SEQ ID NO: 14300 - protein, 987 aa, Artificial Sequence
  Cas13d variant__Eubacterium siraeum DSM15702__NLS-EsCas13d-NLS-HA
MSPKKKRKVEASGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQKGSGPKKKRKVAAAYPYDVPDYA

SEQ ID NO: 14301 - protein, 987 aa, Artificial Sequence
  Cas13d variant__Eubacterium siraeum DSM15702__NLS-dEsCas13d-NLS-HA
MSPKKKRKVEASGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLAHWCVASEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFANTVCALNAIRNININIKEIKEVENYFALYHYLIQKHLENRFADKKVERDTGDFISKLEEHKTYCKDFVKAYCTPFGYNLVRYKNLTIDGLFDKNYPGKDDSDEQKGSGPKKKRKVAAAYPYDVPDYA

SEQ ID NO: 14302 - protein, 1133 aa, Artificial Sequence
  Cas13d variant__Eubacterium siraeum DSM15702__PspCas13b-NES(HIV)-3xHA
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMKGSLQLPPLERLTLGSSYPYDVPDYAYPYDVPDYAYPYDVPDYA

SEQ ID NO: 14303 - protein, 915 aa, Artificial Sequence
  Cas13d variant__Gut metagenome assembly P1E0-k21__P1E0Cas13d-HA
MEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLRQFCAHDSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYRNAVDHLNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAEYPYDVPDYA

SEQ ID NO: 14304 - protein, 915 aa, Artificial Sequence
  Cas13d variant__Gut metagenome assembly P1E0-k21__dP1E0Cas13d-HA
MEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLAQFCAADSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYANAVDALNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAEYPYDVPDYA

SEQ ID NO: 14305 - protein, 939 aa, Artificial Sequence
  Cas13d variant__Gut metagenome assembly P1E0-k21__NLS-P1E0Cas13d-NLS-HA
MSPKKKRKVEASEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLRQFCAHDSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYRNAVDHLNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAEGSGPKKKRKVAAAYPYDVPDYA

SEQ ID NO: 14306 - protein, 939 aa, Artificial Sequence
  Cas13d variant__Gut metagenome assembly P1E0-k21__NLS-dP1E0Cas13d-NLS-HA
MSPKKKRKVEASEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLAQFCAADSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYANAVDALNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAEGSGPKKKRKVAAAYPYDVPDYA

SEQ ID NO: 14307 - protein, 953 aa, Artificial Sequence
  Cas13d variant__Ruminococcus albus __RaCas13d-HA
MAKKSKGMSLREKRELEKQKRIQKAAVNSVNDTPEKTEEANVVSVNVRTSAENKHSKKSAAKALGLKSGLVIGDELYLTSFGRGNEAKLEKKISGDTVEKLGIGAFEVAERDESTLTLESGRIKDKTARPKDPRHITVDTQGKFKEDMLGIRSVLEKKIFGKTFDDNIHVQLAYNILDVEKIMAQYVSDIVYMLHNTDKTERNDNLMGYMSIRNTYKTFCDTSNLPDDTKQKVENQKREFDKIIKSGRLGYFGEAFMVNSGNSTKLRPEKEIYHIFALMASLRQSYFHGYVKDTDYQGTTWAYTLEDKLKGPSHEFRETIDKIFDEGFSKISKDFGKMNKVNLQILEQMIGELYGSIERQNLTCDYYDFIQLKKHKYLGFSIKRLRETMLETTPAECYKAECYNSERQKLYKLIDFLIYDLYYNRKPARIEEIVDKLRESVNDEEKESIYSVEAKYVYESLSKVLDKSLKNSVSGETIKDLQKRYDDETANRIWDISQHSISGNVNCFCKLIYIMTLMLDGKEINDLLTTLVNKFDNIASFIDVMDELGLEHSFTDNYKMFADSKAICLDLQFINSFARMSKIDDEKSKRQLFRDALVILDIGNKDETWINNYLDSDIFKLDKEGNKLKGARHDFRNFIANNVIKSSRFKYLVKYSSADGMIKLKTNEKLIGFVLDKLPETQIDRYYESCGLDNAVVDKKVRIEKLSGLIRDMKFDDFSGVKTSNKAGDNDKQDKAKYQAIISLYLMVLYQIVKNMIYVNSRYVIAFHCLERDFGMYGKDFGKYYQGCRKLTDHFIEEKYMKEGKLGCNKKVGRYLKNNISCCTDGLINTYRNQVDHFAVVRKIGNYAAYIKSIGSWFELYHYVIQRIVFDEYRFALNNTESNYKNSIIKHHTYCKDMVKALNTPFGYDLPRYKNLSIGDLFDRNNYLNKTKESIDANSSIDSQYPYDVPDYA

SEQ ID NO: 14308 - protein, 977 aa, Artificial Sequence
  Cas13d variant__Ruminococcus albus __NLS-RaCas13d-NLS-HA
MSPKKKRKVEASAKKSKGMSLREKRELEKQKRIQKAAVNSVNDTPEKTEEANVVSVNVRTSAENKHSKKSAAKALGLKSGLVIGDELYLTSFGRGNEAKLEKKISGDTVEKLGIGAFEVAERDESTLTLESGRIKDKTARPKDPRHITVDTQGKFKEDMLGIRSVLEKKIFGKTFDDNIHVQLAYNILDVEKIMAQYVSDIVYMLHNTDKTERNDNLMGYMSIRNTYKTFCDTSNLPDDTKQKVENQKREFDKIIKSGRLGYFGEAFMVNSGNSTKLRPEKEIYHIFALMASLRQSYFHGYVKDTDYQGTTWAYTLEDKLKGPSHEFRETIDKIFDEGFSKISKDFGKMNKVNLQILEQMIGELYGSIERQNLTCDYYDFIQLKKHKYLGFSIKRLRETMLETTPAECYKAECYNSERQKLYKLIDFLIYDLYYNRKPARIEEIVDKLRESVNDEEKESIYSVEAKYVYESLSKVLDKSLKNSVSGETIKDLQKRYDDETANRIWDISQHSISGNVNCFCKLIYIMTLMLDGKEINDLLTTLVNKFDNIASFIDVMDELGLEHSFTDNYKMFADSKAICLDLQFINSFARMSKIDDEKSKRQLFRDALVILDIGNKDETWINNYLDSDIFKLDKEGNKLKGARHDFRNFIANNVIKSSRFKYLVKYSSADGMIKLKTNEKLIGFVLDKLPETQIDRYYESCGLDNAVVDKKVRIEKLSGLIRDMKFDDFSGVKTSNKAGDNDKQDKAKYQAIISLYLMVLYQIVKNMIYVNSRYVIAFHCLERDFGMYGKDFGKYYQGCRKLTDHFIEEKYMKEGKLGCNKKVGRYLKNNISCCTDGLINTYRNQVDHFAVVRKIGNYAAYIKSIGSWFELYHYVIQRIVFDEYRFALNNTESNYKNSIIKHHTYCKDMVKALNTPFGYDLPRYKNLSIGDLFDRNNYLNKTKESIDANSSIDSQGSGPKKKRKVAAAYPYDVPDYA

SEQ ID NO: 14309 - protein, 942 aa, Artificial Sequence
  Cas13d variant__Ruminococcus flavefaciens FD1__RffCas13d-HA
MKKKMSLREKREAEKQAKKAAYSAASKNTDSKPAEKKAETPKPAEIISDNSRNKTAVKAAGLKSTIISGDKLYMTSFGKGNAAVIEQKIDINDYSFSAMKDTPSLEVDKAESKEISFSSHHPFVKNDKLTTYNPLYGGKDNPEKPVGRDMLGLKDKLEERYFGCTFNDNLHIQIIYNILDIEKILAVHSANITTALDHMVDEDDEKYLNSDYIGYMNTINTYDVFMDPSKNSSLSPKDRKNIDNSRAKFEKLLSTKRLGYFGFDYDANGKDKKKNEEIKKRLYHLTAFAGQLRQWSFHSAGNYPRTWLYKLDSLDKEYLDTLDHYFDKRFNDINDDFVTKNATNLYILKEVFPEANFKDIADLYYDFIVIKSHKNMGFSIKKLREKMLECDGADRIKEQDMDSVRSKLYKLIDFCIFKYYHEFPELSEKNVDILRAAVSDTKKDNLYSDEAARLWSIFKEKFLGFCDKIVVWVTGEHEKDITSVIDKDAYRNRSNVSYFSKLMYAMCFFLDGKEINDLLTTLINKFDNIANQIKTAKELGINTAFVKNYDFFNHSEKYVDELNIVKNIARMKKPSSNAKKAMYHDALTILGIPEDMDEKALDEELDLILEKKTDPVTGKPLKGKNPLRNFIANNVIENSRFIYLIKFCNPENVRKIVNNTKVTEFVLKRIPDAQIERYYKSCTDSEMNPPTEKKITELAGKLKDMNFGNFRNVRQSAKENMEKERFKAVIGLYLTVVYRVVKNLVDVNSRYIMAFHSLERDSQLYNVSVDNDYLALTDTLVKEGDNSRSRYLAGNKRLRDCVKQDIDNAKKWFVSDKYNSITKYRNNVAHLTAVRNCAEFIGDITKIDSYFALYHYLIQRQLAKGLDHERSGFDRNYPQYAPLFKWHTYVKDVVKALNAPFGYNIPRFKNLSIDALFDRNEIKKNDGEKKSDDYPYDVPDYA

SEQ ID NO: 14310 - protein, 966 aa, Artificial Sequence
  Cas13d variant__Ruminococcus flavefaciens FD1__NLS-RffCas13d-NLS-HA
MSPKKKRKVEASKKKMSLREKREAEKQAKKAAYSAASKNTDSKPAEKKAETPKPAEIISDNSRNKTAVKAAGLKSTIISGDKLYMTSFGKGNAAVIEQKIDINDYSFSAMKDTPSLEVDKAESKEISFSSHHPFVKNDKLTTYNPLYGGKDNPEKPVGRDMLGLKDKLEERYFGCTFNDNLHIQIIYNILDIEKILAVHSANITTALDHMVDEDDEKYLNSDYIGYMNTINTYDVFMDPSKNSSLSPKDRKNIDNSRAKFEKLLSTKRLGYFGFDYDANGKDKKKNEEIKKRLYHLTAFAGQLRQWSFHSAGNYPRTWLYKLDSLDKEYLDTLDHYFDKRFNDINDDFVTKNATNLYILKEVFPEANFKDIADLYYDFIVIKSHKNMGFSIKKLREKMLECDGADRIKEQDMDSVRSKLYKLIDFCIFKYYHEFPELSEKNVDILRAAVSDTKKDNLYSDEAARLWSIFKEKFLGFCDKIVVWVTGEHEKDITSVIDKDAYRNRSNVSYFSKLMYAMCFFLDGKEINDLLTTLINKFDNIANQIKTAKELGINTAFVKNYDFFNHSEKYVDELNIVKNIARMKKPSSNAKKAMYHDALTILGIPEDMDEKALDEELDLILEKKTDPVTGKPLKGKNPLRNFIANNVIENSRFIYLIKFCNPENVRKIVNNTKVTEFVLKRIPDAQIERYYKSCTDSEMNPPTEKKITELAGKLKDMNFGNFRNVRQSAKENMEKERFKAVIGLYLTVVYRVVKNLVDVNSRYIMAFHSLERDSQLYNVSVDNDYLALTDTLVKEGDNSRSRYLAGNKRLRDCVKQDIDNAKKWFVSDKYNSITKYRNNVAHLTAVRNCAEFIGDITKIDSYFALYHYLIQRQLAKGLDHERSGFDRNYPQYAPLFKWHTYVKDVVKALNAPFGYNIPRFKNLSIDALFDRNEIKKNDGEKKSDDGSGPKKKRKVAAAYPYDVPDYA

SEQ ID NO: 14311 - protein, 976 aa, Artificial Sequence
  Cas13d variant__Ruminococcus flavefaciens XPD3002__RfxCas13d-HA
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSYPYDVPDYA

SEQ ID NO: 14312 - protein, 976 aa, Artificial Sequence
  Cas13d variant__Ruminococcus flavefaciens XPD3002__dRfxCas13d-HA
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLAHWVVANNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFANKAVALEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSYPYDVPDYA

SEQ ID NO: 14313 - protein, 1000 aa, Artificial Sequence
  Cas13d variant__Ruminococcus flavefaciens XPD3002__NLS-RfxCas13d-NLS-HA (CasRx)
MSPKKKRKVEASIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVAAAYPYDVPDYA

SEQ ID NO: 14314 - protein, 1000 aa, Artificial Sequence
  Cas13d variant__Ruminococcus flavefaciens XPD3002__NLS-dRfxCas13d-NLS-HA (dCasRx)
MSPKKKRKVEASIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLAHWVVANNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFANKAVALEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVAAAYPYDVPDYA

SEQ ID NO: 14315 - protein, 1126 aa, Artificial Sequence
  Cas13d variant__Ruminococcus flavefaciens XPD3002__hnRNPa1-dCasRx-HA
MGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRFSPKKKRKVEASIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLAHWVVANNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFANKAVALEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVAAAYPYDVPDYA

SEQ ID NO: 14316 - protein, 928 aa, Artificial Sequence
  Cas13d variant__Uncultured Ruminococcus sp. __UrCas13d-HA
MAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIRQCVFHDKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEKYPYDVPDYA

SEQ ID NO: 14317 - protein, 928 aa, Artificial Sequence
  Cas13d variant__Uncultured Ruminococcus sp. __dUrCas13d-HA
MAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIAQCVFADKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYANCIAALTVVRELKEYIGDICTVDSYFSIYHYVMQRCITKRENDTKQEEKIKYEDDLLKNHGYTKDFVKALNSPFGYNIPRFKNLSIEQLFDRNEYLTEKYPYDVPDYA

SEQ ID NO: 14318 - protein, 952 aa, Artificial Sequence
  Cas13d variant__Uncultured Ruminococcus sp. __NLS-UrCas13d-NLS-HA
MSPKKKRKVEASAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIRQCVFHDKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEKGSGPKKKRKVAAAYPYDVPDYA

SEQ ID NO: 14319 - protein, 952 aa, Artificial Sequence
  Cas13d variant__Uncultured Ruminococcus sp. __NLS-dUrCas13d-NLS-HA
MSPKKKRKVEASAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIAQCVFADKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYANCIAALTVVRELKEYIGDICTVDSYFSIYHYVMQRCITKRENDTKQEEKIKYEDDLLKNHGYTKDFVKALNSPFGYNIPRFKNLSIEQLFDRNEYLTEKGSGPKKKRKVAAAYPYDVPDYA

SEQ ID NO: 14320 - protein, 1424 aa, Artificial Sequence
  Cas13d variant__Leptotrichia wadei __NLS-LwCas13a-msfGFP
MKRPAATKKAGQAKKKKGSMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYK

SEQ ID NO: 14321 - protein, 1424 aa, Artificial Sequence
  Cas13d variant__Leptotrichia wadei __NLS-dLwCas13a-msfGFP
MKRPAATKKAGQAKKKKGSMKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIAHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIANYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEGGGGSGGGGSGGGGSVSKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITLGMDELYK

SEQ ID NO: 14322 - RNA, 2868 nt, Artificial Sequence
  Cas13d variant__Anaerobic digester metagenome 15706__AdmCas13d-HA
augaacaacaagcgcaagaccaaggccaaggccgcgggccucaagagcguguucuucgaccagaagcaggccguccugaccacguucgccaaggggaacaacucccagaucgagaagaagguggugaacagcgaggucaaggaccugcggcagcccccggccuucgaccuggagcucaaggagaagaccuucuacaucuccggcaagaacaacaucaacaccagccgcgagaacccccuggccuccgcgagccugccccucuccaagcggcagcgcauccgggccgagcgcaucaagcgggcccgcgaggagaaccggcccuaccacaacgugaagcgcgugggggaggacgaccugcgggccaaggcggaccuggagaagcacuacuucggcaaggaguacagcgacaaccucaagauccagaucaucuacaacauccuggacaucaacaagaucaucuccccguacaucaacgacaucgucuacagcaugaacaaccuggcccgcaacgacgaguacaucgacgggaagaucgacgugaucggcucccucagcuccaccacggacuacagcuccuucaugagccccaacaaggaccuggagaaggagaagaaguucuccuuccaccgggagaacuacaagaaguucguggaggccagcaagcccuacaugcgcuacuacggcaaggucuucauccgggacgugaagaaguccaagcugagcaccgggaagggcgagaagaucgaggugauguaccgcagcgacgaggagaucuucaccaucuuccagauccucuccuacguccggcagagcaucaugcacaacgacaucgggaacaaguccagcauccuggccaucgagaaguaccccgcccgcuucgugggcuuccuguccgaccuccugaagaccaagacgaacgacgugaaccggauguucaucgacaacaacagccagaccaacuucuggguccuguucuccaucuucgggcuccaggaccacaccagcggcgcggacaagaucugccgcaacuucuacgacuucgugaucaaggccgacuccaagaaccugggcuucagccugaagaagauccgggagcucaugcuggaccugccgaacgccaacaugcuccgcgaccaccaguucgacaccgugcgcuccaaguucuacacgcugcuggacuucaucaucuaccagcacuaccucgaggagaagucccggaucgacaacauggucgagaagcugcgcaugacccugaaggaggaggagaaggaggugcucuacgccgccgaggcgaagaucguguggaacgccaucggggccaaggucaucaacaagcuggugcccaugaugaacggcgacgcccugaaggagaucaagcggaagaaccgcgaccggaagcucccccagagcgugaucgccaccguccaggugaacagcgacgcgaacgucuucuccgggcugaucuacuuccugacccucuuccuggacggcaaggagaucaacgagauggugagcaaccugaucacgaaguucgagaacaucgacucccuccugcacguggaccgcgagaucuacaagagcgacgagaaggaccuggaccucgagaucgagaagcuggcccuguucuucaagggcgucgugcggcccaacgccaagaccgacaccggggccggcgagaucuccaagagcuucagcaucuuccaguccgccgagcgcaucaucgaggagcucaaguucaucaagaacgugacccggauggacaacgagaucuucccgagcgagggggucuuccuggacgcggccaacgugcugggcgugcgcggggacgacuucgacuucuccaacgaguucgucggcgacgaccugcacagcgacgccaacaagaagaucaucaacaagaucaacggcacgaaggaggaccggaaccuccgcaacuucaucaucaacaacguggugaagucccggcgcuuccaguacaucgcccggcacaugaacacccacuacgucaagcagcuggcgaacaacgagacccugaaccgcuucgugcucaacaagaugggggacgccaagaucaucaaccgguacuacgagagcaucuccggcaacacccccaacaucgaggugcgcagccagaucgacuaccuggucaagcggcugcgcuccuucagcuucgaggaccucaacgacgugaagcagaaggugcgccccgggacgaacgaguccaucgagaaggagaagaagaaggcccuggucggccugugccucaccauccaguaccugguguacaagaaccuggugaacaucaacgcccgguacaccaccgccuucuacugccucgagcgcgacagcaagcugaagggguucggcgucgacguguggcgggacuucgaguccuacacggcgcugaccaaccacuucaucaaggagggcuaccuccccgugcgcaaggccgagauccugcgggccaaccugaagcaccucgacugcgaggacggguucaaguacuaccgcaaccaggucacccaccugaacgccauccggguggccuacaaguacaucaacgagaucaagagcgugcacuccuacuucgcgcuguaccacuacaucaugcagcgccaccucuacgacagccugcaggccaaggccaaggacuccagcggcuucgucaucgacgcccugaagaaguccuucgagcacaagaucuacagcaaggaccuccugcacgugcugcacagcccguucggguacaacaccgcccgguacaagaaccucuccaucgaggcgcuguucgacaagaacgagagccgccccgaggugaacccccuguccacgaacgacuaccccuacgacgucccggacuacgccuga

SEQ ID NO: 14323 - RNA, 2868 nt, Artificial Sequence
  Cas13d variant__Anaerobic digester metagenome 15706__dAdmCas13d-HA
augaacaacaagcgcaagaccaaggccaaggccgcgggccucaagagcguguucuucgaccagaagcaggccguccugaccacguucgccaaggggaacaacucccagaucgagaagaagguggugaacagcgaggucaaggaccugcggcagcccccggccuucgaccuggagcucaaggagaagaccuucuacaucuccggcaagaacaacaucaacaccagccgcgagaacccccuggccuccgcgagccugccccucuccaagcggcagcgcauccgggccgagcgcaucaagcgggcccgcgaggagaaccggcccuaccacaacgugaagcgcgugggggaggacgaccugcgggccaaggcggaccuggagaagcacuacuucggcaaggaguacagcgacaaccucaagauccagaucaucuacaacauccuggacaucaacaagaucaucuccccguacaucaacgacaucgucuacagcaugaacaaccuggcccgcaacgacgaguacaucgacgggaagaucgacgugaucggcucccucagcuccaccacggacuacagcuccuucaugagccccaacaaggaccuggagaaggagaagaaguucuccuuccaccgggagaacuacaagaaguucguggaggccagcaagcccuacaugcgcuacuacggcaaggucuucauccgggacgugaagaaguccaagcugagcaccgggaagggcgagaagaucgaggugauguaccgcagcgacgaggagaucuucaccaucuuccagauccucuccuacgucgcccagagcaucauggccaacgacaucgggaacaaguccagcauccuggcgaucgagaaguaccccgcccgguucgugggcuuccuguccgaccuccugaagaccaagacgaacgacgugaaccgcauguucaucgacaacaacagccagaccaacuucuggguccuguucuccaucuucgggcuccaggaccacaccagcggcgccgacaagaucugccggaacuucuacgacuucgugaucaaggccgacuccaagaaccugggcuucagccugaagaagauccgcgagcucaugcuggaccugccgaacgccaacaugcuccgggaccaccaguucgacaccgugcgcuccaaguucuacacgcugcuggacuucaucaucuaccagcacuaccucgaggagaagucccgcaucgacaacauggucgagaagcugcggaugacccugaaggaggaggagaaggaggugcucuacgcggccgaggccaagaucguguggaacgccaucggggccaaggucaucaacaagcuggugcccaugaugaacggcgacgcgcugaaggagaucaagcgcaagaaccgggaccgcaagcucccccagagcgugaucgccaccguccaggugaacagcgacgccaacgucuucuccgggcugaucuacuuccugacccucuuccuggacggcaaggagaucaacgagauggugagcaaccugaucacgaaguucgagaacaucgacucccuccugcacguggaccgggagaucuacaagagcgacgagaaggaccuggaccucgagaucgagaagcuggcccuguucuucaagggcgucgugcgccccaacgccaagaccgacaccggggcgggcgagaucuccaagagcuucagcaucuuccaguccgccgagcggaucaucgaggagcucaaguucaucaagaacgugacccgcauggacaacgagaucuucccgagcgagggggucuuccuggacgccgccaacgugcugggcgugcgcggggacgacuucgacuucuccaacgaguucgucggcgacgaccugcacagcgacgcgaacaagaagaucaucaacaagaucaacggcacgaaggaggaccggaaccuccggaacuucaucaucaacaacguggugaagucccgccgguuccaguacaucgcccgccacaugaacacccacuacgucaagcagcuggccaacaacgagacccugaaccgguucgugcucaacaagaugggggacgccaagaucaucaaccgcuacuacgagagcaucuccggcaacacccccaacaucgaggugcggagccagaucgacuaccuggucaagcgccugcgguccuucagcuucgaggaccucaacgacgugaagcagaaggugcgccccgggacgaacgaguccaucgagaaggagaagaagaaggcccuggucggccugugccucaccauccaguaccugguguacaagaaccuggugaacaucaacgcgcgcuacaccaccgccuucuacugccucgagcgggacagcaagcugaagggguucggcgucgacguguggcgcgacuucgaguccuacacggcccugaccaaccacuucaucaaggagggcuaccuccccgugcggaaggccgagauccugcgcgccaaccugaagcaccucgacugcgaggacggguucaaguacuacgcgaaccaggucaccgcccugaacgccauccggguggccuacaaguacaucaacgagaucaagagcgugcacuccuacuucgcccuguaccacuacaucaugcagcgccaccucuacgacagccugcaggcgaaggccaaggacuccagcggcuucgucaucgacgcccugaagaaguccuucgagcacaagaucuacagcaaggaccuccugcacgugcugcacagcccguucggguacaacaccgcccgguacaagaaccucuccaucgaggcgcuguucgacaagaacgagagccgccccgaggugaacccccuguccacgaacgacuaccccuacgacgucccggacuacgccuga

SEQ ID NO: 14324 - RNA, 2940 nt, Artificial Sequence
  Cas13d variant__Anaerobic digester metagenome 15706__NLS-AdmCas13d-NLS-HA
augagccccaagaagaagcgcaagguggaggccuccaacaacaagcggaagaccaaggccaaggcggccggccucaagagcgucuucuucgaccagaagcaggccgugcugaccacguucgccaaggggaacaacucccagaucgagaagaagguggucaacagcgaggugaaggaccugcgccagccgcccgccuucgaccuggagcucaaggagaagaccuucuacaucuccggcaagaacaacaucaacaccagccgggagaacccccuggcguccgccagccugccccucuccaagcgccagcggauccgcgccgagcggaucaagcgcgcccgggaggagaaccgcccguaccacaacgugaagcgggucggggaggacgaccugcgcgcgaaggccgaccuggagaagcacuacuucggcaaggaguacagcgacaaccucaagauccagaucaucuacaacauccuggacaucaacaagaucaucucccccuacaucaacgacaucguguacagcaugaacaaccuggcccggaacgacgaguacaucgacgggaagaucgacgugaucggcucccucagcuccaccacggacuacagcuccuucaugagccccaacaaggaccuggagaaggagaagaaguucuccuuccaccgcgagaacuacaagaaguucgucgaggccagcaagcccuacaugcgguacuacggcaagguguucauccgcgacgugaagaaguccaagcugagcaccgggaagggcgagaagaucgaggucauguaccggagcgacgaggagaucuucaccaucuuccagauccucuccuacgugcgccagagcaucaugcacaacgacaucgggaacaaguccagcauccuggccaucgagaaguacccggcgcgguucgugggcuuccuguccgaccuccugaagaccaagacgaacgacgucaaccgcauguucaucgacaacaacagccagaccaacuucugggugcuguucuccaucuucgggcuccaggaccacaccagcggcgccgacaagaucugccggaacuucuacgacuucgugaucaaggccgacuccaagaaccugggcuucagccugaagaagauccgcgagcucaugcuggaccugcccaacgccaacaugcuccgcgaccaccaguucgacaccguccgguccaaguucuacacgcugcuggacuucaucaucuaccagcacuaccucgaggagaagucccgcaucgacaacaugguggagaagcugcggaugacccugaaggaggaggagaaggaggugcucuacgccgcggaggccaagaucgucuggaacgccaucggggccaaggugaucaacaagcuggugcccaugaugaacggcgacgcccugaaggagaucaagcgcaagaaccgggaccgcaagcucccccagagcgucaucgcgaccgugcaggucaacagcgacgccaacguguucuccgggcugaucuacuuccugacccucuuccuggacggcaaggagaucaacgagauggugagcaaccugaucacgaaguucgagaacaucgacucccuccugcacgucgaccgggagaucuacaagagcgacgagaaggaccuggaccucgagaucgagaagcuggcccuguucuucaagggcguggugcgcccgaacgccaagaccgacaccggggccggcgagaucagcaaguccuucagcaucuuccaguccgcggagcggaucaucgaggagcucaaguucaucaagaacgucacccgcauggacaacgagaucuuccccagcgaggggguguuccuggacgccgccaacgugcugggcguccgcggggacgacuucgacuucuccaacgaguucgugggcgacgaccugcacagcgacgccaacaagaagaucaucaacaagaucaacggcacgaaggaggaccggaaccuccggaacuucaucaucaacaacguggucaagucccgccgguuccaguacaucgcgcgccacaugaacacccacuacgugaagcagcuggccaacaacgagacccugaaccgguucgugcucaacaagaugggggacgccaagaucaucaaccgcuacuacgagagcaucuccggcaacacccccaacaucgagguccggagccagaucgacuaccuggugaagcgccugcgcuccuucagcuucgaggaccucaacgacgugaagcagaagguccggcccgggacgaacgaguccaucgagaaggagaagaagaaggcccuggugggccugugccucaccauccaguaccugguguacaagaaccuggucaacaucaacgcccgcuacaccaccgcguucuacugccucgagcgggacagcaagcugaagggguucggcguggacguguggcgcgacuucgaguccuacacggcccugaccaaccacuucaucaaggagggcuaccucccgguccggaaggccgagauccugcgcgccaaccugaagcaccucgacugcgaggacggguucaaguacuaccggaaccaggugacccaccugaacgccauccgcguggcguacaaguacaucaacgagaucaagagcguccacuccuacuucgcccuguaccacuacaucaugcagcggcaccucuacgacagccugcaggccaaggccaaggacagcuccggcuucgugaucgacgcccugaagaaguccuucgagcacaagaucuacagcaaggaccuccugcacgugcugcacagccccuucggguacaacaccgcgcgcuacaagaaccucuccaucgaggcccuguucgacaagaacgagagccggcccgaggucaacccccuguccacgaacgacggcagcgggccgaagaagaagcgcaagguggccgccgcguaccccuacgacgugcccgacuacgccuga

SEQ ID NO: 14325 - RNA, 2940 nt, Artificial Sequence
  Cas13d variant__Anaerobic digester metagenome 15706__NLS-dAdmCas13d-NLS-HA
augagccccaagaagaagcgcaagguggaggccuccaacaacaagcggaagaccaaggccaaggcggccggccucaagagcgucuucuucgaccagaagcaggccgugcugaccacguucgccaaggggaacaacucccagaucgagaagaagguggucaacagcgaggugaaggaccugcgccagccgcccgccuucgaccuggagcucaaggagaagaccuucuacaucuccggcaagaacaacaucaacaccagccgggagaacccccuggcguccgccagccugccccucuccaagcgccagcggauccgcgccgagcggaucaagcgcgcccgggaggagaaccgcccguaccacaacgugaagcgggucggggaggacgaccugcgcgcgaaggccgaccuggagaagcacuacuucggcaaggaguacagcgacaaccucaagauccagaucaucuacaacauccuggacaucaacaagaucaucucccccuacaucaacgacaucguguacagcaugaacaaccuggcccggaacgacgaguacaucgacgggaagaucgacgugaucggcucccucagcuccaccacggacuacagcuccuucaugagccccaacaaggaccuggagaaggagaagaaguucuccuuccaccgcgagaacuacaagaaguucgucgaggccagcaagcccuacaugcgguacuacggcaagguguucauccgcgacgugaagaaguccaagcugagcaccgggaagggcgagaagaucgaggucauguaccggagcgacgaggagaucuucaccaucuuccagauccucuccuacguggcccagagcaucauggcgaacgacaucgggaacaaguccagcauccuggccaucgagaaguacccggcccgcuucgugggcuuccuguccgaccuccugaagaccaagacgaacgacgucaaccggauguucaucgacaacaacagccagaccaacuucugggugcuguucuccaucuucgggcuccaggaccacaccagcggcgccgacaagaucugccgcaacuucuacgacuucgugaucaaggccgacuccaagaaccugggcuucagccugaagaagauccgggagcucaugcuggaccugcccaacgcgaacaugcuccgcgaccaccaguucgacaccguccgcuccaaguucuacacgcugcuggacuucaucaucuaccagcacuaccucgaggagaagucccggaucgacaacaugguggagaagcugcgcaugacccugaaggaggaggagaaggaggugcucuacgccgccgaggccaagaucgucuggaacgccaucggggcgaaggugaucaacaagcuggugcccaugaugaacggcgacgcccugaaggagaucaagcggaagaaccgcgaccggaagcucccccagagcgucaucgccaccgugcaggucaacagcgacgccaacguguucuccgggcugaucuacuuccugacccucuuccuggacggcaaggagaucaacgagauggugagcaaccugaucacgaaguucgagaacaucgacucccuccugcacgucgaccgcgagaucuacaagagcgacgagaaggaccuggaccucgagaucgagaagcuggcccuguucuucaagggcguggugcggccgaacgcgaagaccgacaccggggccggcgagaucagcaaguccuucagcaucuuccaguccgccgagcgcaucaucgaggagcucaaguucaucaagaacgucacccggauggacaacgagaucuuccccagcgaggggguguuccuggacgccgcgaacgugcugggcguccgcggggacgacuucgacuucuccaacgaguucgugggcgacgaccugcacagcgacgccaacaagaagaucaucaacaagaucaacggcacgaaggaggaccggaaccuccgcaacuucaucaucaacaacguggucaagucccggcgcuuccaguacaucgcccggcacaugaacacccacuacgugaagcagcuggccaacaacgagacccugaaccgcuucgugcucaacaagaugggggacgccaagaucaucaaccgguacuacgagagcaucuccggcaacacccccaacaucgagguccgcagccagaucgacuaccuggugaagcggcugcgcuccuucagcuucgaggaccucaacgacgugaagcagaagguccgccccgggacgaacgaguccaucgagaaggagaagaagaaggcgcuggugggccugugccucaccauccaguaccugguguacaagaaccuggucaacaucaacgcccgguacaccaccgccuucuacugccucgagcgcgacagcaagcugaagggguucggcguggacguguggcgggacuucgaguccuacacggcccugaccaaccacuucaucaaggagggcuaccucccgguccgcaaggccgagauccugcgggcgaaccugaagcaccucgacugcgaggacggguucaaguacuacgccaaccaggugaccgcccugaacgccauccgcguggccuacaaguacaucaacgagaucaagagcguccacuccuacuucgcgcuguaccacuacaucaugcagcggcaccucuacgacagccugcaggccaaggccaaggacagcuccggcuucgugaucgacgcccugaagaaguccuucgagcacaagaucuacagcaaggaccuccugcacgugcugcacagccccuucggguacaacaccgcgcgcuacaagaaccucuccaucgaggcccuguucgacaagaacgagagccggcccgaggucaacccccuguccacgaacgacggcagcgggccgaagaagaagcgcaagguggccgccgccuaccccuacgacgugcccgacuacgcguga

SEQ ID NO: 14326 - RNA, 2892 nt, Artificial Sequence
  Cas13d variant__Eubacterium siraeum DSM15702__EsCas13d-HA
augggcaagaagauccacgcccgcgaccugcgggagcagcgcaagaccgaccggaccgagaaguucgccgaccagaacaagaagcgcgaggcggagcgggccgugcccaagaaggacgccgccgucagcgugaaguccgugagcuccgucagcuccaagaaggacaacgugaccaagagcauggccaaggcggccggggugaaguccgucuucgccgugggcaacacgguguacaugaccagcuucgggcgcggcaacgacgccguccucgagcagaagaucguggacaccucccacgagccgcugaacaucgacgaccccgcguaccagcugaacguggucacgaugaacggguacagcgugaccggccaccggggcgagaccguguccgccgucaccgacaacccccuccgccgguucaacgggcgcaagaaggacgagcccgagcagagcgugccgacggacaugcugugccugaagcccacccucgagaagaaguucuucggcaaggaguucgacgacaacauccacauccagcugaucuacaacauccuggacaucgagaagauccucgccguguacuccaccaacgccaucuacgcccugaacaacaugagcgcggacgagaacaucgagaacuccgacuucuucaugaagcggaccacggacgagaccuucgacgacuucgagaagaagaaggagagcaccaacucccgcgagaaggccgacuucgacgccuucgagaaguucaucgggaacuaccggcuggccuacuucgccgacgcguucuacgucaacaagaagaaccccaagggcaaggccaagaacgugcuccgcgaggacaaggagcuguacagcgugcugacccucaucgggaagcugcggcacuggugcguccacuccgaggagggccgcgccgaguucuggcuguacaagcucgacgagcugaaggacgacuucaagaacgugcuggacguggucuacaaccggcccguggaggagaucaacaaccgcuucaucgagaacaacaaggucaacauccagauccucggcagcguguacaagaacacggacaucgccgagcuggugcggagcuacuacgaguuccugaucaccaagaaguacaagaacaugggguucuccaucaagaagcuccgcgagagcaugcuggagggcaagggguacgccgacaaggaguacgacuccguccggaacaagcuguaccagaugaccgacuucauccucuacaccggcuacaucaacgaggacagcgaccgcgcggacgaccuggugaacacgcugcgcuccagccucaaggaggacgacaagaccaccguguacugcaaggaggccgacuaccuguggaagaaguaccgggaguccauccgcgaggucgccgacgcccuggacggcgacaacaucaagaagcucagcaaguccaacaucgagauccaggaggacaagcugcggaagugcuucaucagcuacgccgacuccgugagcgaguucaccaagcugaucuaccuccugacgcgcuuccuguccgggaaggagaucaacgaccucgugaccacccugaucaacaaguucgacaacauccggagcuuccuggagaucauggacgagcucggccuggaccgcaccuucacggcggaguacuccuucuucgaggggagcaccaaguaccuggccgagcucgucgagcugaacuccuucgucaagagcugcuccuucgacaucaacgccaagcggaccauguaccgcgacgcccuggacauccucggcaucgagagcgacaagaccgaggaggacaucgagaagaugaucgacaacauccugcagaucgacgcgaacggggacaagaagcugaagaagaacaacggccugcggaacuucaucgccagcaacgugaucgacuccaaccgcuucaaguaccucgugcgguacggcaacccgaagaagauccgcgagacggccaagugcaagcccgccgugcgguucgugcugaacgagauccccgacgcccagaucgagcgcuacuacgaggcgugcugccccaagaacaccgcccugugcagcgccaacaagcggcgcgagaagcucgccgacaugaucgccgagaucaaguucgagaacuucuccgacgcggggaacuaccagaaggccaacgucaccagccggaccuccgaggccgagaucaagcgcaagaaccaggccaucauccggcuguaccugacggugauguacaucaugcucaagaaccuggugaacgucaacgcccgcuacgugaucgcguuccacugcguggagcgcgacaccaagcuguacgccgagagcggccucgaggucgggaacaucgagaagaacaagaccaaccugaccauggccgugaugggcgugaagcuggagaacgggaucaucaagaccgaguucgacaaguccuucgccgagaacgcggccaaccgguaccuccgcaacgcccggugguacaagcugauccuggacaaccucaagaaguccgagcgcgccgucgugaacgaguuccggaacacggugugccaccugaacgccauccgcaacaucaacaucaacaucaaggagaucaaggaggucgagaacuacuucgcgcuguaccacuaccucauccagaagcaccuggagaaccgguucgccgacaagaagguggagcgcgacaccggcgacuucaucagcaagcuggaggagcacaagaccuacugcaaggacuucgugaaggccuacugcaccccguucggcuacaaccucguccgguacaagaaccugacgaucgacgggcuguucgacaagaacuaccccggcaaggacgacagcgacgagcagaaguaccccuacgacgugcccgacuacgccuga

SEQ ID NO: 14327 - RNA, 2892 nt, Artificial Sequence
  Cas13d variant__Eubacterium siraeum DSM15702__dEsCas13d-HA
augggcaagaagauccacgcccgcgaccugcgggagcagcgcaagaccgaccggaccgagaaguucgccgaccagaacaagaagcgcgaggcggagcgggccgugcccaagaaggacgccgccgucagcgugaaguccgugagcuccgucagcuccaagaaggacaacgugaccaagagcauggccaaggcggccggggugaaguccgucuucgccgugggcaacacgguguacaugaccagcuucgggcgcggcaacgacgccguccucgagcagaagaucguggacaccucccacgagccgcugaacaucgacgaccccgcguaccagcugaacguggucacgaugaacggguacagcgugaccggccaccggggcgagaccguguccgccgucaccgacaacccccuccgccgguucaacgggcgcaagaaggacgagcccgagcagagcgugccgacggacaugcugugccugaagcccacccucgagaagaaguucuucggcaaggaguucgacgacaacauccacauccagcugaucuacaacauccuggacaucgagaagauccucgccguguacuccaccaacgccaucuacgcccugaacaacaugagcgcggacgagaacaucgagaacuccgacuucuucaugaagcggaccacggacgagaccuucgacgacuucgagaagaagaaggagagcaccaacucccgcgagaaggccgacuucgacgccuucgagaaguucaucgggaacuaccggcuggccuacuucgccgacgcguucuacgucaacaagaagaaccccaagggcaaggccaagaacgugcuccgcgaggacaaggagcuguacagcgugcugacccucaucgggaagcuggcccacuggugcgucgccuccgaggagggccgggccgaguucuggcuguacaagcucgacgagcugaaggacgacuucaagaacgugcuggacguggucuacaaccgccccguggaggagaucaacaaccgguucaucgagaacaacaaggucaacauccagauccucggcagcguguacaagaacacggacaucgcggagcuggugcgcagcuacuacgaguuccugaucaccaagaaguacaagaacaugggguucuccaucaagaagcuccgggagagcaugcuggagggcaagggguacgccgacaaggaguacgacuccguccgcaacaagcuguaccagaugaccgacuucauccucuacaccggcuacaucaacgaggacagcgaccgggccgacgaccuggugaacacgcugcgcuccagccucaaggaggacgacaagaccaccguguacugcaaggaggccgacuaccuguggaagaaguaccgcgaguccauccgggaggucgccgacgcgcuggacggcgacaacaucaagaagcucagcaaguccaacaucgagauccaggaggacaagcugcgcaagugcuucaucagcuacgccgacuccgugagcgaguucaccaagcugaucuaccuccugacgcgguuccuguccgggaaggagaucaacgaccucgugaccacccugaucaacaaguucgacaacauccgcagcuuccuggagaucauggacgagcucggccuggaccggaccuucacggccgaguacuccuucuucgaggggagcaccaaguaccuggccgagcucgucgagcugaacuccuucgucaagagcugcuccuucgacaucaacgcgaagcgcaccauguaccgggacgcccuggacauccucggcaucgagagcgacaagaccgaggaggacaucgagaagaugaucgacaacauccugcagaucgacgccaacggggacaagaagcugaagaagaacaacggccugcgcaacuucaucgccagcaacgugaucgacuccaaccgguucaaguaccucgugcgcuacggcaacccgaagaagauccgggagacggccaagugcaagcccgcggugcgcuucgugcugaacgagauccccgacgcccagaucgagcgguacuacgaggccugcugccccaagaacaccgcccugugcagcgccaacaagcgccgggagaagcucgcggacaugaucgccgagaucaaguucgagaacuucuccgacgccgggaacuaccagaaggccaacgucaccagccgcaccuccgaggccgagaucaagcggaagaaccaggcgaucauccgccuguaccugacggugauguacaucaugcucaagaaccuggugaacgucaacgcccgguacgugaucgccuuccacugcguggagcgcgacaccaagcuguacgccgagagcggccucgaggucgggaacaucgagaagaacaagaccaaccugaccauggcggugaugggcgugaagcuggagaacgggaucaucaagaccgaguucgacaaguccuucgccgagaacgccgccaaccgcuaccuccggaacgcccgcugguacaagcugauccuggacaaccucaagaaguccgagcgggcggucgugaacgaguucgccaacacggugugcgcccugaacgccauccgcaacaucaacaucaacaucaaggagaucaaggaggucgagaacuacuucgcccuguaccacuaccucauccagaagcaccuggagaaccgguucgcggacaagaagguggagcgcgacaccggcgacuucaucagcaagcuggaggagcacaagaccuacugcaaggacuucgugaaggccuacugcaccccguucggcuacaaccucguccgguacaagaaccugacgaucgacgggcuguucgacaagaacuaccccggcaaggacgacagcgacgagcagaaguaccccuacgacgugcccgacuacgccuga

SEQ ID NO: 14328 - RNA, 2964 nt, Artificial Sequence
  Cas13d variant__Eubacterium siraeum DSM15702__NLS-EsCas13d-NLS-HA
augagccccaagaagaagcgcaagguggaggccuccggcaagaagauccacgcccgggaccugcgcgagcagcggaagaccgaccgcaccgagaaguucgcggaccagaacaagaagcgggaggccgagcgcgccgucccgaagaaggacgccgccgugagcgugaaguccgucagcuccgugagcuccaagaaggacaacgugaccaagagcauggcgaaggccgccggggucaaguccguguucgccgugggcaacacggucuacaugaccagcuucgggcggggcaacgacgcggugcucgagcagaagaucguggacaccucccacgagccccugaacaucgacgaccccgccuaccagcugaacgucgugacgaugaacggguacagcgugaccggccaccgcggcgagaccgucuccgccgugaccgacaacccccuccggcgcuucaacgggcggaagaaggacgagccggagcagagcgugcccacggacaugcugugccugaagcccacccucgagaagaaguucuucggcaaggaguucgacgacaacauccacauccagcugaucuacaacauccuggacaucgagaagauccucgccgucuacuccaccaacgccaucuacgcgcugaacaacaugagcgccgacgagaacaucgagaacuccgacuucuucaugaagcgcaccacggacgagaccuucgacgacuucgagaagaagaaggagagcaccaacucccgggagaaggccgacuucgacgccuucgagaaguucaucgggaacuaccgccuggccuacuucgcggacgccuucuacgugaacaagaagaaccccaagggcaaggccaagaacgugcuccgggaggacaaggagcuguacagcguccugacccucaucgggaagcugcgccacuggugcgugcacagcgaggagggccgggccgaguucuggcuguacaagcucgacgagcugaaggacgacuucaagaacgugcuggacgucguguacaaccgcccggucgaggagaucaacaaccgguucaucgagaacaacaaggugaacauccagauccucggcuccguguacaagaacacggacaucgccgagcugguccgcagcuacuacgaguuccugaucaccaagaaguacaagaacaugggguucuccaucaagaagcuccgggagagcaugcuggagggcaagggguacgcggacaaggaguacgacuccgugcgcaacaagcuguaccagaugaccgacuucauccucuacaccggcuacaucaacgaggacagcgaccgcgccgacgaccuggugaacacgcugcgguccagccucaaggaggacgacaagaccaccgucuacugcaaggaggccgacuaccuguggaagaaguaccgcgaguccauccgggagguggccgacgcccuggacggcgacaacaucaagaagcucagcaaguccaacaucgagauccaggaggacaagcugcgcaagugcuucaucagcuacgcggacuccgugagcgaguucaccaagcugaucuaccuccugacgcgguuccuguccgggaaggagaucaacgaccucgucaccacccugaucaacaaguucgacaacauccgcagcuuccuggagaucauggacgagcucggccuggaccggaccuucacggccgaguacuccuucuucgaggggagcaccaaguaccuggccgagcucguggagcugaacuccuucgucaagagcugcagcuucgacaucaacgccaagcgcaccauguaccgggacgcgcuggacauccucggcaucgaguccgacaagaccgaggaggacaucgagaagaugaucgacaacauccugcagaucgacgccaacggggacaagaagcugaagaagaacaacggccugcgcaacuucaucgccagcaacgugaucgacuccaaccgguucaaguaccucgugcgcuacggcaaccccaagaagauccgggagacggccaagugcaagcccgccgugcgcuucguccugaacgagauccccgacgcgcagaucgagcgguacuacgaggccugcugcccgaagaacaccgcccugugcagcgccaacaagcgccgggagaagcucgccgacaugaucgcggagaucaaguucgagaacuucuccgacgccgggaacuaccagaaggccaacgugaccagccgcaccuccgaggccgagaucaagcggaagaaccaggccaucauccgccuguaccugacggugauguacaucaugcucaagaaccuggucaacgugaacgcgcgcuacgugaucgccuuccacugcgucgagcgggacaccaagcuguacgccgagagcggccucgagguggggaacaucgagaagaacaagaccaaccugaccauggccgugaugggcgucaagcuggagaacgggaucaucaagaccgaguucgacaaguccuucgcggagaacgccgccaaccgcuaccuccggaacgcccgcugguacaagcugauccuggacaaccucaagaaguccgagcgggccguggugaacgaguuccgcaacacggucugccaccugaacgcgauccggaacaucaacaucaacaucaaggagaucaaggagguggagaacuacuucgcccuguaccacuaccucauccagaagcaccuggagaaccgcuucgccgacaagaagguggagcgggacaccggcgacuucaucagcaagcuggaggagcacaagaccuacugcaaggacuucgucaaggccuacugcacccccuucggcuacaaccucgugcgcuacaagaaccugacgaucgacgggcuguucgacaagaacuaccccggcaaggacgacagcgacgagcagaagggguccggccccaagaagaagcggaagguggccgcggccuacccguacgacguccccgacuacgccuga

SEQ ID NO: 14329 - RNA, 2964 nt, Artificial Sequence
  Cas13d variant__Eubacterium siraeum DSM15702__NLS-dEsCas13d-NLS-HA
augagccccaagaagaagcgcaagguggaggccuccggcaagaagauccacgcccgggaccugcgcgagcagcggaagaccgaccgcaccgagaaguucgcggaccagaacaagaagcgggaggccgagcgcgccgucccgaagaaggacgccgccgugagcgugaaguccgucagcuccgugagcuccaagaaggacaacgugaccaagagcauggcgaaggccgccggggucaaguccguguucgccgugggcaacacggucuacaugaccagcuucgggcggggcaacgacgcggugcucgagcagaagaucguggacaccucccacgagccccugaacaucgacgaccccgccuaccagcugaacgucgugacgaugaacggguacagcgugaccggccaccgcggcgagaccgucuccgccgugaccgacaacccccuccggcgcuucaacgggcggaagaaggacgagccggagcagagcgugcccacggacaugcugugccugaagcccacccucgagaagaaguucuucggcaaggaguucgacgacaacauccacauccagcugaucuacaacauccuggacaucgagaagauccucgccgucuacuccaccaacgccaucuacgcgcugaacaacaugagcgccgacgagaacaucgagaacuccgacuucuucaugaagcgcaccacggacgagaccuucgacgacuucgagaagaagaaggagagcaccaacucccgggagaaggccgacuucgacgccuucgagaaguucaucgggaacuaccgccuggccuacuucgcggacgccuucuacgugaacaagaagaaccccaagggcaaggccaagaacgugcuccgggaggacaaggagcuguacagcguccugacccucaucgggaagcuggcccacuggugcguggccagcgaggagggccgcgcggaguucuggcuguacaagcucgacgagcugaaggacgacuucaagaacgugcuggacgucguguacaaccggccggucgaggagaucaacaaccgcuucaucgagaacaacaaggugaacauccagauccucggcuccguguacaagaacacggacaucgccgagcugguccggagcuacuacgaguuccugaucaccaagaaguacaagaacaugggguucuccaucaagaagcuccgcgagagcaugcuggagggcaagggguacgccgacaaggaguacgacuccgugcggaacaagcuguaccagaugaccgacuucauccucuacaccggcuacaucaacgaggacagcgaccgcgccgacgaccuggugaacacgcugcgcuccagccucaaggaggacgacaagaccaccgucuacugcaaggaggccgacuaccuguggaagaaguaccgggaguccauccgcgagguggcggacgcccuggacggcgacaacaucaagaagcucagcaaguccaacaucgagauccaggaggacaagcugcggaagugcuucaucagcuacgccgacuccgugagcgaguucaccaagcugaucuaccuccugacgcgcuuccuguccgggaaggagaucaacgaccucgucaccacccugaucaacaaguucgacaacauccggagcuuccuggagaucauggacgagcucggccuggaccgcaccuucacggccgaguacuccuucuucgaggggagcaccaaguaccuggcggagcucguggagcugaacuccuucgucaagagcugcagcuucgacaucaacgccaagcggaccauguaccgcgacgcccuggacauccucggcaucgaguccgacaagaccgaggaggacaucgagaagaugaucgacaacauccugcagaucgacgccaacggggacaagaagcugaagaagaacaacggccugcggaacuucaucgccagcaacgugaucgacuccaaccgcuucaaguaccucgugcgguacggcaaccccaagaagauccgcgagacggcgaagugcaagcccgccgugcgguucguccugaacgagauccccgacgcccagaucgagcgcuacuacgaggccugcugcccgaagaacaccgcccugugcagcgcgaacaagcggcgcgagaagcucgccgacaugaucgccgagaucaaguucgagaacuucuccgacgccgggaacuaccagaaggccaacgugaccagccggaccuccgaggcggagaucaagcgcaagaaccaggccaucauccggcuguaccugacggugauguacaucaugcucaagaaccuggucaacgugaacgcccgcuacgugaucgccuuccacugcgucgagcgcgacaccaagcuguacgcggagagcggccucgagguggggaacaucgagaagaacaagaccaaccugaccauggccgugaugggcgucaagcuggagaacgggaucaucaagaccgaguucgacaaguccuucgccgagaacgccgccaaccgguaccuccgcaacgcgcggugguacaagcugauccuggacaaccucaagaaguccgagcgcgccguggugaacgaguucgccaacacggucugcgcccugaacgccauccggaacaucaacaucaacaucaaggagaucaaggagguggagaacuacuucgcgcuguaccacuaccucauccagaagcaccuggagaaccgcuucgccgacaagaagguggagcgggacaccggcgacuucaucagcaagcuggaggagcacaagaccuacugcaaggacuucgucaaggccuacugcacccccuucggcuacaaccucgugcgcuacaagaaccugacgaucgacgggcuguucgacaagaacuaccccggcaaggacgacagcgacgagcagaagggguccggccccaagaagaagcggaagguggccgccgcguacccguacgacguccccgacuacgccuga

SEQ ID NO: 14330 - RNA, 3402 nt, Artificial Sequence
  Cas13d variant__Eubacterium siraeum DSM15702__PspCas13b-NES(HIV)-3xHA
augaacauccccgcccugguggagaaccagaagaaguacuucggcaccuacagcgucauggccaugcucaacgcgcagaccgugcuggaccacauccagaagguggccgacaucgagggggagcagaacgagaacaacgagaaccugugguuccacccggucaugucccaccucuacaacgccaagaacggcuacgacaagcagcccgagaagacgauguucaucaucgagcgccugcagagcuacuuccccuuccugaagaucauggccgagaaccagcgggaguacuccaacgggaaguacaagcagaaccgcguggaggugaacagcaacgacaucuucgagguccucaagcgggccuucggcgugcugaagauguaccgcgaccugaccaaccacuacaagaccuacgaggagaagcucaacgacgggugcgaguuccugaccuccacggagcagccccugagcggcaugaucaacaacuacuacaccguggcgcuccggaacaugaacgagcgcuacggcuacaagaccgaggaccuggccuucauccaggacaagcgguucaaguucgucaaggacgccuacgggaagaagaagucccaggugaacaccggcuucuuccugagccuccaggacuacaacggggacacgcagaagaagcugcaccuguccggcguggggaucgcccuccugaucugccuguuccucgacaagcaguacaucaacaucuuccugagccgccugccgaucuucuccagcuacaacgcgcaguccgaggagcggcgcaucaucauccggagcuucggcaucaacuccaucaagcuccccaaggaccgcauccacagcgagaaguccaacaagagcgucgccauggacaugcugaacgaggugaagcggugccccgacgagcuguucaccacccucuccgccgagaagcagagccgcuuccggaucaucagcgacgaccacaacgaggugcugaugaagcgcuccagcgaccgguucgucccccugcuccugcaguacaucgacuacggcaagcuguucgaccacauccgcuuccacgugaacauggggaagcuccgguaccugcugaaggccgacaagaccugcaucgacggccagacgcgcgugcgggucaucgagcagccgcucaacggguucggccgccuggaggaggccgagaccaugcgcaagcaggagaacggcaccuucgggaacuccggcauccggauccgcgacuucgagaacaugaagcgggacgacgcgaaccccgccaacuaccccuacaucguggacaccuacacgcacuacauccuggagaacaacaagguggagauguucaucaacgacaaggaggacagcgcgccccuccugccggucaucgaggacgaccgcuacguggugaagaccauccccuccugccggaugagcacccuggagauccccgccauggccuuccacauguuccucuucggguccaagaagaccgagaagcugaucgucgacgugcacaaccgcuacaagcggcuguuccaggccaugcagaaggaggaggucacggccgagaacaucgccagcuucggcaucgccgaguccgaccucccccagaagauccuggaccugaucagcgggaacgcccacggcaaggacguggacgcguucauccgccucaccguggacgacaugcugaccgacaccgagcggcgcaucaagcgguucaaggacgaccgcaaguccauccggagcgccgacaacaagaugggcaagcgcggguucaagcagaucuccacgggcaagcuggccgacuuccuggccaaggacaucguccucuuccagccgagcgugaacgacggggagaacaagaucaccggccugaacuaccggaucaugcaguccgccaucgcgguguacgacagcggggacgacuacgaggccaagcagcaguucaagcugauguucgagaaggcccgccucaucggcaagggcaccaccgagccccaccccuuccuguacaaggucuucgcccgguccauccccgcgaacgccguggaguucuacgagcgcuaccugaucgagcggaaguucuaccucacggggcugagcaacgagaucaagaagggcaaccgcguggacgucccguucauccgccgggaccagaacaaguggaagacccccgccaugaagacccuggggcgcaucuacuccgaggaccuccccguggagcugccccggcagauguucgacaacgagaucaagagccaccucaagagccucccgcagauggagggcaucgacuucaacaacgccaacgugaccuaccugaucgccgaguacaugaagcgcguccuggacgacgacuuccagacguucuaccaguggaaccggaacuaccgcuacauggacaugcucaagggggaguacgaccggaagggcucccugcagcacugcuucaccagcguggaggagcgcgagggccuguggaaggagcgggcgucccgcaccgagcgguaccgcaagcaggccagcaacaagauccgguccaaccgccagaugcggaacgccagcuccgaggagaucgagaccauccucgacaagcgccugagcaacucccggaacgaguaccagaaguccgagaaggugauccgccgguaccgcguccaggacgcccugcuguuccugcuggccaagaagacgcucaccgagcuggcggacuucgacggggagcgguucaagcugaaggagaucaugcccgacgccgagaagggcauccucagcgagaucaugcccaugagcuucaccuucgagaagggcgggaagaaguacaccaucaccuccgagggcaugaagcugaagaacuacggggacuucuucgugcuggccagcgacaagcgcaucggcaaccuccuggagcuggugggguccgacaucgucagcaaggaggacaucauggaggaguucaacaaguacgaccagugccgccccgagaucuccagcaucguguucaaccucgagaagugggccuucgacacguacccggagcugagcgcccggguggaccgcgaggagaaggucgacuucaaguccauccugaagauccuccugaacaacaagaacaucaacaaggagcagagcgacauccugcggaagauccgcaacgcguucgaccacaacaacuaccccgacaagggcgugguggagaucaaggcccuccccgagaucgccauguccaucaagaaggccuucggggaguacgcgaucaugaagggcagccugcagcugccgccccucgagcggcugacccugggcuccagcuaccccuacgacguccccgacuacgccuacccguacgacgugcccgacuacgccuaccccuacgacgugcccgacuacgccuga

SEQ ID NO: 14331 - RNA, 2748 nt, Artificial Sequence
  Cas13d variant__Gut metagenome assembly P1E0-k21__P1E0Cas13d-HA
auggagcgcgaggugaagaagcccccgaagaagucccuggccaaggccgcgggccucaagagcaccuucgucaucagcccccaggagaaggagcuggccaugaccgccuucgggcggggcaacgacgcccugcuccagaagcgcaucguggacggggugguccgggacguggccggcgagaagcagcaguuccaggugcagcgccaggacgagucccgguuccgccugcagaacagccggcuggcggaccgcaccgucaccgccgacgacccccuccaccgggccgagacgccccgccggcagccgcugggggccggcauggaccagcugcgccggaaggcgauccucgagcagaaguacuucggccgcaccuucgacgacaacauccacauccagcugaucuacaacauccuggacauccacaagaugcucgccgugcccgccaaccacaucgugcacacccugaaccugcucgggggcuacggggagaccgacuucgucggcaugcugcccgccgggcugcccuacgacaagcuccggguggugaagaagaagaacggcgacaccgucgacaucaaggccgacaucgcggccuacgccaagcgcccgcagcuggccuaccugggcgccgcguucuacgacgugacccccgggaaguccaagcgggacgccgcccgcggccgggugaagcgcgagcaggacgucuacgccauccucagccugaugucccugcuccggcaguucugcgcccacgacagcgugcgcaucugggggcagaacacgaccgcggcccuguaccaccuccaggcccucccccaggacaugaaggaccugcuggacgacggcuggcgccgggcccucggcggggugaacgaccacuuccuggacaccaacaaggucaaccugcucacccuguucgaguacuacggcgccgagacgaagcaggcgcgcguggcccugacccaggacuucuaccgguucgugguccucaaggagcagaagaacaugggguucucccugcgccggcugcgcgaggagcuccugaagcugcccgacgccgccuaccucaccggccaggaguacgacagcgugcggcagaagcuguacaugcugcucgacuuccugcugugccgccucuacgcgcaggagcgggccgaccgcugcgaggagcugguguccgcccugcggugcgcccugagcgacgaggagaaggacaccgucuaccaggccgaggcggccgcccucuggcaggcccugggggacacgcugcgccggaagcuccugccgcugcucaagggcaagaagcugcaggacaaggacaagaagaaguccgacgagcugggccucagccgcgacgugcuggacgggguccuguuccggcccgcccagcagggcucccgcgcgaacgccgacuacuucugccggcucaugcaccugagcaccugguucauggacgggaaggagaucaacacccugcucaccacgcugaucuccaagcuggagaacaucgacagccuccgcuccgugcuggagagcaugggccuggccuacagcuucgugcccgccuacgccauguucgaccacucccgguacaucgcggggcagcuccgcgucgugaacaacaucgcccgcaugcggaagcccgccaucggcgccaagcgcgagauguaccgggcggccgugguccugcugggcguggacagcccggaggccgccgccgcgaucaccgacgaccuccugcagaucgaccccgagaccgggaaggugcgcccccgguccgacagcgcccgcgacaccggccugcggaacuucaucgccaacaacgucguggagucccgccgguucacguaccuccugcgcuacaugacccccgagcaggcccgggugcuggcccagaacgagaagcucaucgcguucguccugagcaccgugccggacacccagcuggagcgcuacugccggacgugcgggcgcgaggacaucaccggccggcccgcccagauccgcuaccucaccgcccagaucaugggggugcgguacgaguccuucaccgacgucgagcagcgcggccggggcgacaaccccaagaaggagcgcuacaaggcccugaucgggcuguaccucacggugcuguaccuggccgugaagaacauggucaacugcaacgcgcgguacgugaucgccuucuacugccgcgaccgcgacaccgcccucuaccagaaggaggugugcugguacgaccuggaggaggacaagaaguccggcaagcagcggcaggucgaggacuacaccgcccugacccgcuacuucgugagccagggguaccucaaccggcacgcgugcggcuaccugcgcagcaacaugaacggcaucuccaacagccugcucacggccuaccggaacgccguggaccaccugaacgccaucccgccccuggggucccucugccgcgacaucggccgggucgacagcuacuucgcccuguaccacuacgcggugcagcaguaccugaacgggcgcuacuaccggaagacgccccgcgagcaggagcuguucgccgccauggcccagcaccggaccuggugcuccgaccuggugaaggcccugaacacccccuucggcuacaaccucgcgcgcuacaagaaccugagcaucgacgggcuguucgaccgggagggcgaccacgucgugcgcgaggacggcgagaagcccgccgaguacccguacgacgugcccgacuacgccuga

SEQ ID NO: 14332 - RNA, 2748 nt, Artificial Sequence
  Cas13d variant__Gut metagenome assembly P1E0-k21__dP1E0Cas13d-HA
auggagcgcgaggugaagaagcccccgaagaagucccuggccaaggccgcgggccucaagagcaccuucgucaucagcccccaggagaaggagcuggccaugaccgccuucgggcggggcaacgacgcccugcuccagaagcgcaucguggacggggugguccgggacguggccggcgagaagcagcaguuccaggugcagcgccaggacgagucccgguuccgccugcagaacagccggcuggcggaccgcaccgucaccgccgacgacccccuccaccgggccgagacgccccgccggcagccgcugggggccggcauggaccagcugcgccggaaggcgauccucgagcagaaguacuucggccgcaccuucgacgacaacauccacauccagcugaucuacaacauccuggacauccacaagaugcucgccgugcccgccaaccacaucgugcacacccugaaccugcucgggggcuacggggagaccgacuucgucggcaugcugcccgccgggcugcccuacgacaagcuccggguggugaagaagaagaacggcgacaccgucgacaucaaggccgacaucgcggccuacgccaagcgcccgcagcuggccuaccugggcgccgcguucuacgacgugacccccgggaaguccaagcgggacgccgcccgcggccgggugaagcgcgagcaggacgucuacgccauccucagccugaugucccugcucgcccaguucugcgcggccgacagcgugcggaucugggggcagaacacgaccgccgcccuguaccaccuccaggcccucccccaggacaugaaggaccugcuggacgacggcuggcgccgcgcgcucggcggggugaacgaccacuuccuggacaccaacaaggucaaccugcucacccuguucgaguacuacggcgccgagacgaagcaggcccggguggcccugacccaggacuucuaccgcuucgugguccucaaggagcagaagaacaugggguucucccugcggcgccugcgggaggagcuccugaagcugcccgacgcggccuaccucaccggccaggaguacgacagcgugcgccagaagcuguacaugcugcucgacuuccugcugugccggcucuacgcccaggagcgcgccgaccggugcgaggagcugguguccgcccugcgcugcgcgcugagcgacgaggagaaggacaccgucuaccaggccgaggccgccgcccucuggcaggcgcugggggacacgcugcggcgcaagcuccugccgcugcucaagggcaagaagcugcaggacaaggacaagaagaaguccgacgagcugggccucagccgggacgugcuggacgggguccuguuccgccccgcccagcagggcucccgggccaacgccgacuacuucugccgccucaugcaccugagcaccugguucauggacgggaaggagaucaacacccugcucaccacgcugaucuccaagcuggagaacaucgacagccuccgguccgugcuggagagcaugggccuggccuacagcuucgugcccgcguacgccauguucgaccacucccgcuacaucgccgggcagcuccgggucgugaacaacaucgcccgcaugcgcaagcccgcgaucggcgccaagcgggagauguaccgcgccgccgugguccugcugggcguggacagcccggaggccgcggccgccaucaccgacgaccuccugcagaucgaccccgagaccgggaaggugcggccccgcuccgacagcgcccgggacaccggccugcgcaacuucaucgccaacaacgucguggagucccggcgcuucacguaccuccugcgguacaugacccccgagcaggcgcgcgugcuggcccagaacgagaagcucaucgccuucguccugagcaccgugccggacacccagcuggagcgguacugccgcacgugcgggcgggaggacaucaccggccgccccgcccagauccgguaccucaccgcccagaucaugggggugcgcuacgaguccuucaccgacgucgagcagcggggccgcggcgacaaccccaagaaggagcgguacaaggcgcugaucgggcuguaccucacggugcuguaccuggccgugaagaacauggucaacugcaacgcccgcuacgugaucgccuucuacugccgggaccgcgacaccgcgcucuaccagaaggaggugugcugguacgaccuggaggaggacaagaaguccggcaagcagcgccaggucgaggacuacaccgcccugacccgguacuucgugagccagggguaccucaaccgccacgccugcggcuaccugcggagcaacaugaacggcaucuccaacagccugcucacggccuacgccaacgcgguggacgcccugaacgccaucccgccccuggggucccucugccgcgacaucggccgggucgacagcuacuucgcccuguaccacuacgccgugcagcaguaccugaacgggcgcuacuaccggaagacgccccgcgagcaggagcuguucgcggccauggcccagcaccggaccuggugcuccgaccuggugaaggcccugaacacccccuucggcuacaaccucgcccgcuacaagaaccugagcaucgacgggcuguucgaccgggagggcgaccacgucgugcgcgaggacggcgagaagcccgcggaguacccguacgacgugcccgacuacgccuga

SEQ ID NO: 14333 - RNA, 2820 nt, Artificial Sequence
  Cas13d variant__Gut metagenome assembly P1E0-k21__NLS-P1E0Cas13d-NLS-HA
augagccccaagaagaagcgcaagguggaggccuccgagcgggaggucaagaagccgcccaagaagucccuggccaaggcggccggccucaagagcaccuucgugaucagcccccaggagaaggagcuggccaugaccgccuucgggcgcggcaacgacgcccugcuccagaagcggaucguggacggggucgugcgcgacguggcgggcgagaagcagcaguuccagguccagcggcaggacgagucccgcuuccggcugcagaacagccgccuggccgaccggaccgugaccgccgacgacccccuccaccgcgccgagaccccgcggcgccagccccugggggcgggcauggaccagcugcggcgcaaggccauccucgagcagaaguacuucggccggaccuucgacgacaacauccacauccagcugaucuacaacauccuggacauccacaagaugcucgccgugcccgccaaccacaucguccacacgcugaaccugcucgggggcuacggggagaccgacuucgugggcaugcugcccgccgggcugccguacgacaagcuccgcguggucaagaagaagaacggcgacaccguggacaucaaggcggacaucgccgccuacgccaagcggccccagcuggccuaccugggcgcggccuucuacgacgugacccccgggaaguccaagcgcgacgccgcccggggccgcgucaagcgggagcaggacguguacgccauccucagccugaugucccugcuccgccaguucugcgcgcacgacagcgugcgcaucugggggcagaacacgaccgccgcccuguaccaccuccaggcccucccccaggacaugaaggaccugcuggacgacggcuggcggcgcgcccucggcggggucaacgaccacuuccuggacaccaacaaggugaaccugcucacccuguucgaguacuacggcgcggagacgaagcaggcccggguggcccugacccaggacuucuaccgcuucgucgugcucaaggagcagaagaacaugggguucucccugcggcgccugcgggaggagcuccugaagcugccggacgccgcguaccucaccggccaggaguacgacagcgugcgccagaagcuguacaugcugcucgacuuccugcugugccggcucuacgcccaggagcgcgccgaccggugcgaggagcuggucuccgcccugcgcugcgcccugagcgacgaggagaaggacaccguguaccaggcggaggccgccgcccucuggcaggcccugggggacacgcugcggcgcaagcuccugccccugcucaagggcaagaagcugcaggacaaggacaagaagaaguccgacgagcugggccucagccgggacguccuggacggggugcuguuccgccccgcgcagcagggcucccgggccaacgccgacuacuucugccgccucaugcaccugagcaccugguucauggacgggaaggagaucaacacccugcucaccacgcugaucuccaagcuggagaacaucgacagccuccggagcgugcuggaguccaugggccuggccuacagcuucguccccgccuacgcgauguucgaccacucccgcuacaucgccgggcagcuccgcguggugaacaacaucgcccggaugcgcaagccggccaucggcgcgaagcgggagauguaccgcgccgccgucgugcugcugggcguggacagccccgaggccgccgcggccaucaccgacgaccuccugcagaucgaccccgagaccgggaagguccggccccgcuccgacagcgcccgggacaccggccugcgcaacuucaucgccaacaacgugguggagucccggcgcuucacguaccuccugcgguacaugaccccggagcaggcccgcguccuggcgcagaacgagaagcucaucgccuucgugcugagcaccgugcccgacacccagcuggagcgguacugccgcacgugcgggcgggaggacaucaccggccgccccgcccagauccgguaccucaccgcccagaucauggggguccgcuacgaguccuucaccgacguggagcagcggggccgcggcgacaaccccaagaaggagcgguacaaggcccugaucgggcuguaccucacggugcuguaccuggcggucaagaacauggugaacugcaacgcccgcuacgugaucgccuucuacugccgcgaccgggacaccgcccucuaccagaaggaggucugcugguacgaccuggaggaggacaagaaguccggcaagcagcgccagguggaggacuacaccgcgcugacccgguacuucgugagccagggguaccucaaccgccacgccugcggcuaccugcggagcaacaugaacggcaucuccaacagccugcucacggccuaccgcaacgccgucgaccaccugaacgccaucccgccccuggggucccucugccgggacaucggccgcguggacagcuacuucgcgcuguaccacuacgccgugcagcaguaccugaacgggcgguacuaccgcaagacgccccgggagcaggagcuguucgccgccauggcccagcaccgcaccuggugcuccgaccuggucaaggcgcugaacacccccuucggcuacaaccucgcccgguacaagaaccugagcaucgacgggcuguucgaccgcgagggcgaccacguggugcgggaggacggcgagaagccggccgagggguccggccccaagaagaagcgcaaggucgccgccgcguaccccuacgacgugccggacuacgccuga

SEQ ID NO: 14334 - RNA, 2820 nt, Artificial Sequence
  Cas13d variant__Gut metagenome assembly P1E0-k21__NLS-dP1E0Cas13d-NLS-HA
augagccccaagaagaagcgcaagguggaggccuccgagcgggaggucaagaagccgcccaagaagucccuggccaaggcggccggccucaagagcaccuucgugaucagcccccaggagaaggagcuggccaugaccgccuucgggcgcggcaacgacgcccugcuccagaagcggaucguggacggggucgugcgcgacguggcgggcgagaagcagcaguuccagguccagcggcaggacgagucccgcuuccggcugcagaacagccgccuggccgaccggaccgugaccgccgacgacccccuccaccgcgccgagaccccgcggcgccagccccugggggcgggcauggaccagcugcggcgcaaggccauccucgagcagaaguacuucggccggaccuucgacgacaacauccacauccagcugaucuacaacauccuggacauccacaagaugcucgccgugcccgccaaccacaucguccacacgcugaaccugcucgggggcuacggggagaccgacuucgugggcaugcugcccgccgggcugccguacgacaagcuccgcguggucaagaagaagaacggcgacaccguggacaucaaggcggacaucgccgccuacgccaagcggccccagcuggccuaccugggcgcggccuucuacgacgugacccccgggaaguccaagcgcgacgccgcccggggccgcgucaagcgggagcaggacguguacgccauccucagccugaugucccugcucgcgcaguucugcgccgccgacagcgugcgcaucugggggcagaacacgaccgccgcccuguaccaccuccaggcgcucccccaggacaugaaggaccugcuggacgacggcuggcgccgggcccucggcggggucaacgaccacuuccuggacaccaacaaggugaaccugcucacccuguucgaguacuacggcgccgagacgaagcaggcccgcguggcgcugacccaggacuucuaccgguucgucgugcucaaggagcagaagaacaugggguucucccugcgccggcugcgcgaggagcuccugaagcugccggacgccgccuaccucaccggccaggaguacgacagcgugcggcagaagcuguacaugcugcucgacuuccugcugugccgccucuacgcccaggagcgggccgaccgcugcgaggagcuggucuccgcgcugcggugcgcccugagcgacgaggagaaggacaccguguaccaggccgaggccgccgcgcucuggcaggcccugggggacacgcugcgccggaagcuccugccccugcucaagggcaagaagcugcaggacaaggacaagaagaaguccgacgagcugggccucagccgcgacguccuggacggggugcuguuccggcccgcccagcagggcucccgcgccaacgccgacuacuucugccggcucaugcaccugagcaccugguucauggacgggaaggagaucaacacccugcucaccacgcugaucuccaagcuggagaacaucgacagccuccgcagcgugcuggaguccaugggccuggcguacagcuucguccccgccuacgccauguucgaccacucccgguacaucgccgggcagcuccgcguggugaacaacaucgcgcgcaugcggaagccggccaucggcgccaagcgcgagauguaccgggccgccgucgugcugcugggcguggacagccccgaggcggccgccgccaucaccgacgaccuccugcagaucgaccccgagaccgggaagguccgcccccgguccgacagcgcccgcgacaccggccugcggaacuucaucgcgaacaacgugguggagucccgccgguucacguaccuccugcgcuacaugaccccggagcaggcccggguccuggcccagaacgagaagcucaucgccuucgugcugagcaccgugcccgacacccagcuggagcgcuacugccggacgugcgggcgcgaggacaucaccggccggcccgcccagauccgcuaccucaccgcgcagaucauggggguccgguacgaguccuucaccgacguggagcagcgcggccggggcgacaaccccaagaaggagcgcuacaaggcccugaucgggcuguaccucacggugcuguaccuggccgucaagaacauggugaacugcaacgcccgguacgugaucgcguucuacugccgcgaccgcgacaccgcccucuaccagaaggaggucugcugguacgaccuggaggaggacaagaaguccggcaagcagcgccagguggaggacuacaccgcccugacccgguacuucgugagccagggguaccucaaccggcacgccugcggcuaccugcgcagcaacaugaacggcaucuccaacagccugcucacggccuacgcgaacgccgucgacgcccugaacgccaucccgccccuggggucccucugccgggacaucggccgcguggacagcuacuucgcccuguaccacuacgcggugcagcaguaccugaacgggcgguacuaccgcaagacgccccgggagcaggagcuguucgccgccauggcccagcaccgcaccuggugcuccgaccuggucaaggcccugaacacccccuucggcuacaaccucgcgcgguacaagaaccugagcaucgacgggcuguucgaccgcgagggcgaccacguggugcgggaggacggcgagaagccggccgagggguccggccccaagaagaagcgcaaggucgccgccgccuaccccuacgacgugccggacuacgcguga

SEQ ID NO: 14335 - RNA, 2862 nt, Artificial Sequence
  Cas13d variant__Ruminococcus albus __RaCas13d-HA
auggccaagaaguccaagggcaugagccugcgcgagaagcgggagcucgagaagcagaagcgcauccagaaggccgcggugaacagcgucaacgacacccccgagaagaccgaggaggccaacgugguguccgucaacgugcggacgagcgccgagaacaagcacuccaagaaguccgccgccaaggcgcuggggcucaagagcggccuggugaucggggacgagcuguaccugaccagcuucggccgcgggaacgaggccaagcucgagaagaagaucuccggcgacaccgucgagaagcugggcaucggggccuucgagguggccgagcgggacgagagcacccugacgcucgaguccggccgcaucaaggacaagaccgcgcggccgaaggacccccgccacaucaccguggacacccaggggaaguucaaggaggacaugcugggcauccggagcguccuggagaagaagaucuucgggaagacguucgacgacaacauccacgugcagcucgccuacaacauccuggacguggagaagaucauggcccaguacgucuccgacaucguguacaugcugcacaacaccgacaagaccgagcgcaacgacaaccucaugggcuacaugagcauccggaacaccuacaagacguucugcgacaccuccaaccugcccgacgacaccaagcagaagguggagaaccagaagcgcgaguucgacaagaucaucaagagcggccggcugggguacuucggcgaggccuucauggucaacuccgggaacagcaccaagcuccgccccgagaaggagaucuaccacaucuucgcccugauggcgucccugcggcagagcuacuuccacggcuacgugaaggacacggacuaccagggcaccaccugggccuacacccucgaggacaagcugaaggggccgagccacgaguuccgcgagacgaucgacaagaucuucgacgagggcuucuccaagaucagcaaggacuucgggaagaugaacaaggugaaccugcagauccucgagcagaugaucggcgagcuguacggguccaucgagcggcagaaccugaccugcgacuacuacgacuucauccagcucaagaagcacaaguaccugggcuucagcaucaagcgccugcgggagaccaugcucgagaccacgcccgccgagugcuacaaggccgagugcuacaacuccgagcgccagaagcuguacaagcugaucgacuuccucaucuacgaccuguacuacaaccggaagcccgcccgcaucgaggagaucgucgacaagcugcgcgagagcgugaacgacgaggagaaggaguccaucuacagcguggaggcgaaguacgucuacgagucccucagcaaggugcuggacaagucccugaagaacagcguguccggcgagaccaucaaggaccuccagaagcgguacgacgacgagaccgccaaccgcaucugggacaucagccagcacuccaucagcgggaacgucaacugcuucugcaagcugaucuacaucaugacccugaugcucgacggcaaggagaucaacgaccugcugacgacccucgugaacaaguucgacaacaucgccuccuucaucgacgucauggacgagcuggggcuggagcacagcuucaccgacaacuacaagauguucgccgacuccaaggccaucugccucgaccugcaguucaucaacagcuucgcgcggaugagcaagaucgacgacgagaaguccaagcgccagcuguuccgggacgcccuggugauccucgacaucggcaacaaggacgagaccuggaucaacaacuaccuggacagcgacaucuucaagcuggacaaggaggggaacaagcucaagggcgcccgccacgacuuccggaacuucaucgccaacaacgugaucaaguccagccgcuucaaguaccuggucaaguacuccagcgccgacggcaugaucaagcugaagacgaacgagaagcucaucggguucgugcuggacaagcugcccgagacccagaucgaccgguacuacgaguccugcggccucgacaacgcgguggucgacaagaaggugcgcaucgagaagcugagcgggcugauccgggacaugaaguucgacgacuucuccggcgugaagaccagcaacaaggccggggacaacgacaagcaggacaaggccaaguaccaggccaucaucucccucuaccugaugguccuguaccagaucgugaagaacaugaucuacgugaacagccgcuacgucaucgcguuccacugccucgagcgggacuucggcauguacggcaaggacuucgggaaguacuaccagggcugccgcaagcugaccgaccacuucaucgaggagaaguacaugaaggaggggaagcugggcugcaacaagaaggugggccgguaccucaagaacaacaucuccugcugcacggacgggcugaucaacaccuaccgcaaccagguggaccacuucgccgucgugcggaagaucggcaacuacgccgccuacaucaagagcaucggguccugguucgagcuguaccacuacgugauccagcgcaucgucuucgacgaguaccgguucgcccucaacaacaccgagagcaacuacaagaacuccaucaucaagcaccacaccuacugcaaggacauggugaaggcgcugaacaccccguucggcuacgaccugccccgcuacaagaaccucagcaucggggaccuguucgaccgcaacaacuaccugaacaagacgaaggagagcaucgacgccaacuccagcaucgacucccaguaccccuacgacgugcccgacuacgccuga

SEQ ID NO: 14336 - RNA, 2934 nt, Artificial Sequence
  Cas13d variant__Ruminococcus albus __NLS-RaCas13d-NLS-HA
augagccccaagaagaagcgcaagguggaggccuccgccaagaaguccaagggcaugagccugcgggagaagcgcgagcucgagaagcagaagcggauccagaaggcggccgucaacagcgugaacgacaccccggagaagaccgaggaggccaacguggucuccgugaacgugcgcacgagcgccgagaacaagcacuccaagaaguccgccgcgaaggcccuggggcucaagagcggccuggucaucggggacgagcuguaccugaccagcuucggccgggggaacgaggccaagcucgagaagaagaucuccggcgacaccguggagaagcugggcaucggggccuucgagguggcggagcgcgacgagagcacccugacgcucgaguccggccggaucaaggacaagaccgcccgccccaaggacccccggcacaucaccgucgacacccaggggaaguucaaggaggacaugcugggcauccgcagcgugcuggagaagaagaucuucgggaagacguucgacgacaacauccacgugcagcucgccuacaacauccuggacgucgagaagaucauggcccaguacguguccgacaucguguacaugcugcacaacaccgacaagaccgagcggaacgacaaccucaugggcuacaugagcauccgcaacaccuacaagacguucugcgacaccuccaaccugcccgacgacaccaagcagaaggucgagaaccagaagcgggaguucgacaagaucaucaagagcggccgccugggguacuucggcgaggccuucauggugaacuccgggaacagcaccaagcuccggccggagaaggagaucuaccacaucuucgcgcugauggccagccugcgccaguccuacuuccacggcuacgugaaggacacggacuaccagggcaccaccugggccuacacccucgaggacaagcugaaggggcccagccacgaguuccgggagacgaucgacaagaucuucgacgagggcuucuccaagaucagcaaggacuucgggaagaugaacaaggucaaccugcagauccucgagcagaugaucggcgagcuguacggguccaucgagcgccagaaccugaccugcgacuacuacgacuucauccagcucaagaagcacaaguaccugggcuucagcaucaagcggcugcgcgagaccaugcucgagaccacgcccgccgagugcuacaaggccgagugcuacaacuccgagcggcagaagcuguacaagcugaucgacuuccucaucuacgaccuguacuacaaccgcaagcccgcgcgcaucgaggagaucguggacaagcugcgggagagcgugaacgacgaggagaaggaguccaucuacagcgucgaggccaaguacguguacgagucccucagcaaggugcuggacaagucccugaagaacagcgucuccggcgagaccaucaaggaccuccagaagcgcuacgacgacgagaccgccaaccggaucugggacaucagccagcacuccaucagcgggaacgugaacugcuucugcaagcugaucuacaucaugacccugaugcucgacggcaaggagaucaacgaccugcugacgacccucgucaacaaguucgacaacaucgccuccuucaucgacgugauggacgagcuggggcuggagcacagcuucaccgacaacuacaagauguucgccgacagcaaggcgaucugccucgaccugcaguucaucaacuccuucgcccgcaugagcaagaucgacgacgagaaguccaagcggcagcuguuccgcgacgcccuggugauccucgacaucggcaacaaggacgagaccuggaucaacaacuaccuggacagcgacaucuucaagcuggacaaggaggggaacaagcucaagggcgcccggcacgacuuccgcaacuucaucgccaacaacgucaucaaguccagccgguucaaguaccuggugaaguacuccagcgcggacggcaugaucaagcugaagacgaacgagaagcucaucggguucgugcuggacaagcugccggagacccagaucgaccgcuacuacgaguccugcggccucgacaacgccgucguggacaagaaggugcggaucgagaagcugagcgggcugauccgcgacaugaaguucgacgacuucuccggcgucaagaccagcaacaaggccggggacaacgacaagcaggacaaggccaaguaccaggcgaucaucucccucuaccugauggugcuguaccagaucgugaagaacaugaucuacgucaacagccgguacgugaucgccuuccacugccucgagcgcgacuucggcauguacggcaaggacuucgggaaguacuaccagggcugccggaagcugaccgaccacuucaucgaggagaaguacaugaaggaggggaagcugggcugcaacaagaaggugggccgcuaccucaagaacaacaucuccugcugcacggacgggcugaucaacaccuaccggaaccaggucgaccacuucgccguggugcgcaagaucggcaacuacgccgccuacaucaagagcaucggguccugguucgagcuguaccacuacgucauccagcggaucguguucgacgaguaccgcuucgcgcucaacaacaccgagagcaacuacaagaacagcaucaucaagcaccacaccuacugcaaggacauggugaaggcccugaacacccccuucggcuacgaccugccccgcuacaagaaccucuccaucggggaccuguucgaccggaacaacuaccugaacaagacgaaggagagcaucgacgccaacuccagcaucgacucccagggcagcggccccaagaagaagcgcaaggucgccgccgcguacccguacgacgugcccgacuacgccuga

SEQ ID NO: 14337 - RNA, 2829 nt, Artificial Sequence
  Cas13d variant__Ruminococcus flavefaciens FD1__RffCas13d-HA
augaagaagaagaugagccugcgcgagaagcgggaggccgagaagcaggccaagaaggcggccuacuccgccgccagcaagaacaccgacuccaagcccgccgagaagaaggcggagaccccgaagcccgccgagaucaucagcgacaacucccgcaacaagacggccgugaaggccgcgggccucaagagcaccaucaucuccggggacaagcuguacaugaccagcuucggcaaggggaacgccgccgucaucgagcagaagaucgacaucaacgacuacuccuucagcgccaugaaggacacccccucccuggagguggacaaggccgagagcaaggagaucuccuucagcucccaccaccccuucgugaagaacgacaagcucacgaccuacaacccgcuguacggcgggaaggacaaccccgagaagcccgucggccgggacaugcugggccucaaggacaagcuggaggagcgcuacuucgggugcaccuucaacgacaaccugcacauccagaucaucuacaacauccucgacaucgagaagauccuggcggugcacagcgccaacaucaccacggcccuggaccacaugguggacgaggacgacgagaaguaccucaacuccgacuacaucggcuacaugaacaccaucaacaccuacgacgucuucauggaccccagcaagaacuccagccugagcccgaaggaccggaagaacaucgacaacucccgcgccaaguucgagaagcugcucagcaccaagcggcugggguacuucggcuucgacuacgacgccaacgggaaggacaagaagaagaacgaggagaucaagaagcgccuguaccaccucacggcguucgccggccagcugcggcagugguccuuccacagcgccggcaacuacccccgcaccuggcuguacaagcucgacucccuggacaaggaguaccuggacacccucgaccacuacuucgacaagcgguucaacgacaucaacgacgacuucgugaccaagaacgccacgaaccuguacauccugaaggagguguuccccgaggccaacuucaaggacaucgcggaccucuacuacgacuucaucgucaucaagagccacaagaacaugggguucuccaucaagaagcugcgcgagaagaugcuggagugcgacggcgccgaccggaucaaggagcaggacauggacagcgugcgcuccaagcucuacaagcugaucgacuucugcaucuucaaguacuaccacgaguuccccgagcugagcgagaagaacguggacauccuccgggccgccgucuccgacaccaagaaggacaaccuguacagcgacgaggccgcgcgccugugguccaucuucaaggagaaguuccucggguucugcgacaagaucguggugugggucaccggcgagcacgagaaggacaucaccagcgugaucgacaaggacgccuaccggaaccgcuccaacgugagcuacuucuccaagcugauguacgccaugugcuucuuccuggacggcaaggagaucaacgaccuccugacgacccugaucaacaaguucgacaacaucgccaaccagaucaagaccgcgaaggagcucgggaucaacaccgccuucgucaagaacuacgacuucuucaaccacagcgagaaguacguggacgagcugaacaucgugaagaacaucgcccggaugaagaagccguccagcaacgccaagaaggccauguaccacgacgcgcugacgauccucggcauccccgaggacauggacgagaaggcccuggacgaggagcuggaccucauccuggagaagaagaccgaccccgucaccgggaagccccugaagggcaagaacccgcugcgcaacuucaucgccaacaacgugaucgagaacagccgguucaucuaccucaucaaguucugcaaccccgagaacgugcgcaagaucgucaacaacaccaaggugacggaguucguccugaagcgcauccccgacgcccagaucgagcgguacuacaaguccugcaccgacagcgagaugaacccgcccaccgagaagaagaucaccgagcuggccgggaagcucaaggacaugaacuucggcaacuuccgcaacgugcggcaguccgcgaaggagaacauggagaaggagcgcuucaaggccgugaucggccuguaccugacggucguguaccggguggucaagaaccucguggacgugaacagccgcuacaucauggccuuccacucccuggagcgggacagccagcuguacaacgucuccguggacaacgacuaccucgcccugaccgacacccuggugaaggagggggacaacagccgcucccgguaccucgccggcaacaagcgccugcgggacugcgucaagcaggacaucgacaacgcgaagaagugguucgugagcgacaaguacaacuccaucaccaaguaccgcaacaacguggcccaccugacggccguccggaacugcgccgaguucaucggggacaucaccaagaucgacagcuacuucgcgcucuaccacuaccugauccagcgccagcuggccaagggccucgaccacgagcgguccggguucgaccgcaacuacccccaguacgcgccccuguucaaguggcacaccuacgugaaggacguggucaaggcccugaacgcccccuucggcuacaacaucccgcgguucaagaaccucagcaucgacgcccuguucgaccgcaacgagaucaagaagaacgacggcgagaagaaguccgacgacuaccccuacgacgugcccgacuacgccuga

SEQ ID NO: 14338 - RNA, 2901 nt, Artificial Sequence
  Cas13d variant__Ruminococcus flavefaciens FD1__NLS-RffCas13d-NLS-HA
augagccccaagaagaagcgcaagguggaggccuccaagaagaagaugagccugcgggagaagcgcgaggccgagaagcaggcgaagaaggccgccuacuccgccgccagcaagaacaccgacuccaagccggcggagaagaaggccgagacccccaagcccgccgagaucaucagcgacaacucccggaacaagacggccgucaaggcggccggccucaagagcaccaucaucuccggggacaagcuguacaugaccagcuucggcaaggggaacgccgccgugaucgagcagaagaucgacaucaacgacuacuccuucagcgccaugaaggacacccccucccuggagguggacaaggcggagagcaaggagaucuccuucagcucccaccacccguucgucaagaacgacaagcucacgaccuacaacccccuguacggcgggaaggacaaccccgagaagcccgugggccgcgacaugcugggccucaaggacaagcuggaggagcgguacuucgggugcaccuucaacgacaaccugcacauccagaucaucuacaacauccucgacaucgagaagauccuggccgugcacagcgccaacaucaccacggcccuggaccacauggucgacgaggacgacgagaaguaccucaacuccgacuacaucggcuacaugaacaccaucaacaccuacgacguguucauggacccgagcaagaacagcucccugagccccaaggaccgcaagaacaucgacaacucccgggccaaguucgagaagcugcucagcaccaagcgccugggguacuucggcuucgacuacgacgcgaacgggaaggacaagaagaagaacgaggagaucaagaagcggcuguaccaccucacggccuucgccggccagcugcgccagugguccuuccacagcgccggcaacuacccccggaccuggcuguacaagcucgacucccuggacaaggaguaccuggacacccucgaccacuacuucgacaagcgcuucaacgacaucaacgacgacuucgugaccaagaacgccacgaaccuguacauccugaaggaggucuuccccgaggcgaacuucaaggacaucgccgaccucuacuacgacuucaucgugaucaagagccacaagaacaugggguucuccaucaagaagcugcgggagaagaugcuggagugcgacggcgccgaccgcaucaaggagcaggacauggacagcgugcgguccaagcucuacaagcugaucgacuucugcaucuucaaguacuaccacgaguucccggagcugagcgagaagaacgucgacauccuccgcgccgccguguccgacaccaagaaggacaaccuguacagcgacgaggcggcccggcugugguccaucuucaaggagaaguuccucggguucugcgacaagaucguggucugggugaccggcgagcacgagaaggacaucaccagcgugaucgacaaggacgccuaccgcaaccgguccaacgucagcuacuucuccaagcugauguacgccaugugcuucuuccuggacggcaaggagaucaacgaccuccugacgacccugaucaacaaguucgacaacaucgcgaaccagaucaagaccgccaaggagcucgggaucaacaccgccuucgugaagaacuacgacuucuucaaccacagcgagaaguacguggacgagcugaacaucgucaagaacaucgcccgcaugaagaagcccagcuccaacgccaagaaggcgauguaccacgacgcccugacgauccucggcauccccgaggacauggacgagaaggcccuggacgaggagcuggaccucauccuggagaagaagaccgaccccgugaccgggaagccgcugaagggcaagaacccccugcggaacuucaucgccaacaacgugaucgagaacagccgcuucaucuaccucaucaaguucugcaaccccgagaacguccgcaagaucgugaacaacaccaaggucacggaguucgugcugaagcggauccccgacgcccagaucgagcgcuacuacaaguccugcaccgacagcgagaugaacccgcccaccgagaagaagaucaccgagcuggcggggaagcucaaggacaugaacuucggcaacuuccggaacgugcgccaguccgccaaggagaacauggagaaggagcgguucaaggccgucaucggccuguaccugacggugguguaccgcgucgugaagaaccucguggacgucaacagccgguacaucauggccuuccacucccuggagcgcgacagccagcuguacaacguguccguggacaacgacuaccucgcccugaccgacacccuggucaaggagggggacaacagccggucccgcuaccucgcgggcaacaagcggcugcgcgacugcgugaagcaggacaucgacaacgccaagaagugguucgugagcgacaaguacaacuccaucaccaaguaccggaacaacgucgcccaccugacggccgugcgcaacugcgcggaguucaucggggacaucaccaagaucgacagcuacuucgcccucuaccacuaccugauccagcggcagcuggccaagggccucgaccacgagcgcuccggguucgaccggaacuacccccaguacgcgccccuguucaaguggcacaccuacgugaaggacgucgugaaggcccugaacgccccguucggcuacaacaucccccgcuucaagaaccucagcaucgacgcccuguucgaccggaacgagaucaagaagaacgacggcgagaagaaguccgacgacgggagcggccccaagaagaagcgcaagguggccgccgccuaccccuacgacgucccggacuacgcguga

SEQ ID NO: 14339 - RNA, 2931 nt, Artificial Sequence
  Cas13d variant__Ruminococcus flavefaciens XPD3002__RfxCas13d-HA
augaucgagaagaagaaguccuucgccaagggcaugggggucaagagcacccuggugagcggcuccaagguguacaugaccacguucgccgaggggagcgacgcgcgccucgagaagaucguggagggcgacuccauccggagcgucaacgagggggaggccuucuccgccgagauggccgacaagaacgccggcuacaagaucggcaacgcgaaguucagccaccccaagggguacgccgugguggccaacaacccgcuguacaccggccccguccagcaggacaugcuggggcucaaggagacccuggagaagcgcuacuucggcgaguccgccgacgggaacgacaacaucugcauccaggugauccacaacauccuggacaucgagaagauccucgcggaguacaucaccaacgccgccuacgccgugaacaacaucagcggccuggacaaggacaucaucggcuucgggaaguucuccacggucuacaccuacgacgaguucaaggaccccgagcaccaccgggccgcguucaacaacaacgacaagcugaucaacgccaucaaggcccaguacgacgaguucgacaacuuccucgacaacccccgccugggcuacuucgggcaggccuucuucagcaaggagggccggaacuacaucaucaacuacggcaacgagugcuacgacauccuggcccuccuguccgggcugcgccacuggguggugcacaacaacgaggaggagagccggaucucccgcaccuggcucuacaaccuggacaagaaccuggacaacgaguacaucagcacccucaacuaccuguacgaccggaucacgaacgagcugaccaacuccuucagcaagaacuccgcggccaacgucaacuacaucgccgagacccucggcaucaacccggccgaguucgccgagcaguacuuccgcuucagcaucaugaaggagcagaagaaccugggguucaacaucaccaagcugcgggaggugaugcucgaccgcaaggacaugagcgagauccggaagaaccacaagguguucgacuccauccgcacgaaggucuacaccaugauggacuucgugaucuaccgguacuacaucgaggaggacgcgaagguggccgccgccaacaagagccugcccgacaacgagaagucccugagcgagaaggacaucuucgucaucaaccuccgcggcuccuucaacgacgaccagaaggacgcccuguacuacgacgaggcgaaccggaucuggcgcaagcuggagaacaucaugcacaacaucaaggaguuccgggggaacaagacccgcgaguacaagaagaaggacgcgccccggcucccccgcauccugccggccggccgcgacgugagcgccuucuccaagcugauguacgcccucaccauguuccuggacggcaaggagaucaacgaccugcucacgacccugaucaacaaguucgacaacauccagagcuuccugaaggugaugccccucaucggggucaacgccaaguucguggaggaguacgccuucuucaaggacuccgccaagaucgccgacgagcugcggcugaucaagagcuucgcgcgcaugggcgagcccaucgccgacgcccggcgcgccauguacaucgacgccauccggauccucgggaccaaccuguccuacgacgagcugaaggcgcucgccgacaccuucagccuggacgagaacggcaacaagcugaagaaggggaagcacggcaugcgcaacuucaucaucaacaacgugaucuccaacaagcgguuccacuaccucauccgcuacggcgaccccgcccaccuccacgagaucgccaagaacgaggccgucgugaaguucguccuggggcggaucgcggacauccagaagaagcagggccagaacgggaagaaccagaucgaccgcuacuacgagacgugcaucggcaaggacaagggcaagagcguguccgagaagguggacgcccugaccaagaucaucaccgggaugaacuacgaccaguucgacaagaagcggagcgucaucgaggacaccggccgcgagaacgccgagcgggagaaguucaagaagaucaucucccuguaccugacggugaucuaccacauccugaagaacaucgugaacaucaacgcccgcuacgucaucggguuccacugcguggagcgggacgcgcagcucuacaaggagaagggcuacgacaucaaccugaagaagcuggaggagaagggguucagcuccgugaccaagcucugcgccggcaucgacgagaccgccccggacaagcgcaaggacgucgagaaggagauggccgagcgggccaaggagagcaucgacagccuggaguccgcgaaccccaagcuguacgccaacuacaucaaguacagcgacgagaagaaggccgaggaguucacccgccagaucaaccgggagaaggccaagacggcccucaacgcguaccugcgcaacaccaaguggaacgugaucauccgcgaggaccugcuccggaucgacaacaagaccugcacccuguuccgcaacaaggccgugcaccuggaggucgcccgguacgugcacgccuacaucaacgacaucgccgaggugaacuccuacuuccagcucuaccacuacaucaugcagcgcaucaucaugaacgagcgguacgagaaguccagcggcaaggucagcgaguacuucgacgcggugaacgacgagaagaaguacaacgaccgccugcugaagcuccugugcgugcccuucggguacugcaucccccgguucaagaaccuguccaucgaggcccucuucgaccgcaacgaggccgccaaguucgacaaggagaagaagaaggucagcggcaacuccuacccguacgacgugcccgacuacgcguga

SEQ ID NO: 14340 - RNA, 2931 nt, Artificial Sequence
  Cas13d variant__Ruminococcus flavefaciens XPD3002__dRfxCas13d-HA
augaucgagaagaagaaguccuucgccaagggcaugggggucaagagcacccuggugagcggcuccaagguguacaugaccacguucgccgaggggagcgacgcgcgccucgagaagaucguggagggcgacuccauccggagcgucaacgagggggaggccuucuccgccgagauggccgacaagaacgccggcuacaagaucggcaacgcgaaguucagccaccccaagggguacgccgugguggccaacaacccgcuguacaccggccccguccagcaggacaugcuggggcucaaggagacccuggagaagcgcuacuucggcgaguccgccgacgggaacgacaacaucugcauccaggugauccacaacauccuggacaucgagaagauccucgcggaguacaucaccaacgccgccuacgccgugaacaacaucagcggccuggacaaggacaucaucggcuucgggaaguucuccacggucuacaccuacgacgaguucaaggaccccgagcaccaccgggccgcguucaacaacaacgacaagcugaucaacgccaucaaggcccaguacgacgaguucgacaacuuccucgacaacccccgccugggcuacuucgggcaggccuucuucagcaaggagggccggaacuacaucaucaacuacggcaacgagugcuacgacauccuggcccuccuguccgggcuggcgcacugggugguggccaacaacgaggaggagagccgcaucucccggaccuggcucuacaaccuggacaagaaccuggacaacgaguacaucagcacccucaacuaccuguacgaccgcaucacgaacgagcugaccaacuccuucagcaagaacuccgccgccaacgucaacuacaucgccgagacccucggcaucaacccggcggaguucgccgagcaguacuuccgguucagcaucaugaaggagcagaagaaccugggguucaacaucaccaagcugcgcgaggugaugcucgaccggaaggacaugagcgagauccgcaagaaccacaagguguucgacuccauccggacgaaggucuacaccaugauggacuucgugaucuaccgcuacuacaucgaggaggacgccaagguggccgccgcgaacaagagccugcccgacaacgagaagucccugagcgagaaggacaucuucgucaucaaccuccggggcuccuucaacgacgaccagaaggacgcccuguacuacgacgaggccaaccgcaucuggcggaagcuggagaacaucaugcacaacaucaaggaguuccgcgggaacaagacccgggaguacaagaagaaggacgcgccccgccucccccggauccugccggccggccgcgacgugagcgccuucuccaagcugauguacgcccucaccauguuccuggacggcaaggagaucaacgaccugcucacgacccugaucaacaaguucgacaacauccagagcuuccugaaggugaugccccucaucggggucaacgccaaguucguggaggaguacgccuucuucaaggacuccgcgaagaucgccgacgagcugcgccugaucaagagcuucgcccggaugggcgagcccaucgccgacgcccgccgggcgauguacaucgacgccauccgcauccucgggaccaaccuguccuacgacgagcugaaggcccucgccgacaccuucagccuggacgagaacggcaacaagcugaagaaggggaagcacggcaugcggaacuucaucaucaacaacgugaucuccaacaagcgcuuccacuaccucauccgguacggcgaccccgcccaccuccacgagaucgcgaagaacgaggccgucgugaaguucguccuggggcgcaucgccgacauccagaagaagcagggccagaacgggaagaaccagaucgaccgguacuacgagacgugcaucggcaaggacaagggcaagagcguguccgagaagguggacgcccugaccaagaucaucaccgggaugaacuacgaccaguucgacaagaagcgcagcgucaucgaggacaccggccgggagaacgcggagcgcgagaaguucaagaagaucaucucccuguaccugacggugaucuaccacauccugaagaacaucgugaacaucaacgcccgguacgucaucggguuccacugcguggagcgcgacgcccagcucuacaaggagaagggcuacgacaucaaccugaagaagcuggaggagaagggguucagcuccgugaccaagcucugcgccggcaucgacgagaccgccccggacaagcggaaggacgucgagaaggagauggcggagcgcgccaaggagagcaucgacagccuggaguccgccaaccccaagcuguacgccaacuacaucaaguacagcgacgagaagaaggccgaggaguucacccggcagaucaaccgcgagaaggcgaagacggcccucaacgccuaccugcggaacaccaaguggaacgugaucauccgcgaggaccugcuccgcaucgacaacaagaccugcacccuguucgccaacaaggccguggcgcuggaggucgcccgguacgugcacgccuacaucaacgacaucgccgaggugaacuccuacuuccagcucuaccacuacaucaugcagcgcaucaucaugaacgagcgguacgagaaguccagcggcaaggucagcgaguacuucgacgcggugaacgacgagaagaaguacaacgaccgccugcugaagcuccugugcgugcccuucggguacugcaucccccgguucaagaaccuguccaucgaggcccucuucgaccgcaacgaggccgccaaguucgacaaggagaagaagaaggucagcggcaacuccuacccguacgacgugcccgacuacgccuga

SEQ ID NO: 14341 - RNA, 3003 nt, Artificial Sequence
  Cas13d variant__Ruminococcus flavefaciens XPD3002__NLS-RfxCas13d-NLS-HA (CasRx)
augagccccaagaagaagcgcaagguggaggccuccaucgagaagaagaaguccuucgccaagggcaugggggucaagagcacccuggugagcggcuccaagguguacaugaccacguucgcggaggggagcgacgcccggcucgagaagaucgucgagggcgacuccauccgcagcgugaacgagggggaggccuucuccgccgagauggccgacaagaacgcgggcuacaagaucggcaacgccaaguucagccacccgaagggguacgccguggucgccaacaacccccuguacaccggccccgugcagcaggacaugcuggggcucaaggagacccuggagaagcgguacuucggcgaguccgcggacgggaacgacaacaucugcauccaggugauccacaacauccuggacaucgagaagauccucgccgaguacaucaccaacgccgccuacgccgucaacaacaucagcggccuggacaaggacaucaucggcuucgggaaguucuccacgguguacaccuacgacgaguucaaggaccccgagcaccaccgcgcggccuucaacaacaacgacaagcugaucaacgccaucaaggcccaguacgacgaguucgacaacuuccucgacaacccgcggcugggcuacuucgggcaggccuucuucagcaaggagggccgcaacuacaucaucaacuacggcaacgagugcuacgacauccuggcgcuccuguccgggcugcggcacugggugguccacaacaacgaggaggagagccgcaucucccggaccuggcucuacaaccuggacaagaaccuggacaacgaguacaucagcacccucaacuaccuguacgaccgcaucacgaacgagcugaccaacuccuucagcaagaacagcgccgccaacgugaacuacaucgccgagacccucggcaucaaccccgccgaguucgcggagcaguacuuccgguucuccaucaugaaggagcagaagaaccugggguucaacaucaccaagcugcgcgaggugaugcucgaccggaaggacaugagcgagauccgcaagaaccacaaggucuucgacuccauccggacgaagguguacaccaugauggacuucgugaucuaccgcuacuacaucgaggaggacgccaaggucgccgccgccaacaagagccugcccgacaacgagaagucccugagcgagaaggacaucuucgugaucaaccuccggggcuccuucaacgacgaccagaaggacgcgcuguacuacgacgaggccaaccgcaucuggcggaagcuggagaacaucaugcacaacaucaaggaguuccgcgggaacaagacccgggaguacaagaagaaggacgcgccccgccucccgcgcauccugcccgccggccgggacgugagcgccuucuccaagcugauguacgcccucaccauguuccuggacggcaaggagaucaacgaccugcucacgacccugaucaacaaguucgacaacauccagagcuuccugaaggucaugccccucaucggggugaacgccaaguucguggaggaguacgccuucuucaaggacuccgccaagaucgcggacgagcugcgccugaucaagagcuucgcccggaugggcgagcccaucgccgacgcccgccgggccauguacaucgacgcgauccgcauccucgggaccaaccuguccuacgacgagcugaaggcccucgccgacaccuucagccuggacgagaacggcaacaagcugaagaaggggaagcacggcaugcggaacuucaucaucaacaacgucaucuccaacaagcgcuuccacuaccucauccgguacggcgacccggcccaccuccacgagaucgccaagaacgaggcgguggucaaguucgugcuggggcgcaucgccgacauccagaagaagcagggccagaacgggaagaaccagaucgaccgguacuacgagacgugcaucggcaaggacaagggcaagagcguguccgagaaggucgacgcccugaccaagaucaucaccgggaugaacuacgaccaguucgacaagaagcgcagcgugaucgaggacaccggccgggagaacgccgagcgcgagaaguucaagaagaucaucucccuguaccugacggugaucuaccacauccugaagaacaucgucaacaucaacgcgcgguacgugaucggguuccacugcguggagcgcgacgcccagcucuacaaggagaagggcuacgacaucaaccugaagaagcuggaggagaagggguucagcagcgucaccaagcucugcgccggcaucgacgagaccgcccccgacaagcggaaggacguggagaaggagauggccgagcgcgcgaaggaguccaucgacagccuggaguccgccaaccccaagcuguacgccaacuacaucaaguacagcgacgagaagaaggccgaggaguucacccggcagaucaaccgcgagaaggccaagacggcgcucaacgccuaccugcgcaacaccaaguggaacgugaucauccgggaggaccugcuccgcaucgacaacaagaccugcacccuguuccggaacaaggccguccaccuggagguggcccgcuacgugcacgccuacaucaacgacaucgcggaggucaacuccuacuuccagcucuaccacuacaucaugcagcggaucaucaugaacgagcgcuacgagaaguccagcggcaaggugagcgaguacuucgacgccgugaacgacgagaagaaguacaacgaccggcugcugaagcuccugugcguccccuucggguacugcaucccgcgcuucaagaaccuguccaucgaggcccucuucgaccggaacgaggccgcgaaguucgacaaggagaagaagaaggugagcggcaacuccgggagcggccccaagaagaagcgcaagguggccgccgccuaccccuacgacguccccgacuacgccuga

SEQ ID NO: 14342 - RNA, 3003 nt, Artificial Sequence
  Cas13d variant__Ruminococcus flavefaciens XPD3002__NLS-dRfxCas13d-NLS-HA (dCasRx)
augagccccaagaagaagcgcaagguggaggccuccaucgagaagaagaaguccuucgccaagggcaugggggucaagagcacccuggugagcggcuccaagguguacaugaccacguucgcggaggggagcgacgcccggcucgagaagaucgucgagggcgacuccauccgcagcgugaacgagggggaggccuucuccgccgagauggccgacaagaacgcgggcuacaagaucggcaacgccaaguucagccacccgaagggguacgccguggucgccaacaacccccuguacaccggccccgugcagcaggacaugcuggggcucaaggagacccuggagaagcgguacuucggcgaguccgcggacgggaacgacaacaucugcauccaggugauccacaacauccuggacaucgagaagauccucgccgaguacaucaccaacgccgccuacgccgucaacaacaucagcggccuggacaaggacaucaucggcuucgggaaguucuccacgguguacaccuacgacgaguucaaggaccccgagcaccaccgcgcggccuucaacaacaacgacaagcugaucaacgccaucaaggcccaguacgacgaguucgacaacuuccucgacaacccgcggcugggcuacuucgggcaggccuucuucagcaaggagggccgcaacuacaucaucaacuacggcaacgagugcuacgacauccuggcgcuccuguccgggcuggcccacuggguggucgccaacaacgaggaggagagccggaucucccgcaccuggcucuacaaccuggacaagaaccuggacaacgaguacaucagcacccucaacuaccuguacgaccggaucacgaacgagcugaccaacuccuucagcaagaacagcgccgccaacgugaacuacaucgcggagacccucggcaucaaccccgccgaguucgccgagcaguacuuccgcuucuccaucaugaaggagcagaagaaccugggguucaacaucaccaagcugcgggaggugaugcucgaccgcaaggacaugagcgagauccggaagaaccacaaggucuucgacuccauccgcacgaagguguacaccaugauggacuucgugaucuaccgguacuacaucgaggaggacgccaaggucgccgcggccaacaagagccugcccgacaacgagaagucccugagcgagaaggacaucuucgugaucaaccuccgcggcuccuucaacgacgaccagaaggacgcccuguacuacgacgaggccaaccggaucuggcgcaagcuggagaacaucaugcacaacaucaaggaguuccgggggaacaagacccgcgaguacaagaagaaggacgcgccccggcucccgcgcauccugcccgccggccgcgacgugagcgccuucuccaagcugauguacgcccucaccauguuccuggacggcaaggagaucaacgaccugcucacgacccugaucaacaaguucgacaacauccagagcuuccugaaggucaugccccucaucggggugaacgccaaguucguggaggaguacgcguucuucaaggacuccgccaagaucgccgacgagcugcggcugaucaagagcuucgcccgcaugggcgagcccaucgccgacgcgcggcgcgccauguacaucgacgccauccggauccucgggaccaaccuguccuacgacgagcugaaggcccucgccgacaccuucagccuggacgagaacggcaacaagcugaagaaggggaagcacggcaugcgcaacuucaucaucaacaacgucaucuccaacaagcgguuccacuaccucauccgcuacggcgacccggcgcaccuccacgagaucgccaagaacgaggccguggucaaguucgugcuggggcggaucgccgacauccagaagaagcagggccagaacgggaagaaccagaucgaccgcuacuacgagacgugcaucggcaaggacaagggcaagagcguguccgagaaggucgacgcgcugaccaagaucaucaccgggaugaacuacgaccaguucgacaagaagcggagcgugaucgaggacaccggccgcgagaacgccgagcgggagaaguucaagaagaucaucucccuguaccugacggugaucuaccacauccugaagaacaucgucaacaucaacgcccgcuacgugaucggguuccacugcguggagcgggacgcccagcucuacaaggagaagggcuacgacaucaaccugaagaagcuggaggagaagggguucagcagcgucaccaagcucugcgccggcaucgacgagaccgcgcccgacaagcgcaaggacguggagaaggagauggccgagcgggccaaggaguccaucgacagccuggaguccgccaaccccaagcuguacgccaacuacaucaaguacagcgacgagaagaaggcggaggaguucacccgccagaucaaccgggagaaggccaagacggcccucaacgccuaccugcgcaacaccaaguggaacgugaucauccgcgaggaccugcuccggaucgacaacaagaccugcacccuguucgccaacaaggcggucgcccuggagguggcccgcuacgugcacgccuacaucaacgacaucgcggaggucaacuccuacuuccagcucuaccacuacaucaugcagcggaucaucaugaacgagcgcuacgagaaguccagcggcaaggugagcgaguacuucgacgccgugaacgacgagaagaaguacaacgaccggcugcugaagcuccugugcguccccuucggguacugcaucccgcgcuucaagaaccuguccaucgaggcccucuucgaccggaacgaggccgccaaguucgacaaggagaagaagaaggugagcggcaacuccgggagcggccccaagaagaagcgcaagguggcggccgccuaccccuacgacguccccgacuacgccuga

SEQ ID NO: 14343 - RNA, 3381 nt, Artificial Sequence
  Cas13d variant__Ruminococcus flavefaciens XPD3002__hnRNPa1-dCasRx-HA
augggccgcagcggguccggcaacuucgggggcgggcggggcggcggguucggcgggaacgacaacuucggccgcgggggcaacuucagcggccgcgggggcuucgggggcucccggggcgggggcggguacggcgggagcggcgacggcuacaacggguucggcaacgacggguccaacuucggcgggggcggcagcuacaacgacuucgggaacuacaacaaccaguccagcaacuucggccccaugaagggcgggaacuucgggggccgguccagcggcccguacgggggcgggggccaguacuucgccaagccccgcaaccagggcggguacggcggguccagcuccagcuccagcuacggcuccgggcggcgcuucagccccaagaagaagcggaagguggaggccuccaucgagaagaagaaguccuucgcgaagggcaugggcgucaagagcacccuggugagcgggagcaagguguacaugaccacguucgccgagggcuccgacgcccgccucgagaagaucgucgagggggacagcauccgguccgugaacgagggcgaggccuucagcgccgagauggcggacaagaacgccggguacaagaucggcaacgccaaguucucccaccccaagggcuacgccguggucgcgaacaacccgcuguacaccgggcccgugcagcaggacaugcugggccucaaggagacccuggagaagcgcuacuucggggagagcgccgacggcaacgacaacaucugcauccaggugauccacaacauccuggacaucgagaagauccucgccgaguacaucaccaacgccgccuacgcggucaacaacaucuccgggcuggacaaggacaucaucggcuucggcaaguucagcacgguguacaccuacgacgaguucaaggaccccgagcaccaccgggccgccuucaacaacaacgacaagcugaucaacgccaucaaggcccaguacgacgaguucgacaacuuccucgacaacccccgccugggguacuucggccaggcguucuucuccaaggaggggcggaacuacaucaucaacuacggcaacgagugcuacgacauccuggcccuccugagcgggcuggcccacuggguggucgccaacaacgaggaggagucccgcaucagccggaccuggcucuacaaccuggacaagaaccuggacaacgaguacaucuccacccucaacuaccuguacgaccgcaucacgaacgagcugaccaacagcuucuccaagaacagcgccgcgaacgugaacuacaucgccgagacccucggcaucaacccggccgaguucgccgagcaguacuuccgguucuccaucaugaaggagcagaagaaccugggcuucaacaucaccaagcugcgcgaggugaugcucgaccggaaggacaugagcgagauccgcaagaaccacaaggucuucgacagcauccgcacgaagguguacaccaugauggacuucgugaucuaccgguacuacaucgaggaggacgccaaggucgcggccgccaacaagucccugcccgacaacgagaagucccugagcgagaaggacaucuucgugaucaaccuccgcgggagcuucaacgacgaccagaaggacgcccuguacuacgacgaggcgaaccggaucuggcgcaagcuggagaacaucaugcacaacaucaaggaguuccggggcaacaagacccgcgaguacaagaagaaggacgcgccccggcucccccgcauccugccggccgggcgggacguguccgccuucagcaagcugauguacgcccucaccauguuccuggacggcaaggagaucaacgaccugcucacgacccugaucaacaaguucgacaacauccaguccuuccugaaggucaugccccucaucggcgugaacgccaaguucguggaggaguacgccuucuucaaggacagcgccaagaucgccgacgagcugcgccugaucaaguccuucgcccggaugggggagcccaucgcggacgcccgccgggccauguacaucgacgccauccgcauccucggcaccaaccugagcuacgacgagcugaaggcccucgcggacaccuucucccuggacgagaacgggaacaagcugaagaagggcaagcacgggaugcggaacuucaucaucaacaacgucaucagcaacaagcgcuuccacuaccucauccgguacggcgaccccgcccaccuccacgagaucgccaagaacgaggccguggucaaguucgugcugggccgcaucgcggacauccagaagaagcaggggcagaacggcaagaaccagaucgaccgguacuacgagacgugcaucgggaaggacaagggcaaguccgugagcgagaaggucgacgcccugaccaagaucaucaccgggaugaacuacgaccaguucgacaagaagcgcuccgugaucgaggacaccggccgcgagaacgccgagcgggagaaguucaagaagaucaucagccuguaccugacggugaucuaccacauccugaagaacaucgucaacaucaacgcccgcuacgugaucggcuuccacugcguggagcgggacgcccagcucuacaaggagaagggguacgacaucaaccugaagaagcuggaggagaagggcuucuccagcgucaccaagcucugcgcggggaucgacgagaccgccccggacaagcgcaaggacguggagaaggagauggccgagcgggccaaggagagcaucgacucccuggagagcgccaaccccaagcuguacgcgaacuacaucaaguacuccgacgagaagaaggccgaggaguucacccgccagaucaaccgggagaaggccaagacggcccucaacgccuaccugcgcaacaccaaguggaacgugaucauccgggaggaccugcuccgcaucgacaacaagaccugcacccuguucgcgaacaaggccgucgcccuggagguggcccgguacgugcacgcguacaucaacgacaucgccgaggucaacagcuacuuccagcucuaccacuacaucaugcagcgcaucaucaugaacgagcgguacgagaaguccagcggcaagguguccgaguacuucgacgccgugaacgacgagaagaaguacaacgaccgccugcugaagcuccugugcguccccuucggguacugcaucccccgguucaagaaccugagcaucgaggcccucuucgaccgcaacgaggccgcgaaguucgacaaggagaagaagaagguguccggcaacagcggcuccgggccgaagaagaagcggaagguggccgccgccuaccccuacgacguccccgacuacgccuga

SEQ ID NO: 14344 - RNA, 2787 nt, Artificial Sequence
  Cas13d variant__Uncultured Ruminococcus sp. __UrCas13d-HA
auggccaagaagaacaagaugaagccccgcgagcugcgggaggcccagaagaaggcgcgccagcucaaggccgccgagaucaacaacaacgccgccccggcgaucgccgccaugcccgccgcggaggugaucgcccccgccgccgagaagaagaaguccagcgucaaggccgcgggcaugaaguccauccuggugagcgagaacaagauguacaucaccagcuucgggaagggcaacuccgccgugcuggaguacgaggucgacaacaacgacuacaaccagacccagcucagcuccaaggacaacagcaacauccagcucgggggcgugaacgaggugaacaucacguucuccagcaagcacggguucgaguccggcgucgagaucaacaccagcaaccccacccaccgguccggcgagagcuccccggugcgcggggacaugcugggccucaagagcgagcuggagaagcgguucuucgggaagaccuucgacgacaacauccacauccagcugaucuacaacauccucgacaucgagaagauccuggccguguacgucacgaacaucguguacgcccugaacaacaugcucggcgugaagggguccgagagccacgacgacuucaucggcuaccuguccaccaacaacaucuacgacgucuucaucgaccccgacaacagcagccuguccgacgacaagaaggccaacgugcgcaagagccucuccaaguucaacgcgcugcugaagaccaagcggcucggcuacuucgggcuggaggagcccaagaccaaggacaaccgcgugagccaggccuacaagaagcgggucuaccacaugcuggccaucgugggccagauccgccagugcguguuccacgacaaguccggggccaagcgguucgaccucuacagcuucaucaacaacaucgaccccgaguaccgcgacacgcuggacuaccuggucgaggagcggcucaaguccaucaacaaggacuucaucgaggacaacaaggugaacaucagccugcugaucgacaugaugaagggcuacgaggccgacgacaucauccgccucuacuacgacuucaucgugcugaagucccagaagaaccugggcuucagcaucaagaagcuccgggagaagaugcuggacgaguacggguuccgcuucaaggacaagcaguacgacuccguccggagcaagauguacaagcugauggacuuccuccuguucugcaacuacuaccgcaacgacaucgcggccggcgagucccuggugcggaagcuccgcuucagcaugaccgacgacgagaaggaggggaucuacgccgacgaggccgccaagcuguggggcaaguuccggaacgacuucgagaacaucgcggaccacaugaacggggacgugaucaaggagcugggcaaggccgacauggacuucgacgagaagauccucgacuccgagaagaagaacgccagcgaccugcuguacuucuccaagaugaucuacaugcucaccuacuuccuggacggcaaggagaucaacgaccugcucaccacgcugaucagcaaguucgacaacaucaaggaguuccugaagaucaugaaguccagcgccgucgacguggagugcgagcucaccgcgggguacaagcuguucaacgacagccagcgcaucaccaacgagcuguucaucgucaagaacaucgccuccaugcgcaagccggccgccagcgccaagcugaccauguuccgggacgcgcucacgauccugggcaucgacgacaagaucaccgacgaccgcaucuccgggauccugaagcucaaggagaagggcaaggggauccacggccugcggaacuucaucaccaacaacgugaucgagagcucccgcuucguguaccugaucaaguacgccaacgcccagaagauccgggaggucgccaagaacgagaagguggugauguucguccucggcgggauccccgacacccagaucgagcgcuacuacaagagcugcguggaguuccccgacaugaacuccagccugggcgugaagcgguccgagcuggcccgcaugaucaagaacaucagcuucgacgacuucaagaacgucaagcagcaggcgaaggggcgggagaacguggccaaggagcgcgccaaggccgugaucggccucuaccugacggucauguaccugcucgugaagaaccuggugaacgucaacgcccgguacgugaucgcgauccacugccuggagcgcgacuucgggcucuacaaggagaucauccccgagcuggccuccaagaaccugaagaacgacuaccggauccucagccagacccugugcgagcugugcgacaaguccccgaaccucuuccugaagaagaacgagcgccugcggaagugcguggaggucgacaucaacaacgccgacagcuccaugacccgcaaguaccggaacugcaucgcccaccucaccguggugcgcgagcugaaggaguacaucggcgacaucugcacggucgacagcuacuucuccaucuaccacuacgugaugcagcggugcaucaccaagcgcgagaacgacaccaagcaggaggagaagaucaaguacgaggacgaccugcucaagaaccacggcuacaccaaggacuucgugaaggcgcugaacagccccuucggguacaacaucccccgcuucaagaaccugagcaucgagcagcuguucgaccggaacgaguaccugacggagaaguaccccuacgacgucccggacuacgccuga

SEQ ID NO: 14345 - RNA, 2787 nt, Artificial Sequence
  Cas13d variant__Uncultured Ruminococcus sp. __dUrCas13d-HA
auggccaagaagaacaagaugaagccccgcgagcugcgggaggcccagaagaaggcgcgccagcucaaggccgccgagaucaacaacaacgccgccccggcgaucgccgccaugcccgccgcggaggugaucgcccccgccgccgagaagaagaaguccagcgucaaggccgcgggcaugaaguccauccuggugagcgagaacaagauguacaucaccagcuucgggaagggcaacuccgccgugcuggaguacgaggucgacaacaacgacuacaaccagacccagcucagcuccaaggacaacagcaacauccagcucgggggcgugaacgaggugaacaucacguucuccagcaagcacggguucgaguccggcgucgagaucaacaccagcaaccccacccaccgguccggcgagagcuccccggugcgcggggacaugcugggccucaagagcgagcuggagaagcgguucuucgggaagaccuucgacgacaacauccacauccagcugaucuacaacauccucgacaucgagaagauccuggccguguacgucacgaacaucguguacgcccugaacaacaugcucggcgugaagggguccgagagccacgacgacuucaucggcuaccuguccaccaacaacaucuacgacgucuucaucgaccccgacaacagcagccuguccgacgacaagaaggccaacgugcgcaagagccucuccaaguucaacgcgcugcugaagaccaagcggcucggcuacuucgggcuggaggagcccaagaccaaggacaaccgcgugagccaggccuacaagaagcgggucuaccacaugcuggccaucgugggccagaucgcccagugcguguucgccgacaaguccggggcgaagcgcuucgaccucuacagcuucaucaacaacaucgaccccgaguaccgggacacgcuggacuaccuggucgaggagcgccucaaguccaucaacaaggacuucaucgaggacaacaaggugaacaucagccugcugaucgacaugaugaagggcuacgaggccgacgacaucauccggcucuacuacgacuucaucgugcugaagucccagaagaaccugggcuucagcaucaagaagcuccgcgagaagaugcuggacgaguacggguuccgguucaaggacaagcaguacgacuccguccgcagcaagauguacaagcugauggacuuccuccuguucugcaacuacuaccggaacgacaucgccgccggcgagucccuggugcgcaagcuccgguucagcaugaccgacgacgagaaggaggggaucuacgccgacgaggcggccaagcuguggggcaaguuccgcaacgacuucgagaacaucgccgaccacaugaacggggacgugaucaaggagcugggcaaggccgacauggacuucgacgagaagauccucgacuccgagaagaagaacgcgagcgaccugcuguacuucuccaagaugaucuacaugcucaccuacuuccuggacggcaaggagaucaacgaccugcucaccacgcugaucagcaaguucgacaacaucaaggaguuccugaagaucaugaaguccagcgccgucgacguggagugcgagcucaccgccggguacaagcuguucaacgacagccagcggaucaccaacgagcuguucaucgucaagaacaucgccuccaugcgcaagccggccgcgagcgccaagcugaccauguuccgcgacgcccucacgauccugggcaucgacgacaagaucaccgacgaccggaucuccgggauccugaagcucaaggagaagggcaaggggauccacggccugcgcaacuucaucaccaacaacgugaucgagagcucccgguucguguaccugaucaaguacgccaacgcccagaagauccgcgaggucgcgaagaacgagaagguggugauguucguccucggcgggauccccgacacccagaucgagcgguacuacaagagcugcguggaguuccccgacaugaacuccagccugggcgugaagcgcuccgagcuggcccggaugaucaagaacaucagcuucgacgacuucaagaacgucaagcagcaggccaaggggcgcgagaacguggccaaggagcgggccaaggcggugaucggccucuaccugacggucauguaccugcucgugaagaaccuggugaacgucaacgcccgcuacgugaucgccauccacugccuggagcgggacuucgggcucuacaaggagaucauccccgagcuggccuccaagaaccugaagaacgacuaccgcauccucagccagacccugugcgagcugugcgacaaguccccgaaccucuuccugaagaagaacgagcggcugcgcaagugcguggaggucgacaucaacaacgcggacagcuccaugacccggaaguacgccaacugcaucgccgcccucaccguggugcgcgagcugaaggaguacaucggcgacaucugcacggucgacagcuacuucuccaucuaccacuacgugaugcagcggugcaucaccaagcgcgagaacgacaccaagcaggaggagaagaucaaguacgaggacgaccugcucaagaaccacggcuacaccaaggacuucgugaaggcccugaacagccccuucggguacaacaucccccgguucaagaaccugagcaucgagcagcuguucgaccgcaacgaguaccugacggagaaguaccccuacgacgucccggacuacgcguga

SEQ ID NO: 14346 - RNA, 2859 nt, Artificial Sequence
  Cas13d variant__Uncultured Ruminococcus sp. __NLS-UrCas13d-NLS-HA
augagccccaagaagaagcgcaagguggaggccuccgccaagaagaacaagaugaagccgcgggagcugcgcgaggcgcagaagaaggcccggcagcucaaggccgccgagaucaacaacaacgccgcgcccgccaucgccgccaugcccgcggccgaggucaucgcccccgccgccgagaagaagaaguccagcgugaaggcggccggcaugaaguccauccuggugagcgagaacaagauguacaucaccagcuucgggaagggcaacuccgccguccuggaguacgagguggacaacaacgacuacaaccagacccagcucagcuccaaggacaacagcaacauccagcucgggggcgugaacgaggucaacaucacguucuccagcaagcacggguucgaguccggcguggagaucaacaccagcaacccgacccaccgcuccggcgagagcucccccgugcgcggggacaugcugggccucaagagcgagcuggagaagcgguucuucgggaagaccuucgacgacaacauccacauccagcugaucuacaacauccucgacaucgagaagauccuggccgucuacgugacgaacaucguguacgcccugaacaacaugcucggcgucaagggguccgagagccacgacgacuucaucggcuaccugagcaccaacaacaucuacgacguguucaucgaccccgacaacuccagccuguccgacgacaagaaggcgaacgugcgcaagagccucuccaaguucaacgcccugcugaagaccaagcggcucggcuacuucgggcuggaggagcccaagaccaaggacaaccgggucagccaggccuacaagaagcgcguguaccacaugcuggccaucgugggccagauccggcagugcgucuuccacgacaaguccggggccaagcgcuucgaccucuacagcuucaucaacaacaucgacccggaguaccgggacacgcuggacuaccugguggaggagcgccucaaguccaucaacaaggacuucaucgaggacaacaaggugaacaucagccugcugaucgacaugaugaagggcuacgaggcggacgacaucauccggcucuacuacgacuucaucguccugaagucccagaagaaccugggcuucagcaucaagaagcuccgcgagaagaugcuggacgaguacggguuccgguucaaggacaagcaguacgacuccgugcgcagcaagauguacaagcugauggacuuccuccuguucugcaacuacuaccggaacgacaucgccgccggcgagucccuggugcgcaagcuccgguucagcaugaccgacgacgagaaggaggggaucuacgccgacgaggccgcgaagcuguggggcaaguuccgcaacgacuucgagaacaucgccgaccacaugaacggggacgucaucaaggagcugggcaaggccgacauggacuucgacgagaagauccucgacuccgagaagaagaacgccagcgaccugcuguacuucuccaagaugaucuacaugcucaccuacuuccuggacggcaaggagaucaacgaccugcucaccacgcugaucagcaaguucgacaacaucaaggaguuccugaagaucaugaaguccagcgcgguggacgucgagugcgagcucaccgccggguacaagcuguucaacgacagccagcgcaucaccaacgagcuguucaucgugaagaacaucgccuccaugcggaagcccgccgccagcgcgaagcugaccauguuccgcgacgcccucacgauccugggcaucgacgacaagaucaccgacgaccggaucuccgggauccugaagcucaaggagaagggcaaggggauccacggccugcgcaacuucaucaccaacaacgugaucgagagcucccgguucgucuaccugaucaaguacgccaacgcccagaagauccgcgagguggccaagaacgagaagguggucauguucgugcucggcgggauccccgacacccagaucgagcgguacuacaagagcugcguggaguuccccgacaugaacuccagccugggcgucaagcgcuccgagcuggcgcggaugaucaagaacaucagcuucgacgacuucaagaacgugaagcagcaggccaaggggcgcgagaacguggccaaggagcgggccaaggccgucaucggccucuaccugacggugauguaccugcucgugaagaaccuggucaacgugaacgcgcgcuacgugaucgccauccacugccuggagcgggacuucgggcucuacaaggagaucaucccggagcuggccuccaagaaccugaagaacgacuaccgcauccucagccagacccugugcgagcugugcgacaagucccccaaccucuuccugaagaagaacgagcggcugcgcaagugcgucgagguggacaucaacaacgccgacagcuccaugacccggaaguaccgcaacugcaucgcgcaccucaccgugguccgggagcugaaggaguacaucggcgacaucugcacgguggacagcuacuucagcaucuaccacuacgugaugcagcgcugcaucaccaagcgcgagaacgacaccaagcaggaggagaagaucaaguacgaggacgaccugcucaagaaccacggcuacaccaaggacuucgucaaggcccugaacucccccuucggguacaacaucccccgguucaagaaccugagcaucgagcagcuguucgaccgcaacgaguaccugacggagaagggcuccgggccgaagaagaagcggaagguggccgccgccuaccccuacgacgugcccgacuacgcguga

SEQ ID NO: 14347 - RNA, 2859 nt, Artificial Sequence
  Cas13d variant__Uncultured Ruminococcus sp. __NLS-dUrCas13d-NLS-HA
augagccccaagaagaagcgcaagguggaggccuccgccaagaagaacaagaugaagccgcgggagcugcgcgaggcgcagaagaaggcccggcagcucaaggccgccgagaucaacaacaacgccgcgcccgccaucgccgccaugcccgcggccgaggucaucgcccccgccgccgagaagaagaaguccagcgugaaggcggccggcaugaaguccauccuggugagcgagaacaagauguacaucaccagcuucgggaagggcaacuccgccguccuggaguacgagguggacaacaacgacuacaaccagacccagcucagcuccaaggacaacagcaacauccagcucgggggcgugaacgaggucaacaucacguucuccagcaagcacggguucgaguccggcguggagaucaacaccagcaacccgacccaccgcuccggcgagagcucccccgugcgcggggacaugcugggccucaagagcgagcuggagaagcgguucuucgggaagaccuucgacgacaacauccacauccagcugaucuacaacauccucgacaucgagaagauccuggccgucuacgugacgaacaucguguacgcccugaacaacaugcucggcgucaagggguccgagagccacgacgacuucaucggcuaccugagcaccaacaacaucuacgacguguucaucgaccccgacaacuccagccuguccgacgacaagaaggcgaacgugcgcaagagccucuccaaguucaacgcccugcugaagaccaagcggcucggcuacuucgggcuggaggagcccaagaccaaggacaaccgggucagccaggccuacaagaagcgcguguaccacaugcuggccaucgugggccagaucgcccagugcgucuucgcggacaaguccggggccaagcgguucgaccucuacagcuucaucaacaacaucgacccggaguaccgcgacacgcuggacuaccugguggaggagcggcucaaguccaucaacaaggacuucaucgaggacaacaaggugaacaucagccugcugaucgacaugaugaagggcuacgaggccgacgacaucauccgccucuacuacgacuucaucguccugaagucccagaagaaccugggcuucagcaucaagaagcuccgggagaagaugcuggacgaguacggguuccgcuucaaggacaagcaguacgacuccgugcggagcaagauguacaagcugauggacuuccuccuguucugcaacuacuaccgcaacgacaucgccgccggcgagucccuggugcggaagcuccgcuucagcaugaccgacgacgagaaggaggggaucuacgcggacgaggccgccaagcuguggggcaaguuccggaacgacuucgagaacaucgccgaccacaugaacggggacgucaucaaggagcugggcaaggcggacauggacuucgacgagaagauccucgacuccgagaagaagaacgccagcgaccugcuguacuucuccaagaugaucuacaugcucaccuacuuccuggacggcaaggagaucaacgaccugcucaccacgcugaucagcaaguucgacaacaucaaggaguuccugaagaucaugaaguccagcgccguggacgucgagugcgagcucaccgccggguacaagcuguucaacgacagccagcgcaucaccaacgagcuguucaucgugaagaacaucgccuccaugcgcaagcccgcggccagcgccaagcugaccauguuccgggacgcccucacgauccugggcaucgacgacaagaucaccgacgaccgcaucuccgggauccugaagcucaaggagaagggcaaggggauccacggccugcggaacuucaucaccaacaacgugaucgagagcucccgcuucgucuaccugaucaaguacgccaacgcgcagaagauccgggagguggccaagaacgagaagguggucauguucgugcucggcgggauccccgacacccagaucgagcgcuacuacaagagcugcguggaguuccccgacaugaacuccagccugggcgucaagcgguccgagcuggcccgcaugaucaagaacaucagcuucgacgacuucaagaacgugaagcagcaggccaaggggcgggagaacguggccaaggagcgcgcgaaggccgucaucggccucuaccugacggugauguaccugcucgugaagaaccuggucaacgugaacgcccgguacgugaucgccauccacugccuggagcgcgacuucgggcucuacaaggagaucaucccggagcuggcguccaagaaccugaagaacgacuaccggauccucagccagacccugugcgagcugugcgacaagucccccaaccucuuccugaagaagaacgagcgccugcggaagugcgucgagguggacaucaacaacgccgacagcuccaugacccgcaaguacgccaacugcaucgccgcccucaccgugguccgggagcugaaggaguacaucggcgacaucugcacgguggacagcuacuucagcaucuaccacuacgugaugcagcgcugcaucaccaagcgggagaacgacaccaagcaggaggagaagaucaaguacgaggacgaccugcucaagaaccacggcuacaccaaggacuucgucaaggcgcugaacucccccuucggguacaacaucccccgcuucaagaaccugagcaucgagcagcuguucgaccgcaacgaguaccugacggagaagggcuccgggccgaagaagaagcggaagguggccgccgccuaccccuacgacgugcccgacuacgccuga

SEQ ID NO: 14348 - RNA, 4275 nt, Artificial Sequence
  Cas13d variant__Leptotrichia wadei __NLS-LwCas13a-msfGFP
augaagcgccccgccgccaccaagaaggcgggccaggccaagaagaagaaggggagcaugaaggugaccaaggucgacggcaucucccacaagaaguacaucgaggaggggaagcuggucaagagcacguccgaggagaaccggaccagcgagcgccucuccgagcugcugagcauccggcucgacaucuacaucaagaacccggacaacgccuccgaggaggagaaccgcauccggcgcgagaaccugaagaaguucuucagcaacaaggugcugcaccucaaggacuccgugcuguaccugaagaaccggaaggagaagaacgccgugcaggacaagaacuacagcgaggaggacaucuccgaguacgaccucaagaacaagaacagcuucuccgugcugaagaagauccugcucaacgaggacgucaacagcgaggagcuggagaucuuccgcaaggacguggaggccaagcugaacaagaucaacucccucaaguacagcuucgaggagaacaaggcgaacuaccagaagaucaacgagaacaacguggagaaggucggcgggaaguccaagcggaacaucaucuacgacuacuaccgcgagagcgccaagcggaacgacuacaucaacaacgugcaggaggccuucgacaagcuguacaagaaggaggacaucgagaagcuguucuuccucaucgagaacuccaagaagcacgagaaguacaagauccgcgaguacuaccacaagaucaucggccggaagaacgacaaggagaacuucgccaagaucaucuacgaggagauccagaacgugaacaacaucaaggagcugaucgagaagauccccgacaugagcgagcugaagaagucccaggucuucuacaaguacuaccucgacaaggaggagcugaacgacaagaacaucaaguacgcguucugccacuucguggagaucgagaugagccagcugcucaagaacuacguguacaagcgccugagcaacaucuccaacgacaagaucaagcggaucuucgaguaccagaaccugaagaagcucaucgagaacaagcugcugaacaagcucgacaccuacguccgcaacugcggcaaguacaacuacuaccuccaggugggggagaucgccaccagcgacuucaucgcccggaaccgccagaacgaggccuuccugcggaacaucaucggcguguccagcgucgccuacuucucccuccgcaacauccuggagacggagaacgagaacgggaucaccggccggaugcgcgggaagaccgugaagaacaacaagggcgaggagaaguacgugagcggcgaggucgacaagaucuacaacgagaacaagcagaacgaggugaaggagaaccugaagauguucuacuccuacgacuucaacauggacaacaagaacgagaucgaggacuucuucgcgaacaucgacgaggccaucagcuccauccgccacgggaucgugcacuucaaccucgagcuggagggcaaggacaucuucgccuucaagaacaucgcccccagcgagaucuccaagaagauguuccagaacgagaucaacgagaagaagcugaagcucaagaucuucaagcagcugaacagcgccaacgucuucaacuacuacgagaaggacgugaucaucaaguaccugaagaacaccaaguucaacuucgucaacaagaacauccccuucgugccguccuucacgaagcucuacaacaagaucgaggaccugcggaacacccugaaguucuucuggagcgugcccaaggacaaggaggagaaggacgcgcagaucuaccuccugaagaacaucuacuacggggaguuccugaacaaguucgucaagaacuccaagguguucuucaagaucaccaacgaggugaucaagaucaacaagcagcgcaaccagaagaccggccacuacaaguaccagaaguucgagaacaucgagaagacgguccccguggaguaccucgccaucauccagagccgggagaugaucaacaaccaggacaaggaggagaagaacaccuacaucgacuucauccagcagaucuuccugaagggcuucaucgacuaccugaacaagaacaaccugaaguacaucgaguccaacaacaacaacgacaacaacgacaucuucagcaagaucaagaucaagaaggacaacaaggagaaguacgacaagauccucaagaacuacgagaagcacaaccgcaacaaggagaucccccacgagaucaacgaguucgugcgggagaucaagcuggggaagauccugaaguacaccgagaaccucaacauguucuaccugauccugaagcuccugaaccacaaggagcugaccaaccucaagggcagccuggagaaguaccaguccgccaacaaggaggagacguucagcgacgagcuggagcucaucaaccugcugaaccucgacaacaaccgcgucaccgaggacuucgagcuggaggccaacgagaucgggaaguuccuggacuucaacgagaacaagaucaaggaccggaaggagcucaagaaguucgacaccaacaagaucuacuucgacggcgagaacaucaucaagcaccgcgccuucuacaacaucaagaaguacgggaugcugaaccugcucgagaagaucgcggacaaggccaaguacaagaucucccugaaggagcugaaggaguacagcaacaagaagaacgagaucgagaagaacuacaccaugcagcagaaccuccaccggaaguacgcccgcccgaagaaggacgagaaguucaacgacgaggacuacaaggaguacgagaaggccaucggcaacauccagaaguacacgcaccugaagaacaagguggaguucaacgagcugaaccuccugcagggccugcuccugaagauccugcaccggcucgugggguacaccuccaucugggagcgcgaccugcgguuccgccugaagggcgaguuccccgagaaccacuacaucgaggagaucuucaacuucgacaacagcaagaacgucaaguacaaguccgggcagaucguggagaaguacaucaacuucuacaaggagcucuacaaggacaacguggagaagcggagcaucuacuccgacaagaaggucaagaagcugaagcaggagaagaaggaccuguacauccgcaacuacaucgcccacuucaacuacaucccccacgcggagaucagccuccuggaggugcuggagaaccuccggaagcugcuguccuacgaccgcaagcucaagaacgccaucaugaaguccaucguggacauccugaaggaguacggcuucgucgccaccuucaagaucggggccgacaagaagaucgagauccagacccuggagagcgagaagaucgugcaccucaagaaccugaagaagaagaagcugaugacggaccggaacagcgaggagcucugcgagcuggugaaggucauguucgaguacaaggcgcuggagggcggcgggggcuccgggggcgggggcagcggcgggggcggguccgugagcaagggcgaggagcuguucaccggcgugguccccauccugguggagcuggacggggacgugaacggccacaaguucagcguccgcggggagggcgagggggacgccaccaacggcaagcucacccugaaguucaucugcacgaccggcaagcugccggugcccuggcccacccucgugaccacgcugaccuacgggguccagugcuucucccgcuaccccgaccacaugaagcagcacgacuucuucaagagcgccaugccggagggcuacgugcaggagcggaccaucuccuucaaggacgacgggaccuacaagacgcgcgccgaggugaaguucgagggcgacacccuggucaaccggaucgagcucaaggggaucgacuucaaggaggacggcaacauccugggccacaagcuggaguacaacuucaacagccacaacguguacaucaccgccgacaagcagaagaacgggaucaaggcgaacuucaagauccgccacaacguggaggacggcuccguccagcucgccgaccacuaccagcagaacacccccaucggggacggccccgugcugcugcccgacaaccacuaccucagcacccaguccaagcugagcaaggacccgaacgagaagcgggaccacauggugcugcucgaguucgucacggccgccgggaucacccugggcauggacgagcuguacaaguga

SEQ ID NO: 14349 - RNA, 4275 nt, Artificial Sequence
  Cas13d variant__Leptotrichia wadei __NLS-dLwCas13a-msfGFP
augaagcgccccgccgccaccaagaaggcgggccaggccaagaagaagaaggggagcaugaaggugaccaaggucgacggcaucucccacaagaaguacaucgaggaggggaagcuggucaagagcacguccgaggagaaccggaccagcgagcgccucuccgagcugcugagcauccggcucgacaucuacaucaagaacccggacaacgccuccgaggaggagaaccgcauccggcgcgagaaccugaagaaguucuucagcaacaaggugcugcaccucaaggacuccgugcuguaccugaagaaccggaaggagaagaacgccgugcaggacaagaacuacagcgaggaggacaucuccgaguacgaccucaagaacaagaacagcuucuccgugcugaagaagauccugcucaacgaggacgucaacagcgaggagcuggagaucuuccgcaaggacguggaggccaagcugaacaagaucaacucccucaaguacagcuucgaggagaacaaggcgaacuaccagaagaucaacgagaacaacguggagaaggucggcgggaaguccaagcggaacaucaucuacgacuacuaccgcgagagcgccaagcggaacgacuacaucaacaacgugcaggaggccuucgacaagcuguacaagaaggaggacaucgagaagcuguucuuccucaucgagaacuccaagaagcacgagaaguacaagauccgcgaguacuaccacaagaucaucggccggaagaacgacaaggagaacuucgccaagaucaucuacgaggagauccagaacgugaacaacaucaaggagcugaucgagaagauccccgacaugagcgagcugaagaagucccaggucuucuacaaguacuaccucgacaaggaggagcugaacgacaagaacaucaaguacgcguucugccacuucguggagaucgagaugagccagcugcucaagaacuacguguacaagcgccugagcaacaucuccaacgacaagaucaagcggaucuucgaguaccagaaccugaagaagcucaucgagaacaagcugcugaacaagcucgacaccuacguccgcaacugcggcaaguacaacuacuaccuccaggugggggagaucgccaccagcgacuucaucgcccggaaccgccagaacgaggccuuccugcggaacaucaucggcguguccagcgucgccuacuucucccuccgcaacauccuggagacggagaacgagaacgggaucaccggccggaugcgcgggaagaccgugaagaacaacaagggcgaggagaaguacgugagcggcgaggucgacaagaucuacaacgagaacaagcagaacgaggugaaggagaaccugaagauguucuacuccuacgacuucaacauggacaacaagaacgagaucgaggacuucuucgcgaacaucgacgaggccaucagcuccaucgcccacgggaucgugcacuucaaccucgagcuggagggcaaggacaucuucgccuucaagaacaucgcccccagcgagaucuccaagaagauguuccagaacgagaucaacgagaagaagcugaagcucaagaucuucaagcagcugaacagcgcgaacgucuucaacuacuacgagaaggacgugaucaucaaguaccugaagaacaccaaguucaacuucgucaacaagaacauccccuucgugccguccuucacgaagcucuacaacaagaucgaggaccugcgcaacacccugaaguucuucuggagcgugcccaaggacaaggaggagaaggacgcccagaucuaccuccugaagaacaucuacuacggggaguuccugaacaaguucgucaagaacuccaagguguucuucaagaucaccaacgaggugaucaagaucaacaagcagcggaaccagaagaccggccacuacaaguaccagaaguucgagaacaucgagaagacgguccccguggaguaccucgccaucauccagagccgcgagaugaucaacaaccaggacaaggaggagaagaacaccuacaucgacuucauccagcagaucuuccugaagggcuucaucgacuaccugaacaagaacaaccugaaguacaucgaguccaacaacaacaacgacaacaacgacaucuucagcaagaucaagaucaagaaggacaacaaggagaaguacgacaagauccucaagaacuacgagaagcacaaccggaacaaggagaucccccacgagaucaacgaguucgugcgcgagaucaagcuggggaagauccugaaguacaccgagaaccucaacauguucuaccugauccugaagcuccugaaccacaaggagcugaccaaccucaagggcagccuggagaaguaccaguccgccaacaaggaggagacguucagcgacgagcuggagcucaucaaccugcugaaccucgacaacaaccgggucaccgaggacuucgagcuggaggccaacgagaucgggaaguuccuggacuucaacgagaacaagaucaaggaccgcaaggagcucaagaaguucgacaccaacaagaucuacuucgacggcgagaacaucaucaagcaccgggcguucuacaacaucaagaaguacgggaugcugaaccugcucgagaagaucgccgacaaggccaaguacaagaucucccugaaggagcugaaggaguacagcaacaagaagaacgagaucgagaagaacuacaccaugcagcagaaccuccaccgcaaguacgcccggccgaagaaggacgagaaguucaacgacgaggacuacaaggaguacgagaaggccaucggcaacauccagaaguacacgcaccugaagaacaagguggaguucaacgagcugaaccuccugcagggccugcuccugaagauccugcaccgccucgugggguacaccuccaucugggagcgggaccugcgcuuccggcugaagggcgaguuccccgagaaccacuacaucgaggagaucuucaacuucgacaacagcaagaacgucaaguacaaguccgggcagaucguggagaaguacaucaacuucuacaaggagcucuacaaggacaacguggagaagcgcagcaucuacuccgacaagaaggucaagaagcugaagcaggagaagaaggaccuguacaucgcgaacuacaucgcccacuucaacuacaucccccacgccgagaucagccuccuggaggugcuggagaaccuccggaagcugcuguccuacgaccgcaagcucaagaacgccaucaugaaguccaucguggacauccugaaggaguacggcuucgucgcgaccuucaagaucggggccgacaagaagaucgagauccagacccuggagagcgagaagaucgugcaccucaagaaccugaagaagaagaagcugaugacggaccggaacagcgaggagcucugcgagcuggugaaggucauguucgaguacaaggcccuggagggcggcgggggcuccgggggcgggggcagcggcgggggcggguccgugagcaagggcgaggagcuguucaccggcgugguccccauccugguggagcuggacggggacgugaacggccacaaguucagcguccgcggggagggcgagggggacgccaccaacggcaagcucacccugaaguucaucugcacgaccggcaagcugccggugcccuggcccacccucgugaccacgcugaccuacgggguccagugcuucucccgguaccccgaccacaugaagcagcacgacuucuucaagagcgccaugccggagggcuacgugcaggagcgcaccaucuccuucaaggacgacgggaccuacaagacgcgcgcggaggugaaguucgagggcgacacccuggucaaccggaucgagcucaaggggaucgacuucaaggaggacggcaacauccugggccacaagcuggaguacaacuucaacagccacaacguguacaucaccgccgacaagcagaagaacgggaucaaggccaacuucaagauccgccacaacguggaggacggcuccguccagcucgccgaccacuaccagcagaacacccccaucggggacggccccgugcugcugcccgacaaccacuaccucagcacccaguccaagcugagcaaggacccgaacgagaagcgggaccacauggugcugcucgaguucgucacggccgcggggaucacccugggcauggacgagcuguacaaguga

SEQ ID NO: 14350 - RNA, 2868 nt, Artificial Sequence
  Cas13d variant__Anaerobic digester metagenome 15706__AdmCas13d-HA
augaacaauaagagaaaaaccaaggccaaagcugcaggccugaaaagcguguucuuugaccagaaacaagccguccucacaacuuucgcgaaggggaacaauucccagaucgagaagaaaguugugaacucugaaguaaaggaucuuaggcagcccccugcuuuugaccuggaguugaaagaaaagacguucuacauuucaggaaagaauaacauaaauaccagucgggagaacccauuagccagcgcaucccugccgcuaucuaagcgccagcgaauccgugccgaaagaauuaagagggcucgggaggagaaucgccccuaucacaacgugaaaagagucggugaagaugaccucagggcaaaggccgaucuggagaaacauuacuuuggcaaggaauauucggacaaucuuaaaauccaaauuaucuacaacauacuggauaucaauaagauuaucucaccuuauauuaacgacaucguguacagcaugaauaacuuggcucggaacgaugaguauauagacgggaaaauugauguuaucggaagucucuccucuacaacugacuacagcuccuucaugucaccaaauaaggaucuggagaaggagaaaaaguuuaguuuccaccgcgaaaacuacaaaaaguuuguggaagccagcaaacccuauaugcgauacuauggcaaggucuucauuagagacgugaagaaaucuaagcuguccaccgguaaaggggagaagaucgaaguaauguacaggucagacgaggagaucuuuacaauuuuccagauacucagcuauguucggcagaguaucaugcauaaugauauuggaaacaaaucuuccaucuuagcgauagaaaaguacccugcacguuuugugggcuuccugagcgaccuuuugaagaccaaaacuaaugaugucaaccgcauguucauugacaauaacucgcagacaaauuuuugggugcuguucucuaucuuuggccuacaagaucacaccuccggggccgacaagaucugcagaaacuucuaugauuuugugauuaaagcugacucaaagaaucucggauucagucugaaaaagaucagggagcuuaugcuggauuugccaaacgccaauaugcuccgggaccaucaguuugauacgguccgaagcaaguucuacacucuguuagacuuuauuauauaccagcacuaucuggaagagaaaucccgcaucgacaacaugguugaaaagcucagaaugacccuuaaagaggaggaaaaggaggugcuguacgcagcugaagccaaaauuguauggaaugcgaucggugccaaggugaucaacaaauugguccccaugaugaacggcgaugcacuaaaggagauuaagaggaaaaaucgggaccgcaagcugccucagucugugauagcuacaguucaagugaacagcgaugccaaugucuucucagggcucaucuauuuucugacucuuuuccuggacggaaaagaaauuaacgagauggugaguaauuugaucaccaaguuugagaacauugauucccuccugcacguagacagagaaaucuacaaaagcgaugagaaggacuuagaucuggaaauagagaagcuagcucucuucuucaaaggcguugugaggccaaaugccaagacagacaccggugcaggggagaucucuaaaucauuuaguauuuuccagagcgccgaacguaucauugaggaacugaaguuuaucaaaaacgucacgcggauggauaaugagauauucccguccgaaggaguguuucuugacgcugcgaacgucuugggcgugcgaggcgaugacuucgacuuuucuaaugaguucguuggggaugaccugcauucggaugcaaacaagaagauuaucaauaaaauuaacggaacuaaggaggacagaaaucucaggaacuuuaucauaaacaaugugguaaaaagccgccgguuccaguauaucgccagacacaugaacacacauuacgucaagcaacuggcuaauaacgaaacccuuaauagguuugugcugaacaaaaugggugaugccaagauuaucaaucgcuauuacgaguccauuucaggcaacacucccaauaucgaaguucgaagucagauagacuacuuggugaagcggcuccguucuuucagcuuugaggaucugaacgacgucaaacagaaggugagaccugggacaaaugaauccauugagaaagagaagaaaaaggcauuaguaggacugugucuaaccauccaguaucucguguacaaaaaccugguuaauaucaacgccagguauacgaccgcuuucuacugccuugaacgcgauucaaaguugaagggcuucggugucgacguguggcgggauuuugagagcuauacagcccugacuaaucacuucauuaaagaaggguaccucccagugagaaaggcagagauccugagggcgaacuuaaaacaccuggacugugaagauggcuuuaaguauuaccgaaaccaagucacccaucuuaaugcuauucgcguugccuacaaauauauaaacgagaucaagucugugcacuccuacuucgcauuguaucauuacauuaugcagcggcaccucuaugacagucugcaggccaaggcuaaagacagcucuggauuugugaucgaugcccuaaagaaauccuucgagcauaagauuuacucaaaagaccugcuccacguacugcacagucccuuuggcuauaauacagcaagauacaagaaccuuagcaucgaggcuuuguucgauaagaaugaaucgaggccugaagucaacccacuguccacuaaugacuaccccuaugaugugccggacuacgccuga

SEQ ID NO: 14351 - RNA, 2868 nt, Artificial Sequence
  Cas13d variant__Anaerobic digester metagenome 15706__dAdmCas13d-HA
augaacaauaagagaaaaaccaaggccaaagcugcaggccugaaaagcguguucuuugaccagaaacaagccguccucacaacuuucgcgaaggggaacaauucccagaucgagaagaaaguugugaacucugaaguaaaggaucuuaggcagcccccugcuuuugaccuggaguugaaagaaaagacguucuacauuucaggaaagaauaacauaaauaccagucgggagaacccauuagccagcgcaucccugccgcuaucuaagcgccagcgaauccgugccgaaagaauuaagagggcucgggaggagaaucgccccuaucacaacgugaaaagagucggugaagaugaccucagggcaaaggccgaucuggagaaacauuacuuuggcaaggaauauucggacaaucuuaaaauccaaauuaucuacaacauacuggauaucaauaagauuaucucaccuuauauuaacgacaucguguacagcaugaauaacuuggcucggaacgaugaguauauagacgggaaaauugauguuaucggaagucucuccucuacaacugacuacagcuccuucaugucaccaaauaaggaucuggagaaggagaaaaaguuuaguuuccaccgcgaaaacuacaaaaaguuuguggaagccagcaaacccuauaugcgauacuauggcaaggucuucauuagagacgugaagaaaucuaagcuguccaccgguaaaggggagaagaucgaaguaauguacaggucagacgaggagaucuuuacaauuuuccagauacucagcuauguugcgcagaguaucauggcaaaugauauuggaaacaaaucuuccaucuuagccauagaaaaguacccugcucgguuugugggcuuccugagcgaccuuuugaagaccaaaacuaaugaugucaaccguauguucauugacaauaacucgcagacaaauuuuugggugcuguucucuaucuuuggccuacaagaucauaccuccggggccgacaagaucugccgcaacuucuaugauuuugugauuaaagcagacucaaagaaucucggauucagucugaaaaagaucagagagcuuaugcuggauuugccaaacgcuaauaugcucagggaccaccaguuugauacgguccggagcaaguucuacacucuguuagacuuuauuauauaccagcauuaucuggaagagaaaucccgaaucgacaacaugguugaaaagcuccgcaugacccuuaaagaggaggaaaaggaggugcuguacgccgcggaagccaaaauuguauggaaugcaaucggugcuaaggugaucaacaaauugguccccaugaugaacggcgaugcccuaaaggagauuaagaggaaaaauagagaccggaagcugccucagucugugauagcuacaguucaagugaacagcgaugccaaugucuucucagggcucaucuauuuucugacucuuuuccuggacggaaaagaaauuaacgagauggugaguaauuugaucaccaaguuugagaacauugauucccuccugcacguagaccgcgaaaucuacaaaagcgaugagaaggacuuagaucuggaaauagagaagcuagcacucuucuucaaaggcguugugagaccaaaugccaagacagacaccggugcuggggagaucucuaaaucauuuaguauuuuccagagcgcggaaaggaucauugaggaacugaaguuuaucaaaaacgucacgcguauggauaaugagauauucccguccgaaggaguguuucuugacgcagccaacgucuugggcgugcggggcgaugacuucgacuuuucuaaugaguucguuggggaugaccugcacucggaugcuaacaagaagauuaucaauaaaauuaacggaacuaaggaggaccgaaaucucagaaacuuuaucauaaacaaugugguaaaaagcaggcgcuuccaguauaucgcccggcauaugaacacacacuacgucaagcaacuggcaaauaacgaaacccuuaauagauuugugcugaacaaaaugggugaugccaagauuaucaauagguauuacgaguccauuucaggcaacacucccaauaucgaaguucgcagucagauagacuacuuggugaagcgacuccggucuuucagcuuugaggaucugaacgacgucaaacagaaggugcguccugggacaaaugaauccauugagaaagagaagaaaaaggcuuuaguaggacugugucuaaccauccaguaucucguguacaaaaaccugguuaauaucaacgccagauauacgaccgcauucuacugccuugaaagggauucaaaguugaagggcuucggugucgacguguggcgcgauuuugagagcuauacagcgcugacuaaucauuucauuaaagaaggguaccucccagugcggaaggcugagauccugagagccaacuuaaaacaccuggacugugaagauggcuuuaaguauuacgcaaaccaagucaccgcccuuaaugcuauuaggguugccuacaaauauauaaacgagaucaagucugugcacuccuacuucgcauuguaucauuacauuaugcagcgacaccucuaugacagucugcaggcuaaggccaaagacagcucuggauuugugaucgaugcgcuaaagaaauccuucgagcauaagauuuacucaaaagaccugcuccacguacugcauagucccuuuggcuauaauacagcccgcuacaagaaccuuagcaucgaggcuuuguucgauaagaaugaaucgcggccugaagucaacccacuguccacuaaugacuaccccuaugaugugccggacuacgcauga

SEQ ID NO: 14352 - RNA, 2940 nt, Artificial Sequence
  Cas13d variant__Anaerobic digester metagenome 15706__NLS-AdmCas13d-NLS-HA
augagccccaagaaaaagagaaaaguggaggccuccaacaauaagaggaaaaccaaggcuaaggcagccggccugaaaucugucuucuuugaccagaagcaagcgguucucacaacuuucgcuaaagggaacaauucacagaucgaaaagaaagugguaaacagugaggugaaggaucuucggcagccuccagccuuugaccuggaauugaaggagaaaacguucuacauuagcggaaagaauaacauaaauaccucccgcgaaaacccguuagcaucugccucgcugccccuaucaaaacgacagcguaucagagcugagaggauuaagcgggcacgcgaggaaaauagaccuuaucacaacgucaaaagggugggugaggaugaccuccgggccaaggcugaucuggaaaaacauuacuuuggcaaggaguauagcgacaaucuuaagauccaaauuaucuacaacauacuggauaucaauaaaauuaucaguccauauauuaacgacaucguuuacuccaugaauaacuuggcccgcaacgaugaguauauagacgggaagauugaugugaucggaucucucagcuccacaacugacuacucaaguuucaugagccccaauaaagaucuggaaaaggagaaaaaguuuucuuuccaccgagaaaacuacaagaaauuugucgaggcguccaagccuuauaugagauacuauggcaaaguguucauuagggacguaaagaaaucaaagcugagcaccgguaagggggagaaaaucgagguuauguaccggagugacgaggaaaucuuuacaauuuuccagauacucucuuaugugcgucaguccaucaugcauaaugauauuggaaacaagagcucgaucuuagcaauagagaaauacccagcccgcuuugucggcuuccugucugaccuuuugaagaccaaaacuaaugaugugaacagaauguucauugacaauaacucccagacaaauuuuugggugcuguucucaaucuuuggccuacaagaucacaccaguggggcugacaagaucugcaggaacuucuaugauuuugucauuaaggccgacagcaaaaaucucggauucucccugaagaaaauccgggaacuuaugcuggauuugcccaacgcaaauaugcuccgagaccaucaguuugauacgguucgcucuaaguucuacacucuguuagacuuuauuauauaccagcacuaucuggaggagaaaagcagaaucgacaacaugguggaaaagcucaggaugacccuuaaagaggaagagaaggaaguacuguacgcugccgaggcgaagauuguguggaaugccaucggugcaaaagucaucaacaaguuggugccuaugaugaacggcgaugcucuaaaagaaauuaagcggaaaaaucgcgacagaaagcugccacagucaguuauagccacagugcaagucaacagugaugcuaauguguucuccgggcucaucuauuuucugacucuuuuccuggacggaaaggagauuaacgagaugguaagcaauuugaucaccaaauuugaaaacauugauucucuccugcacguugacagggagaucuacaagucagaugaaaaagacuuagaucuggagauagagaagcuagcccucuucuucaaaggcgugguccguccgaaugcaaagacagacaccggugccggggaaaucaguaagagcuuuuccauuuuccagucugcugagcggaucauugaagaacugaaauuuaucaagaacgugacgcgaauggauaaugaaauauuccccucggagggagucuuucuugacgcggcaaacguguugggcguuagaggcgaugacuucgacuuuagcaaugaguucgugggggaugaccugcauuccgaugccaacaaaaagauuaucaauaaaauuaacggaacuaaggaagacaggaaucuccgcaacuuuaucauaaacaauguagucaagucacggagauuccaguauaucgcuaggcacaugaacacacauuacgugaaacaacuggccaauaacgagacccuuaaucgcuuuguucugaacaagaugggugaugcaaaaauuaucaaucgauauuacgaaaguauuucuggcaacacuccuaauaucgaggugcggagccagauagacuacuuggucaagcgucucagauccuucucauuugaagaucugaacgacgugaaacagaagguaaggccagggacaaaugagagcauugagaaagaaaagaagaaagccuuagugggacugugucuaaccauccaguaucucguuuacaagaaccuggucaauaucaacgcucgcuauacgaccgccuucuacugccuugagcgggauucuaaauugaagggcuucgguguggacguguggagagauuuugaauccuauacagcacugacuaaucacuucauuaaagagggguaccuccccgucaggaaggcggaaauccugcgagcuaacuuaaagcaccuggacugugaggauggcuuuaaauauuaccgcaaccaaguuacccaucuuaaugccauucggguggcauacaaguauauaaacgagaucaaaagugugcacagcuacuucgccuuguaucauuacauuaugcagagacaccucuaugacucucugcaggcuaaggccaaagacuccucaggauuuguaaucgaugcacuaaagaagaguuucgaacauaaaauuuacagcaaggaccugcuccacguccugcacucgccuuuuggcuauaauacagcuagguacaaaaaccuuuccaucgaggccuuguucgauaagaaugaaucucguccagaggugaacccccugagcacuaaugacgggucaggaccgaaaaagaagcgcaaaguugcggccgcuuacccuuaugaugugcccgacuacgcauga

SEQ ID NO: 14353 - RNA, 2940 nt, Artificial Sequence
  Cas13d variant__Anaerobic digester metagenome 15706__NLS-dAdmCas13d-NLS-HA
augagccccaagaaaaagagaaaaguggaggccuccaacaauaagaggaaaaccaaggcuaaggcagccggccugaaaucugucuucuuugaccagaagcaagcgguucucacaacuuucgcuaaagggaacaauucacagaucgaaaagaaagugguaaacagugaggugaaggaucuucggcagccuccagccuuugaccuggaauugaaggagaaaacguucuacauuagcggaaagaauaacauaaauaccucccgcgaaaacccguuagcaucugccucgcugccccuaucaaaacgacagcguaucagagcugagaggauuaagcgggcacgcgaggaaaauagaccuuaucacaacgucaaaagggugggugaggaugaccuccgggccaaggcugaucuggaaaaacauuacuuuggcaaggaguauagcgacaaucuuaagauccaaauuaucuacaacauacuggauaucaauaaaauuaucaguccauauauuaacgacaucguuuacuccaugaauaacuuggcccgcaacgaugaguauauagacgggaagauugaugugaucggaucucucagcuccacaacugacuacucaaguuucaugagccccaauaaagaucuggaaaaggagaaaaaguuuucuuuccaccgagaaaacuacaagaaauuugucgaggcguccaagccuuauaugagauacuauggcaaaguguucauuagggacguaaagaaaucaaagcugagcaccgguaagggggagaaaaucgagguuauguaccggagugacgaggaaaucuuuacaauuuuccagauacucucuuauguggcacaguccaucauggccaaugauauuggaaacaagagcucgaucuuagcuauagagaaauacccagcccguuuugucggcuuccugucugaccuuuugaagaccaaaacuaaugaugugaaccgcauguucauugacaauaacucccagacaaauuuuugggugcuguucucaaucuuuggccuacaagaucauaccaguggggcagacaagaucugcagaaacuucuaugauuuugucauuaaggcugacagcaaaaaucucggauucucccugaagaaaaucagggaacuuaugcuggauuugcccaacgccaauaugcuccgggaccaccaguuugauacgguucgaucuaaguucuacacucuguuagacuuuauuauauaccagcauuaucuggaggagaaaagccgcaucgacaacaugguggaaaagcucagaaugacccuuaaagaggaagagaaggaaguacuguacgcggccgaggcaaagauuguguggaaugcuaucggugccaaagucaucaacaaguuggugccuaugaugaacggcgaugcucuaaaagaaauuaagaggaaaaaucgggaccgcaagcugccacagucaguuauagccacagugcaagucaacagugaugcaaauguguucuccgggcucaucuauuuucugacucuuuuccuggacggaaaggagauuaacgagaugguaagcaauuugaucaccaaauuugaaaacauugauucucuccugcacguugacagagagaucuacaagucagaugaaaaagacuuagaucuggagauagagaagcuagcccucuucuucaaaggcguggucaggccgaaugcuaagacagacaccggugcgggggaaaucaguaagagcuuuuccauuuuccagucugcagagcguaucauugaagaacugaaauuuaucaagaacgugacgcggauggauaaugaaauauuccccucggagggagucuuucuugacgccgcuaacguguugggcguucgaggcgaugacuucgacuuuagcaaugaguucgugggggaugaccugcacuccgaugccaacaaaaagauuaucaauaaaauuaacggaacuaaggaagacagaaaucucaggaacuuuaucauaaacaauguagucaagucacgccgguuccaguauaucgcaagacauaugaacacacacuacgugaaacaacuggccaauaacgagacccuuaauagguuuguucugaacaagaugggugaugcuaaaauuaucaaucgcuauuacgaaaguauuucuggcaacacuccuaauaucgaggugcgaagccagauagacuacuuggucaagcggcuccguuccuucucauuugaagaucugaacgacgugaaacagaagguaagaccagggacaaaugagagcauugagaaagaaaagaagaaagccuuagugggacugugucuaaccauccaguaucucguuuacaagaaccuggucaauaucaacgcaagguauacgaccgcguucuacugccuugagcgcgauucuaaauugaagggcuucgguguggacguguggcgggauuuugaauccuauacagcucugacuaaucauuucauuaaagagggguaccuccccgucagaaaggccgaaauccugagggcaaacuuaaagcaccuggacugugaggauggcuuuaaauauuacgccaaccaaguuaccgcucuuaaugccauucgaguggcauacaaguauauaaacgagaucaaaagugugcacagcuacuucgcuuuguaucauuacauuaugcagcgccaccucuaugacucucugcaggccaaggcgaaagacuccucaggauuuguaaucgaugcccuaaagaagaguuucgaacauaaaauuuacagcaaggaccugcuccacguccugcauucgccuuuuggcuauaauacagcucgguacaaaaaccuuuccaucgaggcauuguucgauaagaaugaaucuagaccagaggugaacccccugagcacuaaugacgggucaggaccgaaaaagaagaggaaaguugccgcugccuacccuuaugaugugcccgacuacgcauga

SEQ ID NO: 14354 - RNA, 2892 nt, Artificial Sequence
  Cas13d variant__Eubacterium siraeum DSM15702__EsCas13d-HA
augggcaagaaaauccacgccagagaccugagggagcagcggaagaccgaucgcacagaaaaauucgcugaccaaaacaagaaacgagaggcagaacgugccgugcccaagaaggaugcggcugucagcguuaaauccgugucuucaguaaguagcaagaaagacaaugugacuaaguccauggccaaagcagccggggucaagucuguguuugcuguuggaaacacgguguacaugaccucguucgguagaggcaaugaugcaguccucgagcagaagauuguggacacaucacaugaaccucuuaacauagaugacccagccuaucagcugaauguaguuacuaugaacggguacagcgugaccggacacaggggcgagacagucagugcugugaccgauaauccguugcggcgcuuuaacgguagaaagaaggacgagcccgaacaguccgugccuacugauauguuaugccugaaaccaacacuagagaagaaauucuuugggaaggaauuugacgauaauauccauauucaacucaucuauaacauucuggacaucgagaaaauacuugccgucuacucuaccaaugcgaucuaugcacugaacaauaugagcgccgacgagaacauugaaaauuccgauuucuucaugaagaggacgacugacgagaccuuugaugacuucgaaaagaaaaaggagucaacaaacagucgggaaaaagcugauuuugacgccuucgagaaguuuaucggaaacuaccgcuuggcauauuucgcugaugccuucuacguuaauaaaaagaaccccaagggcaaagcgaagaaugugcuccgagaggacaaagaacuguacagcguacugacucucauuggcaaguuaagacacuggugugugcauucugaggaagggagggccgaguuuuggcuguauaaacuugaugaauugaaggacgauuucaagaacguccuggacgugguuuacaaucggccuguggaggagaucaacaaucguuuuauagaaaacaauaaagucaacauucagauccuaggauccguguauaagaauaccgacauugcagagcucguacgcucauacuaugaguuccugaucaccaaaaaguacaaaaacauggguuuuagcaucaagaaacuuagagaaaguaugcuggaaggcaaaggguaugcugauaaggaguacgacucuguuaggaauaaauuguaccagaugacagauuucauucucuauacgggauacauaaacgaggacuccgaucgggccgacgaucuggugaauacuuuacgaagcucgcugaaggaagacgauaaaacaaccgucuauugcaaggaggcugacuaccucuggaaaaaguaucgcgaaucuaucagagagguggccgaugcacuugacggcgauaacauuaagaaacuguccaagucaaacaucgagauacaggaagacaaauugaggaaguguuuuauuaguuacgccgacagcgucuccgaguucacuaaacuaaucuaucugcucacacgguuucugucugguaaggaaaucaaugaucuugugaccacgcugauuaacaaguucgacaauauccgcagcuuuuuggagauuauggaugaacucgggcuggacagaaccuucacagcugaguacucauuuuucgagggaaguacuaaauacuuagcggaacugguugagcuaaacuccuucguaaagagcugcucuuuugauauaaaugcaaaaaggaccauguaucgugacgcccucgauauccugggcauugaaucagacaagacagaggaagauaucgagaaaaugaucgacaacauucuucaaauagaugcuaauggcgacaagaaguugaaaaagaacaaugggcugcggaacuucaucgccaguaaugugauugauagcaaccgauuuaaauaccucgucagauauggaaauccaaagaaaaucagggagacugcaaaguguaagcccgccgugcgcuucguucugaacgaaauuccugacgcucagaucgagcgguacuaugaagccugcuguccgaaaaauaccgcacuuugcuccgcgaacaagagaagggagaaacuggcugacaugauagccgaaaucaaguuugagaacuucucugaugcagguaauuaccagaaagccaacgugacaucgcgcaccagcgaggcugaaauuaagcggaaaaaucaggccaucauucgauuguaucucacugucauguacaucaugcugaagaacuuagugaauguaaacgcacguuacgugauagcuuuucacuguguugagagagacacgaagcuguaugccgaauccggccuagaggucgggaauauugagaaaaacaagacaaaucucaccauggcggugaugggagugaaacuggaaaacggcaucauuaagacugaguucgauaaaucauuugccgaaaaugcugcaaacagguaccuucgcaaugcccggugguauaaguugauccuggacaaccucaagaaaagugagagagcugucguuaaugaguucaggaacaccgugugccaccugaacgccauacgaaauaucaacauuaauaucaaggaaauuaaagagguggaaaacuacuuugcauuauaucauuaccugauccaaaagcaccuugagaaucgcuucgcggauaaaaagguagaacgggacacaggugauuuuauaucuaaguuggaggaacauaaaaccuauuguaaggacuucgucaaagccuacugcacuccauucggguacaaccucgugagauauaagaaucugacaauugauggccuauuugacaaaaacuaccccggaaaggaugacagcgacgagcagaaguauccuuacgauguuccagacuaugcuuga

SEQ ID NO: 14355 - RNA, 2892 nt, Artificial Sequence
  Cas13d variant__Eubacterium siraeum DSM15702__dEsCas13d-HA
augggcaagaaaauccacgccagagaccugagggagcagcggaagaccgaucgcacagaaaaauucgcugaccaaaacaagaaacgagaggcagaacgugccgugcccaagaaggaugcggcugucagcguuaaauccgugucuucaguaaguagcaagaaagacaaugugacuaaguccauggccaaagcagccggggucaagucuguguuugcuguuggaaacacgguguacaugaccucguucgguagaggcaaugaugcaguccucgagcagaagauuguggacacaucacaugaaccucuuaacauagaugacccagccuaucagcugaauguaguuacuaugaacggguacagcgugaccggacacaggggcgagacagucagugcugugaccgauaauccguugcggcgcuuuaacgguaggaaaaaggacgagcccgaacaguccgugccuacugauauguuaugccugaaaccaacacuagagaagaaauucuuugggaaggaauuugacgauaauauccauauucaacucaucuauaacauucuggacaucgagaaaauacuugccgucuacucuaccaaugcgaucuaugcacugaacaauaugagcgccgacgagaacauugaaaauuccgauuucuucaugaagagaacgacugacgagaccuuugaugacuucgaaaagaaaaaggagucaacaaacagucgggaaaaagcugauuuugacgccuucgagaaguuuaucggaaacuaccgcuuggcauauuucgcugaugccuucuacguuaauaaaaagaaccccaagggcaaagcgaagaaugugcuccgagaggacaaagaacuguacagcguacugacucucauuggcaaguuagcccacugguguguggcaucugaggaagggagagcugaguuuuggcuguauaaacuugaugaauugaaggacgauuucaagaacguccuggacgugguuuacaauaggccuguggaggagaucaacaaucgguuuauagaaaacaauaaagucaacauucagauccuaggauccguguauaagaauaccgacauugccgagcucguacguucauacuaugaguuccugaucaccaaaaaguacaaaaacauggguuuuagcaucaagaaacuucgcgaaaguaugcuggaaggcaaaggguaugcugauaaggaguacgacucuguuagaaauaaauuguaccagaugacagauuucauucucuauacgggauacauaaacgaggacuccgauagggccgacgaucuggugaauacuuuacggagcucgcugaaggaagacgauaaaacaaccgucuauugcaaggaggcagacuaccucuggaaaaaguaucgagaaucuauccgcgagguggccgaugcucuugacggcgauaacauuaagaaacuguccaagucaaacaucgagauacaggaagacaaauugagaaaguguuuuauuaguuacgcggacagcgucuccgaguucacuaaacuaaucuaucugcucacaagguuucugucugguaaggaaaucaaugaucuugugaccacgcugauuaacaaguucgacaauauccggagcuuuuuggagauuauggaugaacucgggcuggaccgcaccuucacagcagaguacucauuuuucgagggaaguacuaaauacuuagccgaacugguugagcuaaacuccuucguaaagagcugcucuuuugauauaaaugcuaaaagaaccauguauagggacgcccucgauauccugggcauugaaucagacaagacagaggaagauaucgagaaaaugaucgacaacauucuucaaauagaugcaaauggcgacaagaaguugaaaaagaacaaugggcugcguaacuucaucgccaguaaugugauugauagcaaccgguuuaaauaccucguccgauauggaaauccaaagaaaaucagagagacugcuaaguguaagcccgccgugagguucguucugaacgaaauuccugacgcacagaucgagcgcuacuaugaagcgugcuguccgaaaaauaccgcucuuugcuccgccaacaagcggagagagaaacuggcagacaugauagccgaaaucaaguuugagaacuucucugaugcugguaauuaccagaaagccaacgugacaucgaggaccagcgaggcagaaauuaagcgcaaaaaucaggcuaucauucgauuguaucucacugucauguacaucaugcugaagaacuuagugaauguaaacgcccgguacgugauagcguuucauuguguugagcgugacacgaagcuguaugccgaauccggccuagaggucgggaauauugagaaaaacaagacaaaucucaccauggcugugaugggagugaaacuggaaaacggcaucauuaagacugaguucgauaaaucauuugcagaaaaugccgcuaacagauaccuuaggaaugcccgcugguauaaguugauccuggacaaccucaagaaaagugagcgggcagucguuaaugaguucgcgaacaccgugugcgcccugaacgcuauaagaaauaucaacauuaauaucaaggaaauuaaagagguggaaaacuacuuugccuuauaucacuaccugauccaaaagcaccuugagaauagguucgcagauaaaaagguagaacgagacacaggugauuuuauaucuaaguuggaggaacauaaaaccuauuguaaggacuucgucaaggcuuacugcacuccauucggguacaaccucgugcgcuauaagaaucugacaauugauggccuauuugacaaaaacuaccccggaaaggaugacagcgacgagcagaaguauccuuacgauguuccagacuaugccuga

SEQ ID NO: 14356 - RNA, 2964 nt, Artificial Sequence
  Cas13d variant__Eubacterium siraeum DSM15702__NLS-EsCas13d-NLS-HA
augagccccaagaaaaagagaaaaguggaggccuccggcaagaaaauccacgcuagggaccugcgggaacagcgcaagaccgaucgaacagagaaguucgcagaccaaaacaaaaagcgugaagccgagagagcggucccuaaaaaggaugcugccguuucugugaaaucaguaaguagcguguccucuaagaaggacaaugucacuaaaucgauggcaaaggccgcuggggugaaaucaguuuuugcagugggaaacacggucuacaugaccagcuucgguaggggcaaugaugccgugcucgaacagaagauuguagacacaagucaugagccacuuaacauagaugacccggcuuaucagcugaauguugugacuaugaacggguacuccgucaccggacaccggggcgagacagugucugccgugaccgauaaucccuugcgcagauuuaacgguaggaaaaaggacgaaccugagcagagcgucccaacugauauguuaugccugaaacccacacuagaaaagaaguucuuugggaaagaguucgacgauaauauccauauucaacucaucuauaacauucuggacaucgagaagauacuugcgguuuacuccaccaaugcaaucuaugcccugaacaauaugucagcugacgaaaacauugagaauagugauuucuucaugaaacggacgacugacgaaaccuuugaugacuucgagaagaaaaaggaaagcacaaacucucgcgagaaggccgauuuugacgcauucgagaaauuuaucggaaacuaccgauuggcuuauuucgccgaugcguucuacgugaauaagaaaaacccuaagggcaaagccaagaauguacucagagaagacaaggagcuguacuccgugcugacucucauuggcaaauuaaggcacugguguguccauucagaagaggggcgggcagaauuuuggcuguauaaacuugaugaguugaaagacgauuucaagaacgugcuggacguuguguacaaucguccagucgaggaaaucaacaaucgcuuuauagagaacaauaaagugaacauucagauccuaggaagcguauauaagaauaccgacauugcugaacucguuagaaguuacuaugaguuccugaucacaaagaaauacaagaacauggguuuuucuaucaaaaaguugagggaauccaugcuggagggcaaaggguaugccgauaaggaguacgacagcgugcggaauaaauuguaccagaugaccgauuucauucucuauacgggauacauaaacgaagacucggaucgagcugacgaucuggucaauacuuuaagaucuucccugaaggaggacgauaagacaaccguguauugcaaagaagccgacuaccucuggaagaaauaucgcgagucaaucagggaggucgcagaugcccuugacggcgauaacauuaagaaacugaguaagagcaacaucgaaauacaggaggacaaguugcggaaauguuuuauuuccuacgcugacucugugagcgaauuuacuaagcuaaucuaucugcucacacgcuuucugucagguaaagagaucaaugaucuuguuaccacgcugauuaacaaguucgacaauaucagaaguuuucuugaaauuauggaugagcucgggcuggacaggaccuucacagcggaguacuccuuuuucgaaggaagcacuaaauacuuagcagagcugguggaacuaaacucuuucguaaagucaugcaguuuugauauaaaugccaagcguaccauguaucgggacgcucucgauauccugggcauugagagcgacaaaacagaagaggauaucgagaagaugaucgacaacauucuucaaauagaugccaauggcgacaaaaaguugaaaaagaacaaugggcugcgaaacuucaucgcauccaaugucauugauucuaacagauuuaaguaccucgugagguauggaaaucccaaaaagauccgcgaaacugccaaauguaagccugcuguucgguucgugcugaacgagauuccagacgcccagaucgaaagauacuaugaggcaugcuguccgaaaaauaccgcgcuuugcucggcuaacaagaggcgcgaaaaacuggccgacaugauagcagagaucaaguuugagaacuucagcgaugccgguaauuaccagaaggcuaacgucacaucccgaaccucagaagccgagauuaaacggaagaaucaggcaaucauucguuuguaucucacugugauguacaucaugcugaaaaacuuaguaaaugugaacgcuagauacguuauagccuuucacugugucgaaagggacacgaagcuguaugcggagaguggccuagagguggggaauauugaaaagaacaagacaaaucucaccauggccgugaugggagucaagcuggagaacggcaucauuaaaacugaguucgauaagucuuuugcugaaaaugcagccaaccgcuaccuucggaaugcuagaugguauaaauugauccuggacaaccucaagaaaagcgaaagggccguugugaaugaguuccgaaacaccgugugccaccugaacgcaauacgcaauaucaacauuaauaucaaggagauuaaggaaguagagaacuacuuugcguuauaucauuaccugauccaaaaacaccuugaaaaucgguucgccgauaagaaagucgagagagacacaggugauuuuauauccaaguuggaggaacauaaaaccuauuguaaggacuucgugaaggcuuacugcacucccuucggguacaaccucguuagguauaaaaaucugacaauugauggccuauuugacaagaacuacccuggaaaagaugacucagacgagcagaagggcagcgggcccaaaaagaagcguaaaguggccgcagcuuauccauacgaugucccugacuaugccuga

SEQ ID NO: 14357 - RNA, 2964 nt, Artificial Sequence
  Cas13d variant__Eubacterium siraeum DSM15702__NLS-dEsCas13d-NLS-HA
augagccccaagaaaaagagaaaaguggaggccuccggcaagaaaauccacgcuagggaccugcgggaacagcgcaagaccgaucgaacagagaaguucgcagaccaaaacaaaaagcgugaagccgagagagcggucccuaaaaaggaugcugccguuucugugaaaucaguaaguagcguguccucuaagaaggacaaugucacuaaaucgauggcaaaggccgcuggggugaaaucaguuuuugcagugggaaacacggucuacaugaccagcuucgguaggggcaaugaugccgugcucgaacagaagauuguagacacaagucaugagccacuuaacauagaugacccggcuuaucagcugaauguugugacuaugaacggguacuccgucaccggacaccggggcgagacagugucugccgugaccgauaaucccuugcgcagauuuaacgguaggaaaaaggacgaaccugagcagagcgucccaacugauauguuaugccugaaacccacacuagaaaagaaguucuuugggaaagaguucgacgauaauauccauauucaacucaucuauaacauucuggacaucgagaagauacuugcgguuuacuccaccaaugcaaucuaugcccugaacaauaugucagcugacgaaaacauugagaauagugauuucuucaugaaacggacgacugacgaaaccuuugaugacuucgagaagaaaaaggaaagcacaaacucucgcgagaaggccgauuuugacgcauucgagaaauuuaucggaaacuaccgauuggcuuauuucgccgaugcguucuacgugaauaagaaaaacccuaagggcaaagccaagaauguacucagagaagacaaggagcuguacuccgugcugacucucauuggcaaauuagcacacuggugugucgcuucagaagaggggagggccgaauuuuggcuguauaaacuugaugaguugaaagacgauuucaagaacgugcuggacguuguguacaaucggccagucgaggaaaucaacaaucguuuuauagagaacaauaaagugaacauucagauccuaggaagcguauauaagaauaccgacauugcugaacucguucgcaguuacuaugaguuccugaucacaaagaaauacaagaacauggguuuuucuaucaaaaaguugagagaauccaugcuggagggcaaaggguaugccgauaaggaguacgacagcgugaggaauaaauuguaccagaugaccgauuucauucucuauacgggauacauaaacgaagacucggaucgggcagacgaucuggucaauacuuuacgaucuucccugaaggaggacgauaagacaaccguguauugcaaagaagccgacuaccucuggaagaaauaucgcgagucaaucagagaggucgcugaugcgcuugacggcgauaacauuaagaaacugaguaagagcaacaucgaaauacaggaggacaaguugaggaaauguuuuauuuccuacgcagacucugugagcgaauuuacuaagcuaaucuaucugcucacacgguuucugucagguaaagagaucaaugaucuuguuaccacgcugauuaacaaguucgacaauauccgcaguuuucuugaaauuauggaugagcucgggcuggacagaaccuucacagccgaguacuccuuuuucgaaggaagcacuaaauacuuagcugagcugguggaacuaaacucuuucguaaagucaugcaguuuugauauaaaugccaagaggaccauguaucgugacgcacucgauauccugggcauugagagcgacaaaacagaagaggauaucgagaagaugaucgacaacauucuucaaauagaugccaauggcgacaaaaaguugaaaaagaacaaugggcugcggaacuucaucgcuuccaaugucauugauucuaaccgauuuaaguaccucgugagauauggaaaucccaaaaagaucagggaaacugccaaauguaagccugcaguucgcuucgugcugaacgagauuccagacgcgcagaucgaacgguacuaugaggcuugcuguccgaaaaauaccgcccuuugcucggcaaacaagagaagggaaaaacuggccgacaugauagcugagaucaaguuugagaacuucagcgaugccgguaauuaccagaaggcaaacgucacaucccgcaccucagaagcugagauuaaacgaaagaaucaggccaucauucgguuguaucucacugugauguacaucaugcugaaaaacuuaguaaaugugaacgcgcguuacguuauagccuuucauugugucgaaagagacacgaagcuguaugcugagaguggccuagagguggggaauauugaaaagaacaagacaaaucucaccauggcagugaugggagucaagcuggagaacggcaucauuaaaacugaguucgauaagucuuuugccgaaaaugcugccaacagguaccuucgcaaugcacggugguauaaauugauccuggacaaccucaagaaaagcgaaagagcgguugugaaugaguucgccaacaccgugugcgcucugaacgccauaaggaauaucaacauuaauaucaaggagauuaaggaaguagagaacuacuuugcauuauaucacuaccugauccaaaaacaccuugaaaaucgauucgcugauaagaaagucgagcgcgacacaggugauuuuauauccaaguuggaggaacauaaaaccuauuguaaggacuucgugaaggccuacugcacucccuucggguacaaccucguucgguauaaaaaucugacaauugauggccuauuugacaagaacuacccuggaaaagaugacucagacgagcagaagggcagcgggcccaaaaagaagagaaaaguggcagccgcuuauccauacgaugucccugacuaugcguga

SEQ ID NO: 14358 - RNA, 3402 nt, Artificial Sequence
  Cas13d variant__Eubacterium siraeum DSM15702__PspCas13b-NES(HIV)-3xHA
augaacauccccgcccugguggagaaucagaagaaauacuucggcaccuauagcgucauggcuaugcucaacgcacaaacaguucuugaccacauucagaagguggccgauauagaaggggagcagaaugaaaacaaugagaaccugugguuucauccuguaaugucccacuuguacaaugcgaaaaacggauaugacaagcagccagaaaagacuauguucaucauugagagauuacaaucuuacuuuccguuccugaagaucauggcugagaaucagagggaauauucaaacgguaaguacaaacagaaucggguggaggucaacaguaaugauauuuuugaagugcuaaagcgcgccuucggcguucucaaaauguaucgagaccugacgaaccauuacaagaccuacgaggagaaacuuaaugaugggugcgaauuucugacaagcacugagcagcccuuguccggaaugaucaacaacuauuacaccguggcacuccguaauaugaacgaaagauauggcuacaagacagaggaccuggccuucauacaagauaagagguuuaaauucgucaaggacgcuuaugguaaaaagaaaucucaggugaauaccggguuuuuccugucgcuccaggauuacaacggagacacucagaagaaauuacaccugucaggcguaggcaucgcacuuuugauuugucuguuucuagauaagcaauauaucaauauuuuccucagccggcugccuaucuucaguuccuacaacgcccagucugaagaacgcagaauaauuaucaggagcuuugggauuaauuccaucaaacuuccaaaagaccggauccauucagagaagaguaacaaaagcguugcuauggauaugcugaaugaagugaagcgcugccccgacgaguuguucacaacccucucugccgaaaaacagucccgauuuagaauuauaucagacgaucacaacgagguccugaugaagaggagcagugaccgguucgugccuuuacugcuccaauacaucgauuauggaaaacuuuuugaccacauucguuuccaugugaauauggguaaacugcgcuacuugcuaaaggcggauaaaacguguaucgacggccagacuagagucaggguuauagaacagccacugaacggguuuggacggcucgaggaggcagaaaccaugcgaaagcaggagaauggcacauucgguaacucugggauucgcaucagagauuuugaaaauaugaaaagggacgaugccaaccccgcuaacuauccuuacaucguggacacuuauacccacuacauucuggagaauaacaagguagaaauguucaucaaugauaaggaggacuccgccccacuucugccggugauugaggacgaucgguaugucgugaaaacaauacccagcugccgcaugucgaccuuggaaaucccugcaauggcuuuucauauguuccucuuuggaucuaagaaaacggagaagcugauuguugacgugcacaacagauacaaaagguuauuccaagccaugcagaaggaagaggucacugcggagaauaucgccuccuucggcaucgcagaaucagaucugccacagaagauucuagaccucauaaguggcaacgcucacgggaaagauguggacgccuuuauccgucugacaguagaugacaugcuuaccgauacugagcggcgaauuaagagauucaaagacgaucgcaagagcaucagguccgcugacaauaaaaugggaaagcgggguuuuaaacagauuucuacaggcaaguuggccgauuuccuggcaaaggacaucguucucuuucaacccagcgugaacgacggggaaaauaaaauaaccggacugaacuacagaaucaugcagucagccauugcugucuaugauaguggcgacgauuacgaggcgaagcagcaguucaaacuuauguuugaaaaggcaaggcugaucgguaaagggacgaccgagccucauccauucuuguauaagguguuugcccgcuccauucccgcuaaugccgucgaguucuacgaacgauaucucaucgagcggaaguuuuaccugacaggcuuaagcaacgaaauaaagaagggaaaucguguggacguuccguucauuagaagggaucaaaacaaauggaagacuccugcaaugaaaacccugggccgcaucuauucugaggaccuacccguggaacucccacggcagauguuugauaaugagauuaagucacaccugaagagucuuccucagauggaggggaucgacuucaacaacgccaauguaacauacuugauagcugaauacaugaaaagaguccuggaugacgauuuccagacuuuuuaucaauggaacaggaauuaccgauauauggacaugcucaagggagaguacgaucgcaaagguagccugcagcauuguuucaccuccguggaggagcgggaaggcuuauggaaggagagagccucuaggacagagcguuaucgcaaacaggcaucgaacaagauccggagcaauagacaaaugaggaacgcguccucagaagagauugaaaccauccuggacaagcgacuuaguaauucucggaacgaguaccagaaaagcgagaagguuauucgcagauauagggugcaggacgcuuugcucuuucugcuagccaaaaagacucugacggaacucgcagauuucgacggggagcgguuuaaacugaaggaaaucaugcccgaugccgagaaaggaauacuuuccgaaauuaugccaaugucauucacauuugagaagggcgguaagaaauacaccaucacuagcgaggggaugaaguugaaaaauuacggcgacuucuuuguccuggcuucugauaagcgaaucggaaacuuacucgaacuggugggcuccgacauuguaaguaaagaggauaucauggaagaguucaauaaguaugaccagugcagacccgaaauuagcucuauaguguuuaaccuugagaagugggccuucgauaccuacccugagcuguccgcacgcguugacagggaagagaaagucgauuucaagucaaucuugaaaauucuccugaauaacaagaauaucaacaaagaacaaagugacauucuacguaagauccggaacgcuuuugaccacaauaacuauccagauaagggggugguggagauaaaagcccugccggaaaucgcgaugagcauuaagaaagccuucggagaguacgcuaucaugaaggguucgcuccagcugcccccucuugagagauugacacugggcuccucuuauccauacgacguccccgauuaugcauacccuuacgacguuccagauuaugccuaccccuaugacgugccggauuacgcuuga

SEQ ID NO: 14359 - RNA, 2748 nt, Artificial Sequence
  Cas13d variant__Gut metagenome assembly P1E0-k21__P1E0Cas13d-HA
auggagagagaagugaagaaacccccuaagaaaagccuggccaaggcugcaggccucaaauccaccuucgucaucucuccacaggagaaggaacuugccaugacagcguuugggaggggaaacgacgcucuguugcaaaagcggauuguugauggugugguacgcgacguggccggcgagaaacagcaguuccagguccaacgacaggaugaaucacguuuuagauuacagaauaguaggcuggcagaccggacugugacggccgaugacccgcuacaccgcgcugagacccccagaaggcagccucucggggcaggaauggaucaacugcggcgcaaggccauacuugagcagaaauacuucggccgaacauuugacgauaacauccauauucagcugaucuauaauauuuuggacauccacaagaugcucgcuguuccagccaaccauauagugcacacucugaaucugcucgguggguacggagaaaccgauuucgucggcauguuacccgcgggccugccuuaugacaaacuuagagugguaaagaagaaaaacggggauacaguugacaucaaggcagacauugccgcuuacgccaaaaggccacaguuggcauaucugggagcugccuuuuacgaugugacccccgguaagagcaaacgggacgcggcccguggccgcgucaagagagagcaagauguguaugcaauccuaucccucaugucucugcuuaggcaguucugcgcucaugacucggugcggauuugggggcagaauacuacagccgcucuguaccacuugcaagcccucccucaggauaugaaagaccuguuagaugacggauggcgacgcgcacugggcggugucaacgaucacuuucucgacaccaauaagguuaaccuucugacguuguucgaauacuauggggccgagacuaagcaggcuagaguggcgcuaacccaggauuuuuacagguucguagugcugaaagagcaaaagaauaugggauuuucacuccggcgccugagagaggagcuucugaaauugccagacgcagccuaucucacaggccaggaauacgacagcgucaggcagaagcuguauauguuacuggauuuccuacucugucgucuguacgcucaggagcgggccgaccgaugcgaggaacuugugagugcauugagaugugcccuguccgaugaggaaaaagacacuguuuaucaagcugaggccgcagcgcucuggcaggcucugggcgauacccuuaggcgcaagcuguugccgcuccugaaggggaaaaaguuacaggacaaagauaagaaaaagucugacgaacugggacuaagccgggaugugcucgacgguguccuguucagacccgcccagcaaggcuccagggcaaacgccgauuacuuuugccgccuuaugcauuugucaacaugguucauggacgggaaggagaucaauacccugcucacgacucugauaaguaaauuagaaaacauugauagccugcgaucugugcuugaguccaugggauuggcuuacucauuuguaccugccuaugcaauguucgaccacagccgguacaucgcuggccagcuccguguugugaauaacauugccagaaugaggaagccagcgaucggugccaaacgcgagauguaucgggcugcagucgugcugcuaggggucgacagucccgaagccgcugccgcaaucacagaugaccugcuccagauugauccugagaccggcaaggugagaccaaggucugacuccgcgcgagauacuggacugcgcaacuuuauagccaauaacguuguggaaagccggagauucacauaccuuuugagguauaugacccccgagcaggcucguguacuggcccaaaaugaaaaauuaaucgcauuuguccucucgacggugccggacacccagcuggagcgcuacugucggacaugcggcagagaggauauuacugggaggccugcucagauccgauaucuuaccgcccaaauaaugggaguucgguacgaaucuuucacagacguggagcagcgcgguagaggcgauaaccccaagaaggaaagguacaaagcacugauuggguuguaucucacuguccuguaccuagccgugaagaauaugguaaacuguaaugcucgguaugugaucgcguuuuacugccgagacagagauaccgcccuguaucagaaagagguuuguugguacgaccucgaggaagauaagaaauccggaaagcagcgccaagucgaggacuauacagcacugaccagguacuucgugucacagggcuaccuuaaccgucaugcuugcgguuauuugcggaguaauaugaacgggaucagcaauucccuguuaacugccuacagaaacgccguggaccaccucaaugcuauuccaccucugggcucucuuuguagggauaucggacgcgucgacagcuauuuugcacuguaccacuaugccguucagcaguaccuaaacggccgauauuacagaaaaacgccccgggaacaagaacucuucgcggcuauggcccagcauaggacauggugcucagaucuggugaaggcauugaauaccccauuuggguacaaccuggcccgcuauaagaacuuaaguauugacggacucuucgaucgugaaggugaccacgugguaagagaggauggcgagaaacccgcugaauacccuuaugacgucccagauuacgcauga

SEQ ID NO: 14360 - RNA, 2748 nt, Artificial Sequence
  Cas13d variant__Gut metagenome assembly P1E0-k21__dP1E0Cas13d-HA
auggagagagaagugaagaaacccccuaagaaaagccuggccaaggcugcaggccucaaauccaccuucgucaucucuccacaggagaaggaacuugccaugacagcguuugggaggggaaacgacgcucuguugcaaaagcggauuguugauggugugguacgcgacguggccggcgagaaacagcaguuccagguccaacgacaggaugaaucacguuuuagauuacagaauaguaggcuggcagaccggacugugacggccgaugacccgcuacaccgcgcugagacccccagaaggcagccucucggggcaggaauggaucaacugcggcgcaaggccauacuugagcagaaauacuucggccgaacauuugacgauaacauccauauucagcugaucuauaauauuuuggacauccacaagaugcucgcuguuccagccaaccauauagugcacacucugaaucugcucgguggguacggagaaaccgauuucgucggcauguuacccgcgggccugccuuaugacaaacuuagagugguaaagaagaaaaacggggauacaguugacaucaaggcagacauugccgcuuacgccaaaaggccacaguuggcauaucugggagcugccuuuuacgaugugacccccgguaagagcaaacgggacgcggcccguggccgcgucaagagagagcaagauguguaugcaauccuaucccucaugucucugcuugcucaguucugcgccgcugacucggugaggauuugggggcagaauacuacagccgcacuguaccauuugcaagcccucccucaggauaugaaagaccuguuagaugacggauggcggcgagcucugggcggugucaacgaucacuuucucgacaccaauaagguuaaccuucugacguuguucgaauacuauggggcggagacuaagcaggcacgcguggcccuaacccaggauuuuuacagauucguagugcugaaagagcaaaagaauaugggauuuucacucaggcggcugcgcgaggagcuucugaaauugccagacgcugccuaucucacaggccaggaauacgacagcgucagacagaagcuguauauguuacuggauuuccuacucuguaggcuguacgcacaggagcgugccgaccggugcgaggaacuugugagugcuuugcgaugugcccuguccgaugaggaaaaagacacuguuuaucaagcagaggcggcugcccucuggcaggcacugggcgauacccuuagaaggaagcuguugccgcuccugaaggggaaaaaguuacaggacaaagauaagaaaaagucugacgaacugggacuaagccgcgaugugcucgacgguguccuguuccggcccgcccagcaaggcuccagagcuaacgccgauuacuuuugcaggcuuaugcacuugucaacaugguucauggacgggaaggagaucaauacccugcucacgacucugauaaguaaauuagaaaacauugauagccugcgcucugugcuugaguccaugggauuggcauacucauuuguaccugcuuaugccauguucgaccauagccgauacaucgcgggccagcuccggguugugaauaacauugcccguaugagaaagccagcuaucggugcaaaaagggagauguaucgcgccgcugucgugcugcuaggggucgacagucccgaagccgcagcggccaucacagaugaccugcuccagauugauccugagaccggcaaggugcggccaagaucugacuccgcuagggauacuggacugcgaaacuuuauagccaauaacguuguggaaagccgccgguucacauaccuuuugagauauaugacccccgagcaggcaaggguacuggcucaaaaugaaaaauuaaucgccuuuguccucucgacggugccggacacccagcuggagcguuacugucgcacaugcggccgggaggauauuacugggagaccugcacagaucagguaucuuaccgcccaaauaaugggaguucgauacgaaucuuucacagacguggagcagcggggucgcggcgauaaccccaagaaggaaagauacaaagcucugauuggguuguaucucacuguccuguaccuagcggugaagaauaugguaaacuguaaugccagguaugugaucgcauuuuacugccgggaccgagauaccgcucuguaucagaaagagguuuguugguacgaccucgaggaagauaagaaauccggaaagcagagacaagucgaggacuauacagcccugacccgcuacuucgugucacagggcuaccuuaacaggcacgccugcgguuauuugcguaguaauaugaacgggaucagcaauucccuguuaacugcuuacgcaaacgccguggacgcgcucaaugcuauuccaccucugggcucucuuugucgggauaucggaagagucgacagcuauuuugcccuguaccauuaugcaguucagcaguaccuaaacggcagguauuaccgcaaaacgccccgagaacaagaacucuucgccgcuauggcacagcacagaacauggugcucagaucuggugaaggccuugaauaccccauuuggguacaaccuggcgcgguauaagaacuuaaguauugacggacucuucgauagggaaggugaccacgugguacgcgaggauggcgagaaacccgcugaauacccuuaugacgucccagauuacgccuga

SEQ ID NO: 14361 - RNA, 2820 nt, Artificial Sequence
  Cas13d variant__Gut metagenome assembly P1E0-k21__NLS-P1E0Cas13d-NLS-HA
augagccccaagaaaaagagaaaaguggaggccuccgaaagggaggucaagaaaccuccaaagaagucucuggcuaaagcagccggccucaagucaaccuucguuaucaguccgcaggaaaaagagcuugcgaugacagcuuuugggcggggaaacgacgcccuguugcaaaagcgcauuguggaugguguagugcgagacgucgcaggcgaaaaacagcaguuccaggugcaacgucaggaugagagcagauuuagguuacaaaauucccggcuggccgaccgcacuguuacggcugaugacccccuacacagagcagagaccccuaggcggcagccacucggggccggaauggaucagcugcgccgaaaggcuauacuugaacagaaguacuucggcagaacauuugacgauaacauccauauucagcugaucuauaauauuuuggacauccacaaaaugcucgccgugcccgcgaaccauauaguccacacucugaaucugcucgguggguacggagagaccgauuucgugggcauguuaccugcaggccugccauaugacaaacuuaggguaguuaaaaagaaaaacggggauacaguggacaucaaggccgacauugcugccuacgcaaaacggccccaguuggcuuaucugggagccgcguuuuacgaugucaccccugguaagucuaagcgugacgccgcacgcggcagagugaaaagggaacaagauguguaugcuauccuaucgcucaugucacugcuucggcaguucugcgcccaugacagcguccgaauuugggggcagaauacuacagcugcccuguaccacuugcaagcacucccacaggauaugaaggaccuguuagaugacggauggcgcagagcccugggcgguguuaacgaucacuuucucgacaccaauaaagugaaccuucugacguuguucgaguacuauggggcugagacuaagcaggcgaggguagcacuaacccaggauuuuuaccgguucgugguccugaaagaacaaaagaauaugggauuuagucuccgcagacugagggaggaacuucugaaguugccggacgccgcuuaucucacaggccaggaguacgacuccgugcgucagaaacuguauauguuacuggauuuccuacucugucggcuguacgcccaggaacgagcagacagaugcgaggagcuuguuucugccuugaggugugcucugagcgaugaagagaaggacacuguguaucaagccgaagcagcggcucucuggcaggcccugggcgauacccuucgccggaaacuguugccccuccugaaggggaaaaaguuacaggacaaggauaaaaagaaauccgacgagcugggacuaucaagagauguccucgacggugugcuguucaggccugcacagcaaggcagucgcgccaacgcugauuacuuuugccgacuuaugcauuugagcacaugguucauggacgggaaggaaaucaauacccugcucacgacucugauaucuaaauuagagaacauugauucccugcggucaguacuugagagcaugggauuggccuacaguuuuguuccagcauaugcuauguucgaccacucucguuacaucgccggccagcucagaguggucaauaacauugcgaggaugcgcaagcccgccaucggugcuaagcgggaaauguauagagcagccgugguccugcuagggguggacuccccugaggcugccgcagcgaucacagaugaccugcuccagauugauccagaaaccggcaaaguuaggccccgaagcgacucggcccgcgauacuggacugcggaacuuuauagcuaauaacgugguagagucuagaagguucacauaccuuuugcguuauaugaccccggaacaggcccgcguccuggcacaaaaugagaaguuaaucgcuuuugugcucuccacgguuccugacacccagcuggagcgguacuguagaacaugcggcagggaagauauuacugggcgacccgcccagauccgguaucuuaccgcacaaauaaugggagugcgcuacgagucauucacagacgucgaacagagagguaggggcgauaacccaaagaaggagcgguacaaagcccugauuggguuguaucucacugugcuguaccuagcuguaaagaauauggugaacuguaaugcgcgauauguuaucgccuuuuacugcagagaccgcgauaccgcacuguaucagaaagaggucuguugguacgaccucgaagaggauaagaagaguggaaaacagaggcaaguggaagacuauacagcucugacccguuacuucgugagccagggcuaccuuaaccggcaugccugcgguuauuugagauccaauaugaacgggaucucuaauagccuguuaacugccuacaggaacgcugucgaccaccucaaugcaauuccuccccugggcucacuuugucgcgauaucggacgaguugacaguuauuuugcccuguaccacuaugcggugcagcaguaccuaaacggcagauauuaccggaagacgccaagggagcaagaacucuucgcugccauggcacagcaucgcacauggugcuccgaucuggugaaagccuugaauacccccuuuggguacaaccuggcucguuauaagaacuuaagcauugacggacucuucgauagagagggugaccacguaguccgggaggauggcgaaaaaccugcagaggggucuggaccaaagaagaaaaggaagguggccgcggcuuacccguaugacguucccgauuacgccuga

SEQ ID NO: 14362 - RNA, 2820 nt, Artificial Sequence
  Cas13d variant__Gut metagenome assembly P1E0-k21__NLS-dP1E0Cas13d-NLS-HA
augagccccaagaaaaagagaaaaguggaggccuccgaaagggaggucaagaaaccuccaaagaagucucuggcuaaagcagccggccucaagucaaccuucguuaucaguccgcaggaaaaagagcuugcgaugacagcuuuugggcggggaaacgacgcccuguugcaaaagcgcauuguggaugguguagugcgagacgucgcaggcgaaaaacagcaguuccaggugcaacgucaggaugagagcagauuuagguuacaaaauucccggcuggccgaccgcacuguuacggcugaugacccccuacacagagcagagaccccuaggcggcagccacucggggccggaauggaucagcugcgccgaaaggcuauacuugaacagaaguacuucggcagaacauuugacgauaacauccauauucagcugaucuauaauauuuuggacauccacaaaaugcucgccgugcccgcgaaccauauaguccacacucugaaucugcucgguggguacggagagaccgauuucgugggcauguuaccugcaggccugccauaugacaaacuuaggguaguuaaaaagaaaaacggggauacaguggacaucaaggccgacauugcugccuacgcaaaacggccccaguuggcuuaucugggagccgcguuuuacgaugucaccccugguaagucuaagcgugacgccgcacgcggcagagugaaaagggaacaagauguguaugcuauccuaucgcucaugucacugcuugcccaguucugcgcugccgacagcguccggauuugggggcagaauacuacagcagcccuguaccauuugcaagcucucccacaggauaugaaggaccuguuagaugacggauggcgacgcgcgcugggcgguguuaacgaucacuuucucgacaccaauaaagugaaccuucugacguuguucgaguacuauggggcagagacuaagcaggccagaguagcucuaacccaggauuuuuacagguucgugguccugaaagaacaaaagaauaugggauuuagucuccggcgccugagagaggaacuucugaaguugccggacgccgcauaucucacaggccaggaguacgacuccgugaggcagaaacuguauauguuacuggauuuccuacucugucgucuguacgcccaggaacgggcugaccgaugcgaggagcuuguuucugccuugagaugugcacugagcgaugaagagaaggacacuguguaucaagcggaagcugccgcacucuggcaggcccugggcgauacccuuaggcgcaaacuguugccccuccugaaggggaaaaaguuacaggacaaggauaaaaagaaauccgacgagcugggacuaucacgggauguccucgacggugugcuguucagaccugcucagcaaggcaguagggccaacgcagauuacuuuugccgccuuaugcacuugagcacaugguucauggacgggaaggaaaucaauacccugcucacgacucugauaucuaaauuagagaacauugauucccugcgaucaguacuugagagcaugggauuggcuuacaguuuuguuccagccuaugcgauguucgaccauucucgguacaucgccggccagcuccguguggucaauaacauugcuagaaugaggaagcccgcaaucggugccaagcgcgaaauguaucgggcugccgugguccugcuagggguggacuccccugaggcagcggccgcuaucacagaugaccugcuccagauugauccagaaaccggcaaaguuagacccaggagcgacucggcccgagauacuggacugcgcaacuuuauagcaaauaacgugguagagucucggagauucacauaccuuuugagguauaugaccccggaacaggcucguguccuggcccaaaaugagaaguuaaucgcauuugugcucuccacgguuccugacacccagcuggagcgcuacugucggacaugcggcagagaagauauuacugggaggcccgcccagauccgauaucuuaccgcucaaauaaugggagugcgguacgagucauucacagacgucgaacagcgcgguagaggcgauaacccaaagaaggagagguacaaagcgcugauuggguuguaucucacugugcuguaccuagccguaaagaauauggugaacuguaaugcacgguauguuaucgcuuuuuacugccgagacagagauaccgcccuguaucagaaagaggucuguugguacgaccucgaagaggauaagaagaguggaaaacagcgccaaguggaagacuauacagcccugaccagguacuucgugagccagggcuaccuuaaccgucacgcuugcgguuauuugcgguccaauaugaacgggaucucuaauagccuguuaacugcauacgccaacgcggucgacgcucucaaugccauuccuccccugggcucacuuuguagagauaucggaaggguugacaguuauuuugcacuguaccauuaugccgugcagcaguaccuaaacggccgcuauuaccgaaagacgccaagagagcaagaacucuucgcugcaauggcccagcaccggacauggugcuccgaucuggugaaagcguugaauacccccuuuggguacaaccuggcuagguauaagaacuuaagcauugacggacucuucgaucgcgagggugaccacguaguccgugaggauggcgaaaaaccugccgaggggucuggaccaaagaagaaaagaaagguggcagccgcuuacccguaugacguucccgauuacgccuga

SEQ ID NO: 14363 - RNA, 2862 nt, Artificial Sequence
  Cas13d variant__Ruminococcus albus __RaCas13d-HA
auggccaagaaaagcaagggcaugucccugagagagaaaagggaacucgagaagcagaaacggauccaaaaggcugcagugaacucugucaaugacacccccgaaaagacagaggaagccaacguugugucaguaaaugugcgcacgagugcggagaacaaacacagcaagaaauccgcugccaaggcacuugggcugaaaucuggauuggucauuggugaugaguuauaccugacuucguucggccgagggaaugaagccaagcuagagaagaaaauaucaggagacaccguggaaaagcucggcaucggugcuuuugagguugcagagcgugaugaaagcacacugacucuugagagugggagaauuaaagacaagaccgccaggccuaaagauccacggcauaucacaguggacacccagggaaaguucaaagaagauaugcugggcauucgcuccgucuuggagaagaagaucuuuggcaaaacuuucgacgauaacauacacgugcagcucgcuuauaauauccuggacguagaaaagauuauggcccaguacguuucugauaucguguauaugcugcauaacacagacaaaaccgagagaaaugauaaccucaugggguacaugagcauuaggaauacguauaagacuuuuugcgacaccuccaacuuaccggacgauacaaaacaaaaggucgagaaucagaagcgggaguucgacaaaaucauaaagucaggacgccuggguuacuuuggcgaagcguucauggugaacagugggaauagcacuaaacuucgacccgaaaaggagauuuaucacaucuuugcauugauggccucucugagacaguccuacuuccauggauacgugaaagauaccgacuaucagggcacaaccugggcuuacacgcuagaagauaagcucaaggguccuucacacgaguuuagggagacuauugacaaaaucuucgaugaaggguuuagcaagaucaguaaagacuucggaaagaugaacaaagucaaccugcaaauucuugagcagaugauaggcgaacuguauggcucuaucgagcggcagaauuugacaugugauuacuaugacuucauucagcucaagaagcacaaauaccugggguuuuccaucaagcguuuacgcgaaaccaugcuggagacuacaccagccgagugcuauaaagcagaauguuacaacagcgagagacaaaagcucuacaaacuuauagauuuccugauuuaugacuuguacuauaauaggaagcccgcucggaucgaagagaucguugacaaacuacgagagucggugaacgaugaagagaaggaaucuauuuacuccguagaggccaaguauguguacgaaucacugaguaaaguccucgacaagagccugaaaaauuccgugucuggagagaccaucaaggaucuucagaaacgcuaugacgaugagacggcgaacagaauuugggacauaagccagcauucaaucagugguaauguuaacugcuuuuguaagcugauuuacaucaugaccuugaugcucgauggcaaggaaaucaaugaccuguuaacaacucuggugaacaaauucgauaauauugccuccuuuauagacgucauggaugagcuagggcucgaacacagcuucaccgacaacuacaagauguuugcagauucuaaagcuaucugccuggaccuucaauucauuaauucauuugccaggaugaguaagaucgacgaugagaaaagcaagcggcaguuguuccgcgacgcucuggugauucucgauaucggaaacaaggacgaaacauggauaaauaacuaucuggauuccgacaucuuuaaacuugauaaggagggcaacaaacugaagggugccagacaugacuucaggaauuuuauugcaaacaauguaaucaaaucuucgcguuucaaguacuugguuaaguauagcuccgccgaugggaugauuaaacucaagacuaacgagaaacugaucggcuucguguuagacaagcugccugaaacccagauagaucgguacuaugagucauguggacuagacaaugcugucguggauaaaaagguccgaauugaaaaacucaguggccugaucagagacaugaaguuugacgauuucucuggggugaagacaagcaacaaagcgggagacaaugauaagcaggacaaagcaaaguaccaagccauuaucucccuuuauuugaugguucuguaccagauagugaaaaacaugaucuacguaaauucaagguaugucauugcuuuucacugccucgagcgcgauuucgguauguacggcaaggacuuugggaaguauuaccagggaugucggaaacugaccgaucacuucaucgaagagaaguauaugaaagagggcaaguuagguugcaacaaaaagguggggagauaccugaagaauaacauuagcuguugcacugacggccuuaucaauacguauaggaaccagguugaucauuuugccgugguccgcaaaauaggaaauuacgcagccuacauuaagucuaucggcuccugguucgaauuguaucacuacgugauccaacgaauuguauuugacgaguaucgguucgcucucaacaacacagaaaguaauuacaaaaacagcaucauuaagcaucacaccuauugcaaagauauggugaaggcccugaauacuccauuuggguacgaccuaccccguuauaagaaccugucuauaggagaccucuucgauagaaauaacuaccugaauaaaaccaaggaguccaucgacgcaaacucaaguauugauagccaguacccuuaugacguuccagauuacgcguga

SEQ ID NO: 14364 - RNA, 2934 nt, Artificial Sequence
  Cas13d variant__Ruminococcus albus __NLS-RaCas13d-NLS-HA
augagccccaagaaaaagagaaaaguggaggccuccgcuaagaaaucuaagggcaugucacugagggaaaagcgggagcucgaaaaacagaagcgcauccaaaaagcagccgucaacaguguuaaugacaccccugagaagacagaagaggcgaacgugguaagcgugaauguccgaacuuccgcugagaacaaacacucuaagaagucggccgcaaaagcccuugggcugaagucaggauuggugauuggugaugaauuauaccugacgagcuucggccgugggaaugaggcuaaacuagaaaagaaaauaaguggagacaccguugagaagcucggcaucggugcauuugagguggccgaaagagaugaguccacacugacucuugaaucugggaggauuaaagacaagaccgcucggccaaaggauccgcgccauaucacagucgacacccagggaaaauucaaggaggauaugcugggcauuagaagcguguuggaaaagaagaucuuuggcaaaacuuucgacgauaacauacacguacagcucgccuauaauauccuggacguugagaagauuauggcgcaguacguguccgauaucgucuauaugcugcauaacacagacaagaccgagaggaaugauaaccucaugggguacaugucaauucggaauacguauaaaacuuuuugcgacaccaguaacuuacccgacgauacaaagcaaaaaguggaaaaucagaagcgcgaguucgacaaaaucauaaagagcggacgacuggguuacuuuggcgaagcauucauggugaacucuggaaauuccacuaaacuuagaccugagaaagaaauuuaucacaucuuugccuugauggcuucacugaggcagagcuacuuccauggguacgucaaggauaccgacuaucagggcacaaccugggccuacacgcuagaggauaaacucaaggguccaagucacgaguuucgggaaacuauugacaaaaucuucgaugagggguuuucuaagaucuccaaggacuucggaaaaaugaacaagguuaaccugcaaauucuugaacagaugauaggcgagcuguauggcagcaucgaacgucagaauuugacaugugauuacuaugacuucauucagcucaaaaagcacaaauaccugggguuuucgaucaagcgcuuaagagagaccaugcuggagacuacacccgcagaaugcuauaaagcugaguguuacaacucugaaaggcaaaagcucuacaaacuuauagauuuccugauuuaugacuuguacuauaaucggaagccugcccgaaucgaggagaucguggacaagcuacgcgaauccguaaacgaugaggaaaaagagucaauuuacaguguggaagcgaaguaugucuacgagagccuguccaaagugcucgacaagucucugaagaauagcguuucaggagagaccaucaaagaucuucagaagagauaugacgaugaaacggccaacaggauuugggacauaagucagcauuccaucagcgguaaugugaacugcuuuuguaaacugauuuacaucaugaccuugaugcucgauggcaaggagaucaaugaccuguuaacaacucuggucaacaaauucgauaauauugcaucuuuuauagacgugauggaugaacuagggcucgagcacucauucaccgacaacuacaagauguuugcugauaguaaggccaucugccuggaccuucaauucauuaauagcuuugcucggauguccaaaaucgacgaugaaaagucuaaacgccaguuguucagagacgcccugguaauucucgauaucggaaacaaggacgagacauggauaaauaacuaucuggauucggacaucuuuaaacuugauaaggagggcaacaagcugaaaggugcaaggcaugacuuccguaauuuuauugccaacaauguuaucaagagcucccgguucaaauacuuggugaaguauucaagugcugaugggaugauuaaacucaagacuaacgaaaaacugaucggcuucgucuuagacaagcugccagagacccagauagaucgauacuaugaaucuuguggacuagacaaugcgguggucgauaagaaagugagaauugagaagcucagcggccugaucagggacaugaaauuugacgauuucuccgggguuaagacaucaaacaaagcaggagacaaugauaagcaggacaaggccaaauaccaagcuauuaucagccuuuauuugauggugcuguaccagauaguaaagaacaugaucuacgucaauucucgcuaugugauugccuuucacugccucgaacgggauuucgguauguacggcaaagacuuugggaaguauuaccagggauguagaaaacugaccgaucacuucaucgaggagaaguauaugaaggaaggcaaauuagguugcaacaagaaaguugggagguaccugaagaauaacauuuccuguugcacugacggccuuaucaauacguaucgcaaccagguggaucauuuugcagucgugcgaaaaauaggaaauuacgccgcuuacauuaagaguaucggcagcugguucgaguuguaucacuacguaauccaacggauuguguuugacgaauaucguuucgcccucaacaacacagagucuaauuacaagaacuccaucauuaaacaucacaccuauugcaaggauaugguuaaagcacugaauacucccuuuggguacgaccuaccuagauauaagaaccugucaauaggagaccucuucgauaggaauaacuaccugaauaaaaccaaggagaguaucgacgcgaacagcucgauugauucccaggguucuggcccaaagaaaaagcgcaaagucgcugccgcauacccguaugacgugcccgauuacgccuga

SEQ ID NO: 14365 - RNA, 2829 nt, Artificial Sequence
  Cas13d variant__Ruminococcus flavefaciens FD1__RffCas13d-HA
augaagaaaaagaugagccugagagagaaaagggaagccgagaagcaggcuaaaaaggcagccuacuccgcggcuucuaagaacaccgacucaaaacccgccgaaaagaaagcagagacaccuaagccagccgaaaucauuagugauaauagccggaacaaaacugcugugaaggcagccggccucaaguccacgauaaucucuggggacaaacuuuauaugaccucguucggaaaggguaaugcugccgucauugagcaaaagaucgauauuaacgacuacucauuuagcgcgaugaaggauacaccgagucuggagguugacaaagcagaauccaaggagaucucuuucagcucccaccaucccuuugugaaaaaugauaaguugacuaccuauaacccuuuauacggcgggaaggacaauccagaaaaacccguaggacgcgauaugcugggccuaaaggacaaacucgaggagcgauauuucgguugcacauuuaacgauaaucugcacauacagaucauuuacaacauccuugacauugaaaagauccuggccgugcauucagcuaauauaaccacugccuuggaucacauggucgacgaggacgaugaaaaauaucucaacagugacuacauuggguacaugaauacaaucaacaccuaugauguguucauggacccuagcaaaaauucuucccugucaccaaaggaucguaaaaacauugacaacagcagagcaaaguuugagaaacugcucaguacgaagagguuaggauacuucggcuuugauuaugacgcuaauggcaaagauaagaagaaaaacgaagagaucaagaaacggcuguaccaucuuacugccuucgcggggcaguugcgccaguggucuuuucacuccgccggaaauuaucccagaaccuggcuguacaagcuagacagccucgauaaagaguaucuggacacacuugaccacuacuucgauaagagguuuaacgacaucaaugaugacuucguuacuaagaacgcaaccaaucuguacauuuugaaagaaguguucccugaggcuaacuuuaaggauauagccgaccucuauuacgauuucaucgucauuaaaucgcauaagaauauggguuuuucuaucaaaaagcugcgggagaaaauguuagaaugugacggcgcugaucgcauaaaggaacaagacauggauuccgugcgaucaaagcuguauaaacucauugacuucugcaucuuuaaguacuaucacgaguucccagagcuuagugagaaaaacguagauauccugagagccgcaguuagcgacacaaagaaagacaauuuguacuccgaugaagccgcuaggcuauggucuauuuuuaaggaaaaguuccugggguuuugugacaaaaucguggucugggugaccggagagcaugaaaaggauauuacgagcgugauagacaaagaugcguaucggaaccguucaaaugucaguuacuucuccaagcucauguacgcaaugugcuuuuuccuggacggcaaagagaucaacgaucuucugacuacauugauuaauaaguuugacaacaucgccaaccagaucaagaccgcuaaagagcucgguauuaauacugccuucguuaagaacuaugauuucuuuaaucacagcgaaaaauacguggacgagcugaacauaguaaagaauaucgcacgcaugaaaaagccgucuucaaacgccaagaaagcuauguaucacgaugccuuaacaauucuggggauccccgaagacauggaugagaaggcacuagacgaggaacucgaccugauucuugagaaaaagaccgauccugugacgggaaaaccauugaagggcaaaaauccccugagaaacuucaucgcgaauaacgucauagaaaauaguagguuuaucuaccucauuaaguucuguaacccugagaaugugcggaagaucguuaacaauaccaaagugacagaauuuguccugaagcgcauuccagacgcucagaucgagcgauauuacaaaagcugcacugauuccgagaugaaucccccgaccgaaaagaaaauaacagagcuugccggcaagcugaaggacaugaacuucgggaacuuuagaaacgugaggcagucugcaaaagaaaauauggagaaggaacgguucaaagccguaauuggauuguaucucacuguuguguaccgcgucgugaagaaccuggucgauguuaauucgagauacaucauggcuuuucauagcuuagagagggacucccaacuguauaacgugucaguggauaaugacuaccuagcccucaccgauacacugguaaaagagggugacaacagucguucucgguaucuugcaggcaauaagcgauugagagauugugucaagcaggacauugacaacgcuaaaaagugguucgugagcgauaaauacaauuccaucaccaaguauaggaacaauguugcccaccugacugcggugcgcaacugcgccgaauuuauaggggacaucacgaaaauugauucauacuucgcucucuaucauuaccugauccagcggcaguuagcaaagggacuggaccacgagagaagcggcuuugauaggaauuacccucaauaugcuccccuuuucaaguggcauacauacgucaaagacgugguaaaggccuugaacgccccauucgguuauaacauuccucgcuuuaaaaaucucucuaucgaugcacuguucgaccgaaacgaaauaaagaaaaaugauggggagaagaaguccgacgauuaccccuaugacgugccagauuacgcguga

SEQ ID NO: 14366 - RNA, 2901 nt, Artificial Sequence
  Cas13d variant__Ruminococcus flavefaciens FD1__NLS-RffCas13d-NLS-HA
augagccccaagaaaaagagaaaaguggaagccuccaagaaaaagaugucucugagggaaaagcgggaggcugaaaaacaggcaaagaaagccgcguacucagcugccaguaagaacaccgacagcaaaccugcagagaagaaggccgaaacaccaaaaccggcugagauaauuuccgauaauucucgcaacaagacugcagucaaagccgcuggccucaagucgacgauaaucucaggggacaaacuuuauaugaccagcuucggaaaggguaaugccgcgguuauugagcagaaaaucgauauuaacgacuacaguuuuuccgcaaugaaggauacacccucucuggaaguggacaaggccgagagcaaagaaaucuccuucucaagucaccauccuuuuguaaagaaugauaaauugacuaccuauaacccauuauacggcgggaaggacaaucccgagaaaccugugggacgagauaugcugggccuaaaggacaagcucgaggaacguuauuucgguugcacauuuaacgauaaucugcacauacaaaucauuuacaacauccuugacauugagaaaauccuggcuguccauagcgccaauauaaccacugcauuggaucacaugguggacgaagacgaugagaaguaucucaacucugacuacauuggguacaugaauacaaucaacaccuaugauguuuucauggacccauccaaaaauucaagccugagucccaaggauaggaaaaacauugacaacucuagagcuaaguuugaaaagcugcucuccacgaaacgguuaggauacuucggcuuugauuaugacgccaauggcaaggauaaaaagaaaaacgaggagaucaagaagcgccuguaccaucuuacugcguucgccgggcaguugagacaguggagcuuucacucggcaggaaauuauccuaggaccuggcuguacaaacuagacucucucgauaaggaauaucuggacacacuugaccacuacuucgauaaacgguuuaacgacaucaaugaugacuucgugacuaagaacgcuaccaaucuguacauuuugaaagaggucuucccagaagccaacuuuaaggauauagcugaccucuauuacgauuucaucgugauuaaaucccauaagaauauggguuuuucaaucaagaaacugcgcgagaagauguuagaaugugacggcgccgaucgaauaaaagagcaagacauggauaguguaagaagcaagcuguauaaacucauugacuucugcaucuuuaaguacuaucacgaguucccggaacuuuccgagaagaacguugauauccugagggcagccgugucugacaccaaaaaggacaauuuguacagcgaugaagcugcgcggcuauggucaauuuuuaaagagaaguuccugggguuuugugacaaaaucgucgugugggugacaggagaacaugagaaggauauuacgagugucauagacaaggaugcauaucguaaccgcuccaauguuagcuacuucucuaaacucauguacgccaugugcuuuuuccuggacggcaaggagaucaacgaucuucugacuacauugauuaauaaauuugacaacaucgcuaaccagaucaagaccgccaaagaacucgguauuaauacugcauucgugaagaacuaugauuucuuuaaucacucagagaaguacguagacgaacugaacauagugaaaaauaucgccagaaugaagaaacccaguagcaacgcuaagaaagccauguaucacgaugcauuaacaauucuggggaucccugaggacauggaugagaaggcgcuagacgaggagcucgaccugauucuugagaaaaagaccgauccagucacgggaaagcccuugaaaggcaagaauccucugaggaacuucaucgcuaauaacgugauagaaaauucccgguuuaucuaccucauuaaauucuguaacccagaaaauguucgaaagaucgugaacaauaccaaagucacagaauuugugcugaagcgcauucccgacgcccagaucgagagauauuacaagucuugcacugauucggaaaugaacccgccuaccgagaaaaagauaacagaacuugcaggcaaacugaaggacaugaacuucgggaauuuuaggaacguacggcagagcgccaaagagaauauggaaaaggagcgcuucaaggcuguuauuggauuguaucucacuguggucuacagaguggucaaaaaccugguggauguuaauuccagguacaucauggccuuucauucauuagagcgugacagucaacuguauaacgugucuguagauaaugacuaccuagcacucaccgauacacuggucaaggaaggugacaacagccggucccgauaucuugcuggcaauaaaagauugagggauugugugaagcaggacauugacaacgccaaaaagugguucguuucagauaaguacaauagcaucaccaaauaucgcaacaauguggcgcaccugacugccguccggaacugcgcugaguuuauaggggacaucacgaagauugauucuuacuucgcacucuaucauuaccugauccagagacaguuagccaaaggacuggaccacgaaagguccggcuuugaucgcaauuacccccaauaugcuccacuuuucaaguggcauacauacgugaaagacguagugaaggccuugaacgcaccuuucgguuauaacauuccccgauuuaagaaucucaguaucgaugcgcuguucgaccggaacgagaucaaaaagaaugauggggagaaaaagagcgacgauggcucuggacccaaaaagaaacguaagguugccgcugccuacccauaugacgucccugauuacgcauga

SEQ ID NO: 14367 - RNA, 2931 nt, Artificial Sequence
  Cas13d variant__Ruminococcus flavefaciens XPD3002__RfxCas13d-HA
augaucgagaagaaaaagagcuucgccaaaggcaugggggugaaguccacccuggucucuggaucaaaaguuuacaugacaacuuuugcugaagguagugacgcaagacucgagaagauuguggaaggcgauagcauaagguccguaaacgagggggaagccuucucugcggagauggcugacaagaaugccggauauaaaaucggcaacgcaaaguuuucgcaccccaaagguuacgccguggucgcuaauaacccucuuuauacggggccagugcagcaagauaugcugggauugaaggagaccuuagaaaaacgguacuucggcgagucagcagacggcaaugauaacauuugcauccagguuauucauaauauccuggacauagaaaagauccuagccgaguauauuacaaacgcugccuacgcggugaauaacaucagcgggcucgauaaggacauuaucggauuugguaaauucaguacugucuauaccuacgaugaguuuaaggacccggaacaccaucgcgcagccuucaauaacaaugauaaacugauaaacgcuauuaaggcccaguacgacgaguuugauaauuuccuugacaacccccgacugggcuauuuugggcaggcauucuuuuccaaagaaggacguaacuacaucauuaauuauggcaacgaguguuacgacaucuuggcucuccugucuggucugagacacugggugguacauaauaacgaagaggagagcaggaucucccggacauggcucuauaauuuagauaagaaccuggacaaugaauacauuucaacccuuaacuauuuguacgaucgcauaacuaaugagcugacaaacaguuucagcaaaaauucugccgcgaacguuaauuacaucgccgaaacccuagggauuaacccugcagaguucgcugaacaauauuuuagauucuccaucaugaaggagcagaagaaucucggauuuaacauaacgaaacugagggaggugaugcuugaccggaaggauaugucagaaauucgcaaaaaccacaaggucuucgacagcauccgaacuaaaguguacaccaugauggauuuugugaucuauagauacuauauugaggaagacgccaaggucgcugccgcaaauaagagucugccagauaacgagaaaucuuuguccgaaaaggacaucuucguuauuaaucucaggggcagcuuuaacgaugaccagaaagacgcccuguacuaugaugaggcuaaucggauauggcguaaguuagagaacaucaugcacaauauuaaagaguuccgcggcaacaagacaagagaauacaagaaaaaggacgcgcccaggcugccucggauccucccagcagggcgagaugugucggccuuuucuaaacuuauguacgcucugacuauguucuuggacggaaaggaaaucaaugaucuacugaccacacucauuaacaaauuugacaauauacaguccuuccugaagguaaugccccuuaucggugugaacgccaaguuugucgaggaguaugcauucuucaaagauucagccaagauugcugacgaacugcgcuugaucaaaaguuuugccagaaugggcgagccuauugcagaugcgaggcgggcuauguacaucgacgccauacgcauccucgggaccaaucugagcuaugaugaauuaaaggcacuggccgacacguucucccuagaugagaacggaaauaaacucaagaaaggcaagcaugguaugagaaacuuuauuaucaacaaugugauuucuaacaagagguuccacuaccugauccguuauggggacccagcucaucuucacgaaauagccaaaaaugaggcaguugugaaguuugucuugggccggauugcugacauccagaaaaagcaaggacagaacggcaaaaaucagauugaucgauacuaugagacuugcaucgggaaggacaagggaaaaagcgugucagaaaagguagaugcccugacaaaaauaaucaccgguaugaacuacgaccaauucgauaagaaaagaaguguuauugaggacacuggcagggaaaaugcggagcgcgaaaaguuuaagaaaaucauuucccucuaccugacagugaucuaucacauacuuaagaacauugucaauaucaacgcccgguacgugaucggguuccauugugucgagagagaugcucagcuguauaaagagaagggauacgacauuaauuugaaaaagcucgaagagaagggcuuuagcucugugaccaaacugugcgcagguaucgaugaaacggccccggacaagaggaaagauguugagaaggaaauggcugagcgcgccaaagagucaauugacaguuuagaaagcgcaaaccccaagcuguaugcgaauuacauaaaauauuccgaugagaagaaggccgaagaguucacccgacagaucaaccgggagaaagcuaagacagcccuaaaugcauaccuccguaacacuaaauggaacgugauuaucagagaagaccugcuuaggauugacaauaagaccuguacauuguuucgcaacaaagcuguacaccuggaggucgcccgguacgugcaugcauauaucaaugauauagccgaaguuaacucuuacuuccaacucuaucacuacaucaugcagagaauuaucaugaaugagagguaugaaaagucgagcgggaagguguccgaguacuuugacgcugucaacgaugagaaaaaguauaaugaccgacuguuaaaacugcuuugcgugccuuucggcuacuguauuccacgcuucaagaacuugucaaucgaagcgcucuuugaucggaaugaggccgcaaaauucgacaaggaaaagaaaaagguaaguggaaacucuuaccccuaugaugugccugacuacgcuuga

SEQ ID NO: 14368 - RNA, 2931 nt, Artificial Sequence
  Cas13d variant__Ruminococcus flavefaciens XPD3002__dRfxCas13d-HA
augaucgagaagaaaaagagcuucgccaaaggcaugggggugaaguccacccuggucucuggaucaaaaguuuacaugacaacuuuugcugaagguagugacgcaagacucgagaagauuguggaaggcgauagcauaagguccguaaacgagggggaagccuucucugcggagauggcugacaagaaugccggauauaaaaucggcaacgcaaaguuuucgcaccccaaagguuacgccguggucgcuaauaacccucuuuauacggggccagugcagcaagauaugcugggauugaaggagaccuuagaaaaacgguacuucggcgagucagcagacggcaaugauaacauuugcauccagguuauucauaauauccuggacauagaaaagauccuagccgaguauauuacaaacgcugccuacgcggugaauaacaucagcgggcucgauaaggacauuaucggauuugguaaauucaguacugucuauaccuacgaugaguuuaaggacccggaacaccaucgcgcagccuucaauaacaaugauaaacugauaaacgcuauuaaggcccaguacgacgaguuugauaauuuccuugacaacccccgacugggcuauuuugggcaggcauucuuuuccaaagaaggacguaacuacaucauuaauuauggcaacgaguguuacgacaucuuggcucuccugucuggucuggcccacugggugguagcgaauaacgaagaggagagcagaaucuccaggacauggcucuauaauuuagauaagaaccuggacaaugaauacauuucaacccuuaacuauuuguacgaucggauaacuaaugagcugacaaacaguuucagcaaaaauucugccgcaaacguuaauuacaucgcugaaacccuagggauuaacccugccgaguucgcugaacaauauuuucgcuucuccaucaugaaggagcagaagaaucucggauuuaacauaacgaaacugagagaggugaugcuugacaggaaggauaugucagaaauucggaaaaaccauaaggucuucgacagcauccgcacuaaaguguacaccaugauggauuuugugaucuaucgauacuauauugaggaagacgccaaggucgcagccgcuaauaagagucugccagauaacgagaaaucuuuguccgaaaaggacaucuucguuauuaaucucagaggcagcuuuaacgaugaccagaaagacgcgcuguacuaugaugaggcaaauaggauauggcggaaguuagagaacaucaugcacaauauuaaagaguuccguggcaacaagacacgcgaauacaagaaaaaggacgcccccagacugccuaggauccucccagcugggcgggaugugucggccuuuucuaaacuuauguacgcacugacuauguucuuggacggaaaggaaaucaaugaucuacugaccacacucauuaacaaauuugacaauauacaguccuuccugaagguaaugccccuuaucggugugaacgccaaguuugucgaggaguaugcuuucuucaaagauucagccaagauugcagacgaacugcgauugaucaaaaguuuugcgcgcaugggcgagccuauugcugaugccagaagggcaauguacaucgacgccauacggauccucgggaccaaucugagcuaugaugaauuaaaggcucuggccgacacguucucccuagaugagaacggaaauaaacucaagaaaggcaagcacgguaugcgcaacuuuauuaucaacaaugugauuucuaacaagagauuccauuaccugaucagguauggggacccagcacaccuucaugaaauagcuaaaaaugaggccguugugaaguuugucuugggccguauugcggacauccagaaaaagcaaggacagaacggcaaaaaucagauugaucgguacuaugagacuugcaucgggaaggacaagggaaaaagcgugucagaaaagguagaugcccugacaaaaauaaucaccgguaugaacuacgaccaauucgauaagaaacgaaguguuauugaggacacuggcagagaaaaugcugagagggaaaaguuuaagaaaaucauuucccucuaccugacagugaucuaucacauacuuaagaacauugucaauaucaacgcacgcuacgugaucggguuccacugugucgagcgggaugcccagcuguauaaagagaagggauacgacauuaauuugaaaaagcucgaagagaagggcuuuagcucugugaccaaacugugcgcugguaucgaugaaacggccccggacaagagaaaagauguugagaaggaaauggcagagagggcgaaagagucaauugacaguuuagaaagcgccaaccccaagcuguaugcuaauuacauaaaauauuccgaugagaagaaggccgaagaguucacccgccagaucaaccgagagaaagcaaagacagcucuaaaugccuaccuccggaacacuaaauggaacgugauuauccgugaagaccugcuuagaauugacaauaagaccuguacauuguuugcaaacaaagccguagcucuggaggucgcgagguacgugcaugccuauaucaaugauauagcagaaguuaacucuuacuuccaacucuaucacuacaucaugcagcgcauuaucaugaaugagcgguaugaaaagucgagcgggaagguguccgaguacuuugacgcugucaacgaugagaaaaaguauaaugacagacuguuaaaacugcuuugcgugccuuucggcuacuguauuccaagguucaagaacuugucaaucgaagcccucuuugaucgaaaugaggccgcuaaauucgacaaggaaaagaaaaagguaaguggaaacucuuaccccuaugaugugccugacuacgcauga

SEQ ID NO: 14369 - RNA, 3003 nt, Artificial Sequence
  Cas13d variant__Ruminococcus flavefaciens XPD3002__NLS-RfxCas13d-NLS-HA (CasRx)
augagccccaagaaaaagagaaaaguggaggccuccaucgaaaagaaaaagucuuucgcuaagggcaugggggucaaaucaacccugguuaguggaagcaagguguacaugacaacuuuugcagaggguuccgacgccaggcucgaaaagauuguagagggcgauucuauacggucggugaacgaaggggaggcguucucagcugagauggccgacaagaaugcaggauauaaaaucggcaacgccaaguuuagccacccuaaggguuacgcugucguggcaaauaacccacuuuauacggggccgguucagcaagauaugcugggauugaaagaaaccuuagagaagcgcuacuucggcgaaagugccgacggcaaugauaacauuugcauccaggugauucauaauauccuggacauagagaaaauccuagcugaguauauuacaaacgccgcguacgcagucaauaacaucuccgggcucgauaaggacauuaucggauuugguaaauucucuacuguguauaccuacgaugaauuuaaggaccccgagcaccaucgagccgcuuucaauaacaaugauaaacugauaaacgccauuaaggcacaguacgacgaauuugauaauuuccuugacaacccucgucugggcuauuuugggcaggcuuucuuuagcaaggagggaagaaacuacaucauuaauuauggcaacgaauguuacgacaucuuggcccuccuguccggucugaggcacuggguaguucauaauaacgaggaggaaucacggaucagucgcacauggcucuauaauuuagauaaaaaccuggacaaugaguacauuagcacccuuaacuauuuguacgauagaauaacuaaugaacugacaaacucuuucuccaaaaauucagcggccaacgugaauuacaucgcagagacccuagggauuaacccagcugaguucgccgaacaauauuuuagguucagcaucaugaaagagcagaagaaucucggauuuaacauaacgaaacugcgggaagucaugcuugaccgcaaggauaugagugagauucgaaagaaccacaaaguguucgacucuaucagaacuaagguguacaccaugauggauuuugucaucuauagguacuauauugaagaggacgcuaaaguugccgcagccaauaagucccugcccgauaacgaaaagagcuugucggagaaggacaucuucgugauuaaucuccggggcucuuuuaacgaugaccagaaggacgcucuguacuaugaugaggcgaaucguauauggcgcaaauuagaaaacaucaugcacaauauuaaggaguucagaggcaacaaaacaagggaauacaagaaaaaggacgcaccucggcugccacgaauccuccccgccgggcgcgauguauccgcuuuuucaaaacuuauguacgcccugacuauguucuuggacggaaaagagaucaaugaucuacugaccacacucauuaacaaguuugacaauauacagaguuuccugaaagugaugccucuuaucggugucaacgcaaaguuuguggaggaauaugccuucuucaaagauagcgcuaagauugccgacgagcugagauugaucaaauccuuugcaaggaugggcgaaccaauugcggaugcucggcgcgccauguacaucgacgcaauaagaauccucgggaccaaucugucuuaugaugaguuaaaggcccuggcugacacguucagccuagaugaaaacggaaauaagcucaaaaagggcaaacaugguaugaggaacuuuauuaucaacaauguuauuucaaacaagcguuuccacuaccugauccgguauggggacccggcccaucuucacgagauagcuaaaaaugaggcaguggucaaguuuguguugggccgaauugccgacauccaaaagaaacagggacagaacggcaagaaucagauugauagauacuaugaaacuugcaucgggaaagacaagggaaaaaguguauccgagaagguugaugcgcugacaaagauaaucaccgguaugaacuacgaccaauucgauaaaaagaggagcgugauugaagacacuggccgcgagaaugccgaacgggagaaauuuaagaaaaucauuucucucuaccugacagucaucuaucacauacuuaagaacauugugaauaucaacgcuagauacgucaucggguuccauuguguggagagggaugcacagcuguauaaggaaaaaggauacgacauuaauuugaagaaacucgaggaaaagggcuuuucaaguguuaccaaacugugcgccgguaucgaugagacggcucccgacaagcgcaaagauguggaaaaggagauggccgagcgagcaaaggaaagcauugacuccuuagagucugcgaacccuaaacuguaugccaauuacauaaaguauucggaugagaaaaaggcugaagaguucacccggcagaucaaccgugaaaaagccaagacagcacuaaaugcuuaccucagaaacacuaaguggaacguaauuaucagggaggaccugcuucgcauugacaauaaaaccuguacauuguuucggaacaaggccguccaccuggaaguggcaagauacguucaugccuauaucaaugauauagcugaggugaacagcuacuuccaacucuaucacuacaucaugcagaggauuaucaugaaugaacgauaugagaaauccucagggaaggucagugaguacuuugacgcggugaacgaugagaaaaaguauaaugaccgccuguuaaagcugcuuugcguaccauucggcuacuguauuccccgguucaaaaacuugucuaucgaagcccucuuugauagaaaugaagcagcuaaguucgacaaagagaagaaaaaggugagcggaaacuccggcucagggccuaagaaaaagaggaaaguugccgccgcuuacccauaugauguccccgacuacgcauga

SEQ ID NO: 14370 - RNA, 3003 nt, Artificial Sequence
  Cas13d variant__Ruminococcus flavefaciens XPD3002__NLS-dRfxCas13d-NLS-HA (dCasRx)
augagccccaagaaaaagagaaaaguggaggccuccaucgaaaagaaaaagucuuucgcuaagggcaugggggucaaaucaacccugguuaguggaagcaagguguacaugacaacuuuugcagaggguuccgacgccaggcucgaaaagauuguagagggcgauucuauacggucggugaacgaaggggaggcguucucagcugagauggccgacaagaaugcaggauauaaaaucggcaacgccaaguuuagccacccuaaggguuacgcugucguggcaaauaacccacuuuauacggggccgguucagcaagauaugcugggauugaaagaaaccuuagagaagcgcuacuucggcgaaagugccgacggcaaugauaacauuugcauccaggugauucauaauauccuggacauagagaaaauccuagcugaguauauuacaaacgccgcguacgcagucaauaacaucuccgggcucgauaaggacauuaucggauuugguaaauucucuacuguguauaccuacgaugaauuuaaggaccccgagcaccaucgagccgcuuucaauaacaaugauaaacugauaaacgccauuaaggcacaguacgacgaauuugauaauuuccuugacaacccucgucugggcuauuuugggcaggcuuucuuuagcaaggagggaagaaacuacaucauuaauuauggcaacgaauguuacgacaucuuggcccuccuguccggucuggcgcacuggguaguugccaauaacgaggaggaaucaaggaucagucggacauggcucuauaauuuagauaaaaaccuggacaaugaguacauuagcacccuuaacuauuuguacgaucgcauaacuaaugaacugacaaacucuuucuccaaaaauucagcagcuaacgugaauuacaucgccgagacccuagggauuaacccagcugaguucgccgaacaauauuuuagauucagcaucaugaaagagcagaagaaucucggauuuaacauaacgaaacugagggaagucaugcuugaccggaaggauaugagugagauucgcaagaaccauaaaguguucgacucuauccgaacuaagguguacaccaugauggauuuugucaucuauagauacuauauugaagaggacgcaaaaguugccgcugcgaauaagucccugcccgauaacgaaaagagcuugucggagaaggacaucuucgugauuaaucucaggggcucuuuuaacgaugaccagaaggacgcacuguacuaugaugaggccaaucggauauggcguaaauuagaaaacaucaugcacaauauuaaggaguuccgcggcaacaaaacaagagaauacaagaaaaaggacgcuccuaggcugccacggauccuccccgccgggcgagauguauccgcauuuucaaaacuuauguacgcccugacuauguucuuggacggaaaagagaucaaugaucuacugaccacacucauuaacaaguuugacaauauacagaguuuccugaaagugaugccucuuaucggugucaacgcuaaguuuguggaggaauaugccuucuucaaagauagcgcaaagauugcggacgagcugcgcuugaucaaauccuuugcuagaaugggcgaaccaauugccgaugcaaggcgggccauguacaucgacgcuauacgcauccucgggaccaaucugucuuaugaugaguuaaaggcccuggcagacacguucagccuagaugaaaacggaaauaagcucaaaaagggcaaacacgguaugagaaacuuuauuaucaacaauguuauuucaaacaagagguuccauuaccugauccguuauggggacccggcucaccuucaugagauagccaaaaaugaggcgguggucaaguuuguguugggccggauugccgacauccaaaagaaacagggacagaacggcaagaaucagauugaucgauacuaugaaacuugcaucgggaaagacaagggaaaaaguguauccgagaagguugaugcucugacaaagauaaucaccgguaugaacuacgaccaauucgauaaaaagagaagcgugauugaagacacuggcagggagaaugcagaacgcgagaaauuuaagaaaaucauuucucucuaccugacagucaucuaucacauacuuaagaacauugugaauaucaacgcccgguacgucaucggguuccacuguguggagagagaugcucagcuguauaaggaaaaaggauacgacauuaauuugaagaaacucgaggaaaagggcuuuucaaguguuaccaaacugugcgccgguaucgaugagacggcacccgacaagaggaaagauguggaaaaggagauggcggagcgcgccaaggaaagcauugacuccuuagagucugcuaacccuaaacuguaugccaauuacauaaaguauucggaugagaaaaaggcagaagaguucacccgacagaucaaccgggaaaaagcuaagacagcccuaaaugcauaccuccguaacacuaaguggaacguaauuaucagagaggaccugcuuaggauugacaauaaaaccuguacauuguuugccaacaaggcugucgcgcuggaaguggcccgcuacguucaugcauauaucaaugauauagcugaggugaacagcuacuuccaacucuaucacuacaucaugcagcggauuaucaugaaugaaagauaugagaaauccucagggaaggucagugaguacuuugacgccgugaacgaugagaaaaaguauaaugacaggcuguuaaagcugcuuugcguaccauucggcuacuguauuccccgauucaaaaacuugucuaucgaagcccucuuugaucgcaaugaagcugcaaaguucgacaaagagaagaaaaaggugagcggaaacuccggcucagggccuaagaaaaagcggaaaguugccgcggcuuacccauaugauguccccgacuacgccuga

SEQ ID NO: 14371 - RNA, 3381 nt, Artificial Sequence
  Cas13d variant__Ruminococcus flavefaciens XPD3002__hnRNPa1-dCasRx-HA
augggcagaagcggguccggaaacuucgguggcgggaggggaggcgguuuugggggaaaugacaacuucggccggggcgggaauuuuucuggacgcgguggcuucgggggaucacgaggcggugggggauacggcggcaguggggauggauauaacgguuuuggcaaugacgggagcaacuucggaggcgguggguccuacaaugauuuuggcaacuauaauaaccagucuucgaauuucggacccaugaagggcgggaacuuuggaggucguucaagcggcccuuacgggggaggcggucaauauuucgccaaaccaagaaaucaagggggcuacggaggcaguuccucuagcuccucauaugggaguggaaggcgguuuagcccgaagaaaaagcgcaaaguggaggcuucuaucgaaaagaagaaauccuucgcaaaggguaugggcgucaaaucaacccugguuagcgggaguaagguguacaugacaacuuuugccgagggaucugacgcgagacucgaaaagauuguagagggcgauuccauaaggagcgugaacgaaggugaggcuuucucggccgagauggcagacaagaaugccggguacaagaucggcaacgcuaaauucucucaccccaagggauaugcagucguggccaacaauccucuuuacacgggcccaguucagcaggauaugcugggguugaaagaaaccuuagagaagcgguauuuuggagaauccgcugacggcaacgauaauauuugcauccaggugauucauaacauccuggacauagagaaaauccuagccgaguacauuacaaaugcggcauaugccgucaacaauaucucaggucucgauaaggacauuaucggguucggaaaauuuaguacuguguacaccuaugaugaguucaaggaccccgaacaccaucgcgcugccuuuaacaauaacgacaagcugauaaaugcaauuaaagcucaguacgaugaguucgacaacuuucuugauaauccucgacugggcuacuucggucaggccuuuuucagcaaggaaggcagaaacuauaucauuaauuacgggaacgaauguuaugacaucuuggcgcuccuguccggacuggcccacuggguaguugcaaacaaugaggaggaaucuaggaucagccggacauggcucuacaacuuagauaaaaaucuggacaacgaguauauuucaacccuuaauuacuuguaugaucguauaacuaacgaacugacaaauaguuuuuccaagaacagcgcugccaaugugaacuacaucgcugagacccuaggcauuaauccagccgaguucgcagaacaguacuuucgcuucucuaucaugaaagagcaaaagaaccucggguucaauauaacgaagcugagagaagucaugcuugacaggaaagauaugucagagauucggaagaaccauaaaguguuugacaguauccgaacuaagguguauaccaugauggauuucgucaucuaccgcuauuacauugaagaggacgccaaaguugcugcggcaaauaagagccugcccgacaacgaaaaguccuugucugagaaagauaucuuugugauuaaccucagaggaucguucaaugacgaucagaaggacgcccuguauuacgaugaggcuaacaggauauggcggaaauuagaaaauaucaugcacaacauuaaggaguuucgcggcaauaaaacaagagaauauaagaagaaagacgccccuaggcugccacguauccucccggcaggucgggauguaagcgccuucuccaaacuuauguacgcucugacuauguuuuuggacgggaaagagaucaacgaucuacugaccacacucauuaauaaguucgacaacauacagucauuucugaaagugaugccccuuaucggagucaaugccaaguucguggaggaauacgcauuuuucaaagauagugcgaagauugcugacgagcugcgauugaucaagucuuuugccagaaugggcgaaccuauugcagaugccaggcgcgcuauguauaucgacgccauacggauccucgguaccaaccugagcuacgacgaguuaaaagcacuggcugauacguucucccuagacgaaaauggcaacaagcucaaaaaggggaaacacggaaugagaaauuucauuaucaacaauguuauuucaaacaagagguuucauuaucugauccgcuacggcgauccagcccaccuucaugagauagcgaagaacgaggccguggucaaauucguguuggggcgaauugcugacauccagaagaaacaaggacagaauggcaagaaccagauugaucgguauuacgaaacuugcaucgguaaagacaagggaaagagcguaucugagaaaguugaugcacugacaaagauaaucaccgggaugaauuaugaccaauuugauaaaaagcguuccgugauugaagacacuggcagagagaacgccgaaagggagaaauucaagaagaucauuagucucuaccugacagucaucuaccacauacuuaaaaauauugugaacaucaaugcucgcuaugucaucgguuuucacuguguggagcgggaugcccagcuguacaaggaaaaaggcuaugacauuaacuugaagaaacucgaggaaaagggguucagcucuguuaccaaacugugcgcaggaaucgaugagacggcgcccgacaagagaaaggacguggaaaaagagauggccgagagggcuaaggaauccauugauucauuagagagugccaauccuaaacuguacgcaaacuauauaaaguacagcgacgagaaaaaggcugaagaguuuacccgacagaucaaucgcgaaaaggccaaaacagcacuaaacgccuaucuccggaauacuaaguggaacguaauuaucagagaggaucugcuuaggauugacaauaaaaccuguacauuguucgcuaacaaggcggucgcccuggaaguggcacguuacguucaugcuuacaucaaugauauagccgaggugaacucguauuuucagcucuaccacuauaucaugcaacgcauuaucaugaacgaacgguacgagaaauccucuggcaaggucagcgaguauuucgacgccgugaaugaugaaaagaaauacaacgacagacuguuaaagcugcuuugcguaccauuuggguauuguauucccagguucaaaaauuugucaaucgaggcucucuucgaucgaaacgaagcagccaaguuugacaaagagaagaagaaagugaguggaaauuccggcucugguccgaagaaaaagcggaaaguugcggcugccuacccuuacgauguccccgacuaugcauga

SEQ ID NO: 14372 - RNA, 2787 nt, Artificial Sequence
  Cas13d variant__Uncultured Ruminococcus sp. __UrCas13d-HA
auggccaagaaaaacaagaugaaacccagagagcugagggaagcucagaagaaagcacggcaacucaaggccgcggagaucaauaacaaugcugccccugcaauugccgcuaugccagcagccgaagugauagcuccggccgcggagaagaaaaagagcuccgucaaagcagccggcaugaagucuauccuuguuucagaaaacaaaauguacauuaccaguuucgggaagggaaauagcgcugugcuggaguaugagguagacaacaaugauuacaaccagacacaguuguccucuaaggacaauucgaacauccaguuagguggcgugaaugaagucaacauuacuuuuucaagcaaacacggguucgagaguggaguggaaaucaauacguccaaccccacccaucgcucuggcgagagcuccccuguucgaggugauaugcuggggcuaaagucagagcucgaaaaacguuucuucggaaagacauuugacgauaauauacacauccaacugauuuauaacauccuugacauugagaaaauccuggccguguacgucacuaacauaguguaugcauugaauaacaugcucggcguaaagggcagugaaagccaugaugacuucauuggguaccugucuaccaauaacaucuaugauguuuuuauugacccagauaauuccucacugagcgacgauaaaaaggcuaacgugagaaagagucucucuaaauucaaugccuuacugaagacaaaaaggcuuggauacuuugguuuggaggaacccaagaccaaagacaaccgggucucccaggcguacaagaagcgcguguaucacaugcuggccaucgugggccagaucagacagugcgucuuccaugacaaaagcggggcaaagagguuugaucuauacucguucauuaauaacauagacccugaguaucgggauacucucgacuaccugguugaggaacgccuuaaaucuaucaauaaggauuuuauugaggacaacaaagugaauaucucccuguugauagauaugaugaagggauaugaagcugacgauauuauccgacucuacuaugacuucaucguacugaagucacagaaaaacuuaggcuucaguauuaagaaacugagagagaagaugcucgaugaauacgguuuuagguucaaagacaagcaauacgacagcgugcgguccaagauguauaaacuuauggauuuucuguuguucuguaauuacuaucguaacgacaucgccgcuggggagucucuaguccgcaagcugagauuuagcaugacagaugacgagaaagaaggaauuuacgccgaugaggcagccaagcucuggggcaaauucaggaacgacuuugaaaauauagcugaucacaugaacggcgacgugaucaaggagcuggggaaagcggauauggacuucgaugaaaagauucuugacucagagaagaaaaaugcaagugaucuguuguauuuuuccaagaugaucuacaugcucaccuauuuccuggacggaaaagagaucaacgacuuacugacgacucuaauuagcaaguuugauaauauaaaagaauuucucaagaucaugaagucuucagccguugacguggagugcgaacugaccgcugguuacaaacuuuuuaacgauagucagcggauuacaaaugaguuguucaucgucaagaacauugccagcaugcgaaaaccagcagccuccgcuaagcugacuauguuccgcgacgcccucaccauccugggcauagaugacaaaaucacagaugacagaauuucugggauccuuaagcugaaggagaaaggaaagggcauucacgguuugaggaauuuuaucaccaacaaugugauagaaucgagccgguucguauaccucauuaaauaugcaaacgcgcagaagauccgcgagguugcuaaaaaugaaaagguggucauguuugugcugggcgggauucccgauacgcaaaucgagagauacuauaaguccugugucgaguucccugacaugaacucaaguuuaggagugaaaaggucugaacuggcccguaugauaaagaauaucagcuuugaugacuucaaaaacguuaagcagcaggcaaaaggccgggagaacguggccaaggaacgagcuaaagccguaauugggcuauaccucacugucauguaucugcuugugaagaauuugguuaacgugaaugcaagauacgucaucgcuauucauugccuggagagggauuuuggacucuauaaggaaaucauaccagagcuggccuccaaaaacuuaaagaaugacuaccgcauucugucacaaacacuuugugaauugugcgacaaaagcccgaaccucuuccugaagaaaaaugagcggcuaagaaaguguguggagguagauaucaacaaugcggacucuuccaugaccaggaaguaccgcaacugcaucgcccaccugacugugguucgagaacucaaagaguauauuggugauaucuguacagucgacaguuacuuuagcauuuaucauuacgugaugcagcggugcauaaccaagcgugaaaaugauacgaaacaggaggaaaagaucaaauaugaggacgaucugcuuaagaaccacggcuacaccaaggacuucgugaaagcucugaacucucccuuuggguauaauauuccuagauucaagaauuuguccaucgagcaguuauuugauaggaacgaauaccucacagagaaauacccauaugacguccccgauuacgcauga

SEQ ID NO: 14373 - RNA, 2787 nt, Artificial Sequence
  Cas13d variant__Uncultured Ruminococcus sp. __dUrCas13d-HA
auggccaagaaaaacaagaugaaacccagagagcugagggaagcucagaagaaagcacggcaacucaaggccgcggagaucaauaacaaugcugccccugcaauugccgcuaugccagcagccgaagugauagcuccggccgcggagaagaaaaagagcuccgucaaagcagccggcaugaagucuauccuuguuucagaaaacaaaauguacauuaccaguuucgggaagggaaauagcgcugugcuggaguaugagguagacaacaaugauuacaaccagacacaguuguccucuaaggacaauucgaacauccaguuagguggcgugaaugaagucaacauuacuuuuucaagcaaacacggguucgagaguggaguggaaaucaauacguccaaccccacccaucgcucuggcgagagcuccccuguucgaggugauaugcuggggcuaaagucagagcucgaaaaacguuucuucggaaagacauuugacgauaauauacacauccaacugauuuauaacauccuugacauugagaaaauccuggccguguacgucacuaacauaguguaugcauugaauaacaugcucggcguaaagggcagugaaagccaugaugacuucauuggguaccugucuaccaauaacaucuaugauguuuuuauugacccagauaauuccucacugagcgacgauaaaaaggcuaacgugagaaagagucucucuaaauucaaugccuuacugaagacaaaaaggcuuggauacuuugguuuggaggaacccaagaccaaagacaaccgggucucccaggcguacaagaagcgcguguaucacaugcuggccaucgugggccagaucgcacagugcgucuucgcugacaaaagcggggccaagagauuugaucuauacucguucauuaauaacauagacccugaguauagggauacucucgacuaccugguugaggaacggcuuaaaucuaucaauaaggauuuuauugaggacaacaaagugaauaucucccuguugauagauaugaugaagggauaugaagcugacgauauuauccgccucuacuaugacuucaucguacugaagucacagaaaaacuuaggcuucaguauuaagaaacugcgagagaagaugcucgaugaauacgguuuuagauucaaagacaagcaauacgacagcgugagguccaagauguauaaacuuauggauuuucuguuguucuguaauuacuaucggaacgacaucgccgcaggggagucucuaguccguaagcugcgcuuuagcaugacagaugacgagaaagaaggaauuuacgccgaugaggcugcgaagcucuggggcaaauucagaaacgacuuugaaaauauagcagaucauaugaacggcgacgugaucaaggagcuggggaaagccgauauggacuucgaugaaaagauucuugacucagagaagaaaaaugcuagugaucuguuguauuuuuccaagaugaucuacaugcucaccuauuuccuggacggaaaagagaucaacgacuuacugacgacucuaauuagcaaguuugauaauauaaaagaauuucucaagaucaugaagucuucagccguugacguggagugcgaacugaccgcagguuacaaacuuuuuaacgauagucagaggauuacaaaugaguuguucaucgucaagaacauugccagcaugcggaaaccagcugccuccgcaaagcugacuauguuccgagacgcgcucaccauccugggcauagaugacaaaaucacagaugaccgcauuucugggauccuuaagcugaaggagaaaggaaagggcauucacgguuugagaaauuuuaucaccaacaaugugauagaaucgagcagguucguauaccucauuaaauaugcuaacgcccagaagauccgggagguugccaaaaaugaaaagguggucauguuuguguuagggggcauucccgauacgcaaaucgagcgcuacuauaaguccugugucgaguucccugacaugaacucaagucugggagugaaaagaucugaacuggcaaggaugauaaagaauaucagcuuugaugacuucaaaaacguuaagcagcaggcuaaaggccgugagaacguggccaaggaacgggcaaaagcuguaauugggcuauaccucacugucauguaucugcuugugaagaauuugguuaacgugaaugcccgauacgucaucgcgauucacugccuggagagagauuuuggacucuauaaggaaaucauaccagagcuggccuccaaaaacuuaaagaaugacuacaggauucugucacaaacacuuugugaauugugcgacaaaagcccgaaccucuuccugaagaaaaaugagcgccuacggaaguguguggagguagauaucaacaaugcugacucuuccaugaccagaaaguacgcaaacugcaucgccgcucugacugugguuagggaacucaaagaguauauuggugauaucuguacagucgacaguuacuuuagcauuuaucauuacgugaugcagcgcugcauaaccaagcgagaaaaugauacgaaacaggaggaaaagaucaaauaugaggacgaucugcuuaagaaccacggcuacaccaaggacuucgugaaagccuugaacucucccuuuggguauaauauuccucgguucaagaaucuguccaucgagcaguuauuugaucguaacgaauaccucacagagaaauacccauaugacguccccgauuacgcauga

SEQ ID NO: 14374 - RNA, 2859 nt, Artificial Sequence
  Cas13d variant__Uncultured Ruminococcus sp. __NLS-UrCas13d-NLS-HA
augagccccaagaaaaagagaaaaguggaggccuccgcuaagaaaaacaagaugaagccuagggaacugcgggaggcacagaaaaaggcccgccaacucaaagcggcugaaaucaauaacaaugccgcaccagccauugcugcaaugccggccgcugaggucauagcccccgcggcagaaaagaaaaagucuucaguuaaggccgcuggcaugaaaaguauccuugugagcgagaacaagauguacauuaccuccuucgggaaaggaaauucugccguacuggaguaugaaguggacaacaaugauuacaaccagacacaguugucgucaaaggacaauagcaacauccaguuagguggcgucaaugaggugaacauuacuuuuaguuccaaacacggguucgaaucuggaguugagaucaauacgagcaacccuacccaucgauccggcgagucaaguccagugcguggugauaugcuggggcuaaagagcgaacucgagaaaagauuuuucggaaagacauuugacgauaauauacacauccaacugauuuauaacauccuugacauugaaaagauccuggcagucuacgugacuaacauaguauaugcuuugaauaacaugcucggcguuaaaggcucugagucccaugaugacuucauuggguaccugucaaccaauaacaucuaugauguguuuauugaccccgauaauagcagucugucugacgauaagaaagccaacgucaggaagucccucagcaaauucaaugcguuacugaagacaaagcggcuuggauacuuugguuuggaagaaccuaaaaccaaggacaaccgcgugucgcaggccuacaaaaagagaguguaucacaugcuggcaaucgucggccagaucaggcagugcguuuuccaugacaaaucuggggcuaagcgguuugaucuauacuccuucauuaauaacauagacccagaguaucgcgauacucucgacuaccugguggaggagcgacuuaagucaaucaauaaagauuuuauugaagacaacaagguaaauaucagucuguugauagauaugaugaaaggauaugaggccgacgauauuaucagacucuacuaugacuucaucgugcuaaagagccagaaaaacuuaggcuucuccauuaagaagcugagggagaaaaugcucgaugaauacgguuuucgguucaaggacaaacaauacgacucuguccguagcaagauguauaaacuuauggauuuucuguuguucuguaauuacuaucgcaacgacaucgcugccggggagucacuggugagaaagcugagguuuaguaugacagaugacgaaaaagagggaauuuacgcagaugaagccgcuaagcucuggggcaaguuccggaacgacuuugagaauauagcggaucacaugaacggcgacguuaucaaagaacuggggaaggcagauauggacuucgaugagaaaauucuugacuccgagaagaaaaaugccagcgaucuguuguauuuuucuaagaugaucuacaugcucaccuauuuccuggacggaaaggaaaucaacgacuuacugacgacucuaauuucaaaauuugauaauauaaaggaguuccucaaaaucaugaagaguagcgcuguggacgucgaaugcgagcugaccgccgguuacaaacuuuuuaacgauucccagcgaauuacaaaugaguuguucaucgugaagaacauugcaucuaugcgcaagcccgccgcuucggccaaacugacuauguucagagacgcacucaccauccugggcauagaugacaagaucacagaugacaggauuagcgggauccuuaaacugaaggaaaaaggaaagggcauucacgguuugcggaauuuuaucaccaacaauguaauagaguccucacgcuucguuuaccucauuaaguaugcgaacgcucagaaaaucagagaaguggccaagaaugagaaagucgugauguuugucuuagggggcauuccugauacgcaaaucgaaagguacuauaagaguuguguggaguucccagacaugaacucuagccugggaguuaaacguuccgagcuggcacggaugauaaagaauaucucauuugaugacuucaaaaacgugaagcagcaggccaagggccgagaaaacguagcuaaagagagagccaaggcagucauugggcuauaccucacugugauguaucugcuuguuaaaaauuuggugaacgucaaugcuagguacgugaucgccauucauugccuggaacgcgauuuuggacucuauaaggagaucauaccggaacuggcgagcaaaaacuuaaagaaugacuaccggauucugucucaaacacuuugugaguugugcgacaagucccccaaccucuuccugaaaaagaaugagagacuaaggaaauguguagaaguggauaucaacaaugccgacaguagcaugacccgcaaguaccgaaacugcaucgcucaccugacuguuguccgggagcucaaagaauauauuggugauaucuguacaguggacucuuacuuuuccauuuaucauuacgugaugcagcguugcauaaccaagagagagaaugauacgaagcaggaagagaaaaucaaguaugaggacgaucugcuuaaaaaccacggcuacaccaaggacuucgucaaagcauugaacucaccuuuuggguauaauauuccaagguucaagaaucugaguaucgaacaguuauuugaucgcaacgaguaccucacagaaaagggaagcggccccaaaaagaaacggaagguugccgcugccuacccuuaugacgugccagauuacgcauga

SEQ ID NO: 14375 - RNA, 2859 nt, Artificial Sequence
  Cas13d variant__Uncultured Ruminococcus sp. __NLS-dUrCas13d-NLS-HA
augagccccaagaaaaagagaaaaguggaggccuccgcuaagaaaaacaagaugaagccuagggaacugcgggaggcacagaaaaaggcccgccaacucaaagcggcugaaaucaauaacaaugccgcaccagccauugcugcaaugccggccgcugaggucauagcccccgcggcagaaaagaaaaagucuucaguuaaggccgcuggcaugaaaaguauccuugugagcgagaacaagauguacauuaccuccuucgggaaaggaaauucugccguacuggaguaugaaguggacaacaaugauuacaaccagacacaguugucgucaaaggacaauagcaacauccaguuagguggcgucaaugaggugaacauuacuuuuaguuccaaacacggguucgaaucuggaguugagaucaauacgagcaacccuacccaucgauccggcgagucaaguccagugcguggugauaugcuggggcuaaagagcgaacucgagaaaagauuuuucggaaagacauuugacgauaauauacacauccaacugauuuauaacauccuugacauugaaaagauccuggcagucuacgugacuaacauaguauaugcuuugaauaacaugcucggcguuaaaggcucugagucccaugaugacuucauuggguaccugucaaccaauaacaucuaugauguguuuauugaccccgauaauagcagucugucugacgauaagaaagccaacgucaggaagucccucagcaaauucaaugcguuacugaagacaaagcggcuuggauacuuugguuuggaagaaccuaaaaccaaggacaaccgcgugucgcaggccuacaaaaagagaguguaucacaugcuggcaaucgucggccagaucgcucagugcguuuucgccgacaaaucuggggcuaagagguuugaucuauacuccuucauuaauaacauagacccagaguaucgggauacucucgacuaccugguggaggagcgccuuaagucaaucaauaaagauuuuauugaagacaacaagguaaauaucagucuguugauagauaugaugaaaggauaugaggccgacgauauuauccgacucuacuaugacuucaucgugcuaaagagccagaaaaacuuaggcuucuccauuaagaagcugagagagaaaaugcucgaugaauacgguuuuagguucaaggacaaacaauacgacucuguccggagcaagauguauaaacuuauggauuuucuguuguucuguaauuacuaucguaacgacaucgcagccggggagucacuggugcgcaagcugagauuuaguaugacagaugacgaaaaagagggaauuuacgcugaugaagcggcaaagcucuggggcaaguucaggaacgacuuugagaauauagccgaucauaugaacggcgacguuaucaaagaacuggggaaggcugauauggacuucgaugagaaaauucuugacuccgagaagaaaaaugccagcgaucuguuguauuuuucuaagaugaucuacaugcucaccuauuuccuggacggaaaggaaaucaacgacuuacugacgacucuaauuucaaaauuugauaauauaaaggaguuccucaaaaucaugaagaguagcgcaguggacgucgaaugcgagcugaccgccgguuacaaacuuuuuaacgauucccagcggauuacaaaugaguuguucaucgugaagaacauugcuucuaugcgaaagcccgccgcaucggcgaaacugacuauguuccgcgacgcucucaccauccugggcauagaugacaagaucacagaugacagaauuagcgggauccuuaaacugaaggaaaaaggaaagggcauucacgguuugaggaauuuuaucaccaacaauguaauagaguccucacgguucguuuaccucauuaaguaugccaacgcacagaaaauccgcgaaguggccaagaaugagaaagucgugauguuugucuuagggggcauuccugauacgcaaaucgaaagauacuauaagaguuguguggaguucccagacaugaacucuagccugggaguuaaaagguccgagcuggcucguaugauaaagaauaucucauuugaugacuucaaaaacgugaagcagcaggccaagggccgggaaaacguagcaaaagagcgagcuaaggccgucauugggcuauaccucacugugauguaucugcuuguuaaaaauuuggugaacgucaaugcgagauacgugaucgccauucacugccuggaaagggauuuuggacucuauaaggagaucauaccggaacuggcuagcaaaaacuuaaagaaugacuaccgcauucugucucaaacacuuugugaguugugcgacaagucccccaaccucuuccugaaaaagaaugagcggcuaagaaaauguguagaaguggauaucaacaaugcagacaguagcaugaccaggaaguacgccaacugcaucgcugcccugacuguuguccgcgagcucaaagaauauauuggugauaucuguacaguggacucuuacuuuuccauuuaucauuacgugaugcagcgaugcauaaccaagcgggagaaugauacgaagcaggaagagaaaaucaaguaugaggacgaucugcuuaaaaaccacggcuacaccaaggacuucgucaaagcauugaacucaccuuuuggguauaauauuccacguuucaagaaucugaguaucgaacaguuauuugauagaaacgaguaccucacagaaaagggaagcggccccaaaaagaaaaggaagguugcggccgcuuacccuuaugacgugccagauuacgccuga

SEQ ID NO: 14376 - RNA, 4275 nt, Artificial Sequence
  Cas13d variant__Leptotrichia wadei __NLS-LwCas13a-msfGFP
augaagagacccgccgcuaccaaaaaggcaggccaggccaaaaagaaaaaggggagcaugaaggugacaaaagucgacggaaucucccacaagaaauacauugaggaagguaagcugguuaaaucuacuucagaggaaaacaggacgagugagcggcucagcgaacuucuguccauacgcuuggauaucuauauuaagaauccugacaacgcgucugaggaggaaaaucgaauccguagagagaacuuaaagaaauucuuuucgaauaaggugcugcaucuaaaagauucaguacucuaccugaagaacaggaaagaaaagaaugcugugcaagacaaaaacuauagcgaggaggauauuagugaauacgaccuuaagaauaagaacuccuucucuguccugaaaaagaucuugcucaaugaggaugugaacagcgaggaacuggaaauauuucggaaagacguugaggccaagcugaauaaaaucaacucccucaaguauucauucgaggaaaauaaggcaaacuaccagaaaauuaacgagaauaacguggaaaaggucggcgggaaaaguaagcgcaauaucauuuaugauuacuacagagagagcgccaaaaggaacgacuauaucaauaacgugcaggaggcuuuugauaaguuauacaagaaagaagacauagagaagcuguucuuucuuauugaaaauucuaaaaagcacgagaaauauaagauccgggaauacuaucauaagauuaucggacgcaaaaacgauaaggagaauuucgcaaaaaucauuuacgaagagauacagaacguaaauaacaucaaggaguugauugaaaagaucccagacauguccgagcugaagaaaucacaaguguuuuauaaguacuaccuagacaaggaggaacucaaugauaaaaacauaaaguaugccuucugccacuuuguugagauugaaaugagccagcugcuuaaaaauuacgucuauaagcgacugaguaacaucucuaacgacaaaaucaagagaauuuucgaguaccagaauuugaagaaacucaucgaaaacaagcuguuaaauaaacuggauaccuaugugaggaacuguggcaaguacaauuauuaccuccaggugggugagauugcuacauccgacuuuauagcccggaaccgucaaaaugaagcguuccuucgcaacaucauuggggucagcucgguugcauacuucucucugagaaauaucuuggagacugagaacgaaaauggaaucaccggcaggaugcggggcaaaacagugaagaacaauaagggggaggaaaaauauguauccggagagguggauaagauuuacaacgaaaauaaacagaacgaggucaaggagaaccuaaaaauguuuuauucauacgacuucaauauggauaacaagaaugaaauagaggacuuuuucgccaacaucgaugaagcuauuaguagcauccgacaugguauugugcacuuuaaucuggagcucgaaggcaaggacaucuucgccuuuaaaaacauagcaccguccgagaucucuaagaaaauguuccagaaugagauuaacgaaaagaaacugaaacuuaaaaucuuuaagcagcugaauagcgcuaacguuuucaauuauuacgagaaggaugugauuaucaaauauuugaagaacaccaaauuuaauuucgucaacaagaauauacccuuugugccuucauucacuaaacucuacaacaagauugaagaccugcgcaacacauuaaaguucuuuuggaguguaccaaaagacaaggaggagaaagaugcccaaaucuaccugcuaaagaauauuuauuacggggaguuccucaacaaauuuguuaaaaauuccaagguguucuuuaaaaucaccaacgaagucauaaagaucaauaaacagagaaaccagaagacgggacacuauaaauaccaaaaguucgaaaauauugagaagacugugcccgucgaauaucuggcgaucauucagagcagggagaugaucaacaaucaggacaaagaggaaaagaacaccuacauagauuuuauucagcaaaucuuccuuaaaggcuuuaucgacuauuugaauaagaacaaucugaaauacauugagucuaacaauaacaaugauaacaacgacaucuucucaaagauuaagauaaagaaggauaauaaagaaaaguacgacaaaauccucaagaacuaugagaaacauaaucggaacaaggaaauuccucacgagaucaaugaguuugugcgcgaaauuaagcuggguaaaauccuuaaguacacagagaaccugaauauguucuauuugauacucaaacuguuaaaccauaaggaacugacuaaucuaaaagggagucucgagaaguaccagagcgccaacaaggaagagaccuuuuccgaugagcuggaacuuaucaauuugcugaaccucgacaauaacagaguuacagaggauuucgaacuggaggcaaaugagauuggaaaauucuuagacuuuaacgaaaacaagaucaaagauaggaaggagcugaaaaaguucgacaccaauaagauuuauuuugacggcgaaaacaucauaaaacaccgugcuuucuacaauauuaagaaauauggcaugcuuaacuugcucgagaagaucgccgauaaagcuaaguacaagaucucucugaaagaacuaaaggaguacucgaauaaaaagaacgagauugaaaagaauuauacgaugcagcagaaccugcaccggaaguacgcccgacccaaaaaggacgagaaguuuaaugaugaagacuauaaagaguacgaaaaggcaauagggaacauccaaaaauauacucaucucaagaauaaaguggaguucaacgagcugaaucuuuugcagggacuguuacucaagauucugcacagacuuguagguuacacaagcaucugggaaagggaucugcgcuuucgguugaagggcgaguucccagaaaaccauuauauugaggaaaucuuuaauuucgacaacuccaaaaacgucaaguacaaaucagggcagauaguggagaaguacaucaauuuuuauaaagagcucuacaaggauaacguugaaaagagaaguauuuauucugacaaaaaggugaaaaagcugaaacaggagaagaaggaucuauacaucaggaauuauauugcccacuucaacuacaucccucaugcugaaauaagccugcucgagguccuggagaaucuucgcaaauugcuguccuaugaccgaaagcucaaaaacgcgauuaugaagucaaucguggauaucuuaaaagaauacggauucguagcaaccuuuaagauuggcgccgacaaaaagaucgagauacaaacucuggaaagcgagaagauugugcaccuuaaaaaucugaagaaaaagaaacuaaugacagaucggaacucugaggaacucugcgagcugguuaaggucauguucgaauacaaggcuuuggagggugggggcggauccggcgggggagguaguggcgggggaggcagcgugucuaaaggugaggaacuguuuaccgggguggucccaaucuuaguugaacucgacggcgacgugaauggacacaaguucuccgugcguggcgagggggagggagaugccacgaacgguaaacugacccuuaaguuuauuuguacaacuggcaaacugccgguacccuggccuaccuuggucacaacucucaccuauggggugcagugcuucucaagauacccagaccauaugaagcagcacgacuuuuucaagagugcaaugcccgaaggauauguucaggagaggacaaucagcuuuaaagaugauggcaccuacaagacucgcgccgaagugaaauucgagggugacacgcuggucaaucggauagaacuaaaggggauugauuuuaaagaggacggcaacauccugggacauaaacuugaguauaauuucaacucgcacaauguguacaucacagcugauaagcagaaaaacggcauuaaggccaacuuuaaaaucagacacaauguugaagacggguccgugcaacucgcagaucauuaucagcaaaacaccccuauuggagacggcccaguacuguugcccgacaaucacuaccugucuacucagagcaaguuaucaaaagauccgaacgagaagagggaccauaugguccuccuggaguucgugaccgcggcugguauaacacuugggauggaugaacuguacaaguga

SEQ ID NO: 14377 - RNA, 4275 nt, Artificial Sequence
  Cas13d variant__Leptotrichia wadei __NLS-dLwCas13a-msfGFP
augaagagacccgccgcuaccaaaaaggcaggccaggccaaaaagaaaaaggggagcaugaaggugacaaaagucgacggaaucucccacaagaaauacauugaggaagguaagcugguuaaaucuacuucagaggaaaacaggacgagugagcggcucagcgaacuucuguccauacgcuuggauaucuauauuaagaauccugacaacgcgucugaggaggaaaaucgaauccguagagagaacuuaaagaaauucuuuucgaauaaggugcugcaucuaaaagauucaguacucuaccugaagaacaggaaagaaaagaaugcugugcaagacaaaaacuauagcgaggaggauauuagugaauacgaccuuaagaauaagaacuccuucucuguccugaaaaagaucuugcucaaugaggaugugaacagcgaggaacuggaaauauuucggaaagacguugaggccaagcugaauaaaaucaacucccucaaguauucauucgaggaaaauaaggcaaacuaccagaaaauuaacgagaauaacguggaaaaggucggcgggaaaaguaagcgcaauaucauuuaugauuacuacagagagagcgccaaaaggaacgacuauaucaauaacgugcaggaggcuuuugauaaguuauacaagaaagaagacauagagaagcuguucuuucuuauugaaaauucuaaaaagcacgagaaauauaagauccgggaauacuaucauaagauuaucggacgcaaaaacgauaaggagaauuucgcaaaaaucauuuacgaagagauacagaacguaaauaacaucaaggaguugauugaaaagaucccagacauguccgagcugaagaaaucacaaguguuuuauaaguacuaccuagacaaggaggaacucaaugauaaaaacauaaaguaugccuucugccacuuuguugagauugaaaugagccagcugcuuaaaaauuacgucuauaagcgacugaguaacaucucuaacgacaaaaucaagagaauuuucgaguaccagaauuugaagaaacucaucgaaaacaagcuguuaaauaaacuggauaccuaugugaggaacuguggcaaguacaauuauuaccuccaggugggugagauugcuacauccgacuuuauagcccggaaccgucaaaaugaagcguuccuucgcaacaucauuggggucagcucgguugcauacuucucucugagaaauaucuuggagacugagaacgaaaauggaaucaccggcaggaugcggggcaaaacagugaagaacaauaagggggaggaaaaauauguauccggagagguggauaagauuuacaacgaaaauaaacagaacgaggucaaggagaaccuaaaaauguuuuauucauacgacuucaauauggauaacaagaaugaaauagaggacuuuuucgccaacaucgaugaagcuauuaguagcaucgcccaugguauugugcacuuuaaucuggagcucgaaggcaaggacaucuucgcauuuaaaaacauagcuccguccgagaucucuaagaaaauguuccagaaugagauuaacgaaaagaaacugaaacuuaaaaucuuuaagcagcugaauagcgccaacguuuucaauuauuacgagaaggaugugauuaucaaauauuugaagaacaccaaauuuaauuucgucaacaagaauauacccuuugugccuucauucacuaaacucuacaacaagauugaagaccugcgaaacacauuaaaguucuuuuggaguguaccaaaagacaaggaggagaaagaugcgcaaaucuaccugcuaaagaauauuuauuacggggaguuccucaacaaauuuguuaaaaauuccaagguguucuuuaaaaucaccaacgaagucauaaagaucaauaaacagcgcaaccagaagacgggacacuauaaauaccaaaaguucgaaaauauugagaagacugugcccgucgaauaucuggccaucauucagagcagagagaugaucaacaaucaggacaaagaggaaaagaacaccuacauagauuuuauucagcaaaucuuccuuaaaggcuuuaucgacuauuugaauaagaacaaucugaaauacauugagucuaacaauaacaaugauaacaacgacaucuucucaaagauuaagauaaagaaggauaauaaagaaaaguacgacaaaauccucaagaacuaugagaaacauaauaggaacaaggaaauuccucacgagaucaaugaguuugugcgggaaauuaagcuggguaaaauccuuaaguacacagagaaccugaauauguucuauuugauacucaaacuguuaaaccauaaggaacugacuaaucuaaaagggagucucgagaaguaccagagcgcaaacaaggaagagaccuuuuccgaugagcuggaacuuaucaauuugcugaaccucgacaauaaccgcguuacagaggauuucgaacuggaggcuaaugagauuggaaaauucuuagacuuuaacgaaaacaagaucaaagauagaaaggagcugaaaaaguucgacaccaauaagauuuauuuugacggcgaaaacaucauaaaacacagggccuucuacaauauuaagaaauauggcaugcuuaacuugcucgagaagaucgcugauaaagccaaguacaagaucucucugaaagaacuaaaggaguacucgaauaaaaagaacgagauugaaaagaauuauacgaugcagcagaaccugcaccguaaguacgcacggcccaaaaaggacgagaaguuuaaugaugaagacuauaaagaguacgaaaaggccauagggaacauccaaaaauauacucaucucaagaauaaaguggaguucaacgagcugaaucuuuugcagggacuguuacucaagauucugcaccgacuuguagguuacacaagcaucugggaaagagaucugagguuucgcuugaagggcgaguucccagaaaaccauuauauugaggaaaucuuuaauuucgacaacuccaaaaacgucaaguacaaaucagggcagauaguggagaaguacaucaauuuuuauaaagagcucuacaaggauaacguugaaaagcggaguauuuauucugacaaaaaggugaaaaagcugaaacaggagaagaaggaucuauacaucgcuaauuauauugcgcacuucaacuacaucccucaugcagaaauaagccugcucgagguccuggagaaucuuagaaaauugcuguccuaugacaggaagcucaaaaacgccauuaugaagucaaucguggauaucuuaaaagaauacggauucguagcuaccuuuaagauuggcgccgacaaaaagaucgagauacaaacucuggaaagcgagaagauugugcaccuuaaaaaucugaagaaaaagaaacuaaugacagaucgcaacucugaggaacucugcgagcugguuaaggucauguucgaauacaaggcauuggagggugggggcggauccggcgggggagguaguggcgggggaggcagcgugucuaaaggugaggaacuguuuaccgggguggucccaaucuuaguugaacucgacggcgacgugaauggacacaaguucuccgugcgaggcgagggggagggagaugccacgaacgguaaacugacccuuaaguuuauuuguacaacuggcaaacugccgguacccuggccuaccuuggucacaacucucaccuauggggugcagugcuucucacgguacccagaccauaugaagcagcacgacuuuuucaagagugcuaugcccgaaggauauguucaggagcguacaaucagcuuuaaagaugauggcaccuacaagacuagagccgaagugaaauucgagggugacacgcuggucaauaggauagaacuaaaggggauugauuuuaaagaggacggcaacauccugggacauaaacuugaguauaauuucaacucgcacaauguguacaucacagcagauaagcagaaaaacggcauuaaggcgaacuuuaaaauccgccacaauguugaagacggguccgugcaacucgcugaucauuaucagcaaaacaccccuauuggagacggcccaguacuguugcccgacaaucacuaccugucuacucagagcaaguuaucaaaagauccgaacgagaagcgggaccauaugguccuccuggaguucgugaccgccgcagguauaacacuugggauggaugaacuguacaaguga

SEQ ID NO: 14378 - RNA, 2868 nt, Artificial Sequence
  Cas13d variant__Anaerobic digester metagenome 15706__AdmCas13d-HA
augaacaauaagagaaaaaccaaggccaaagcugccggccucaagagcguguucuuugaccagaaacaagcgguccugacaacguucgcuaaggggaacaauucccagaucgagaagaaaguugugaacucugaagugaaggaucugcggcagcccccugccuuugaccuugagcugaaagaaaagaccuucuacauuagcggaaagaauaacaucaauacaucccgcgagaacccgcucgccucugcuagccugccccuuuccaagagacagcggauucgcgccgaaagaaucaagcgggcucgcgaggagaauagaccuuaucacaacgucaaacgggugggcgaagaugaccugcgcgccaaggcggaucucgagaaacauuacuuugggaaggaauauucugacaaucugaaaauucaaaucaucuacaacauucuggauaucaauaagauuaucagccccuauauuaacgacaucguuuacuccaugaauaaccucgccagaaacgaugaguauauugacggaaaaaucgaugugaucggcagccugucuuccaccacagacuacagcucuuucauguccccuaauaaggaucuugagaaggagaaaaaguuuagcuuccaccgggaaaacuacaaaaaguuugucgaagcuagcaaacccuauaugcgcuacuaugggaagguguucauuagagacguuaagaaauccaagcugagcaccggaaaaggcgagaagaucgaagugauguaccgguccgacgaggagauuuuuacaaucuuccagauucucucuuauguccgccagagcaucaugcauaaugauaucggcaacaaauccagcauucuggccaucgaaaaguacccugcuagauuugugggguuccuuucugaccugcucaagaccaaaacgaaugaugugaaccggauguucauugacaauaacucccagaccaauuuuuggguccuguucagcaucuuuggacugcaagaucacacaucuggcgccgacaagauuugcagaaacuucuaugauuuuguuaucaaagcggacagcaagaaucucggguucucccugaaaaagauccgcgagcuuaugcuggaucucccgaacgccaauaugcugcgggaccaucaguuugauaccgugagaucuaaguucuacacacuucuggacuuuauuaucuaccagcacuaucucgaagagaaaagccgcauugacaacaugguggaaaagcugcggaugacccugaaagaggaggaaaaggagguccucuacgcugccgaagcuaaaaucguguggaaugccauuggagccaagguuaucaacaaacuggugcccaugaugaacggcgaugcucuuaaggagauuaagcgcaaaaauagagaccggaagcugccucaguccgucaucgcgacggugcaaguuaacagcgaugccaauguguucucugggcucaucuauuuucugacacuuuuccuggacggaaaagaaauuaacgagauggucuccaaucucaucaccaaguuugagaacauugauagccugcugcacguggacagagaaaucuacaaaucugaugagaaggaccucgaucuggaaauugagaaacuugcucuguucuucaaaggcgucgugcgccccaaugccaagacagacaccggcgccggggagaucuccaaaucuuuuuccaucuuccagucugcugaacggauuaucgaggaacucaaguuuauuaaaaacguuaccagaauggauaaugagaucuucccuagcgaaggaguguuucuggacgccgcgaacguccugggcgugcgcggggaugacuucgacuuuuccaaugaguucguuggagaugaccuucauucugaugcuaacaagaagauuaucaauaaaaucaacggcacaaaggaggaccggaaucucagaaacuuuauuaucaacaauguggucaaaagccggcgcuuccaguauauugccagacacaugaacacgcauuacgugaagcaacuggccaauaacgaaacccugaaucgguuugugcucaacaaaaugggggaugcuaagaucauuaauagauauuacgaguccaucagcggaaacacacccaauaucgaaguucgcucucagauugacuaccuggucaagcggcuuagauccuucagcuuugaggaucugaacgacgugaaacagaaggugcgcccgggcaccaaugaaucuaucgagaaagagaagaaaaaggcccucgucggccugugucugacaauucaguaucuuguguacaaaaaccucguuaauaucaacgcuagauauaccacggccuucuacugccuggaacgggauuccaagcugaagggguucggaguggacgucuggcgcgauuuugagagcuauacagcgcucaccaaucacuucauuaaagaaggcuaccugccugugagaaaggccgagauccuucgggcuaaccugaaacaccucgacugugaagauggguuuaaguauuaccgcaaccaaguuacccaucugaaugccauuagaguggcuuacaaauauaucaacgagaucaagucuguccacagcuacuucgcccuguaucauuacauuaugcagcggcaccuuuaugacucccuccaggcgaaggccaaagacagcucuggauuugugaucgaugcucugaagaaauccuucgagcauaagauuuacagcaaagaccugcuccacguucugcacucccccuuuggcuauaauacagcccgcuacaagaaccuuucuaucgaagcucuguucgauaagaaugagagcagaccugaagugaacccccucuccaccaaugacuaccccuaugaugucccugacuacgccuga

SEQ ID NO: 14379 - RNA, 2868 nt, Artificial Sequence
  Cas13d variant__Anaerobic digester metagenome 15706__dAdmCas13d-HA
augaacaauaagagaaaaaccaaggccaaagcugccggccugaaaagcguguucuuugaccagaaacaagcgguccucacaacguucgcuaaggggaacaauucccagaucgagaagaaaguugugaacucugaagugaaggaucugcggcagcccccugccuuugaccuugagcugaaagaaaagaccuucuacauuagcggaaagaauaacaucaauacaucccgcgagaacccgcucgccucugcuagccugccccuuuccaagagacagcggauucgcgccgaaagaaucaagcgggcucgcgaggagaauagaccuuaucacaacgucaaacgggugggcgaagaugaccugcgcgccaaggcggaucucgagaaacauuacuuugggaaggaauauucugacaaucugaaaauucaaaucaucuacaacauucuggauaucaauaagauuaucagccccuauauuaacgacaucguuuacuccaugaauaaccucgccagaaacgaugaguauauugacggaaaaaucgaugugaucggcagccugucuuccaccacagacuacagcucuuucauguccccuaauaaggaucuugagaaggaaaagaaguuuagcuuccaccgggagaacuacaaaaaguuugucgaagcuagcaaacccuauaugcgcuacuaugggaagguguucauuagagacguuaagaaauccaagcugagcaccggaaaaggcgagaagaucgaagugauguaccgguccgacgaggagauuuuuacaaucuuccagauucucucuuaugucgcccagagcaucauggcuaaugauaucggcaacaaauccagcauucuggccaucgaaaaguacccugcgcgcuuugugggguuccuuucugaccugcucaagaccaaaacgaaugaugugaacagaauguucauugacaauaacucccagaccaauuuuuggguccuguucagcaucuuuggacugcaagaucauacaucuggcgccgacaagauuugccggaacuucuaugauuuuguuaucaaagcugacagcaagaaucucggguucucccugaaaaagaucagagagcuuaugcuggaucucccgaacgccaauaugcugcgcgaccaccaguuugauaccgugcggucuaaguucuacacacuucuggacuuuauuaucuaccagcauuaucucgaagagaaaagcagaauugacaacaugguggaaaagcugcgcaugacccugaaagaggaggaaaaggagguccucuacgcugccgaagccaaaaucguguggaaugcuauuggagcgaagguuaucaacaaacuggugcccaugaugaacggcgaugcccuuaaggagauuaagcggaaaaauagagaccgcaagcugccucaguccgucaucgcuacggugcaaguuaacagcgaugccaauguguucucugggcucaucuauuuucugacacuuuuccuggacggaaaagaaauuaacgagauggucuccaaucucaucaccaaguuugagaacauugauagccugcugcacguggaccgggaaaucuacaaaucugaugagaaggaccucgaucuggaaauugagaaacuugcccuguucuucaaaggcgucgugagacccaaugcuaagacagacaccggcgccggggagaucuccaaaucuuuuuccaucuuccagucugcggaacgcauuaucgaggaacucaaguuuauuaaaaacguuacccggauggauaaugagaucuucccuagcgaaggaguguuucuggacgcugccaacguccugggcgugagaggggaugacuucgacuuuuccaaugaguucguuggagaugaccuucacucugaugccaacaagaagauuaucaauaaaaucaacggcacaaaggaggaccgcaaucuccggaacuuuauuaucaacaauguggucaaaagcagacgguuccaguauauugcucgccauaugaacacgcacuacgugaagcaacuggccaauaacgaaacccugaauagauuugugcucaacaaaaugggggaugcuaagaucauuaaucgguauuacgaguccaucagcggaaacacacccaauaucgaaguuagaucucagauugacuaccuggucaagcgccuucgguccuucagcuuugaggaucugaacgacgugaaacagaaggugagaccgggcaccaaugaaucuaucgagaaagagaagaaaaaggcccucgucggccugugucugacaauucaguaucuuguguacaaaaaccucguuaauaucaacgcgcgcuauaccacggccuucuacugccuggaaagagauuccaagcugaagggguucggaguggacgucuggcgggauuuugagagcuauacagcucucaccaaucauuucauuaaagaaggcuaccugccugugcgcaaggccgagauccuuagagcuaaccugaaacaccucgacugugaagauggguuuaaguauuacgccaaccaaguuaccgcgcugaaugccauucggguggcuuacaaauauaucaacgagaucaagucuguccacagcuacuucgcccuguaucauuacauuaugcagcgccaccuuuaugacucccuccaggcuaaggccaaagacagcucuggauuugugaucgaugcccugaagaaauccuucgagcauaagauuuacagcaaagaccugcuccacguucugcauucccccuuuggcuauaauacagcuagauacaagaaccuuucuaucgaagcgcuguucgauaagaaugagagccggccugaagugaacccccucuccaccaaugacuaccccuaugaugucccugacuacgccuga

SEQ ID NO: 14380 - RNA, 2940 nt, Artificial Sequence
  Cas13d variant__Anaerobic digester metagenome 15706__NLS-AdmCas13d-NLS-HA
augagccccaagaaaaagagaaaaguggaggccuccaacaauaagcggaaaaccaaggcuaaggccgcgggccugaaaucugucuucuuugaccagaagcaagcuguucucacaacguucgccaaagggaacaauagccagaucgaaaagaaaguggugaacuccgaggucaaggaucugcgccagccuccggccuuugaccuugaacugaaggagaaaaccuucuacauuucuggaaagaauaacaucaauacaagcagagaaaacccccucgcuuccgccucucugccucuuagcaaacggcagcgcauuagagcugagcggaucaagcgcgccagagaggaaaaucggcccuaucacaacgugaaacgcguuggcgaggaugaccugagagcgaaggccgaucucgaaaaacauuacuuugggaaggaguauuccgacaaucugaagauucaaaucaucuacaacauucuggauaucaauaaaauuaucagcccuuauauuaacgacaucguguacucuaugaauaaccucgcucggaacgaugaguauauugacggaaagaucgaugucaucggcucccugagcucuaccacagacuacuccagcuucaugucucccaauaaagaucuugaaaaggagaaaaaguuuuccuuccaccgcgaaaacuacaagaaauuuguggaggccagcaagccuuauaugagauacuaugggaaaguuuucauucgggacgugaagaaauccaagcugucuaccggaaagggcgaaaagaucgaggucauguaccgcagcgacgaggaaauuuuuacaaucuuccagauucucuccuaugugagacagagcaucaugcauaaugauaucggcaacaagucuuccauucuggcuaucgagaaauacccggcccgguuugugggguuccuuagcgaccugcucaagaccaaaacgaaugaugucaacagaauguucauugacaauaacucucagaccaauuuuuggguucuguucagcaucuuuggacugcaagaucacacauccggcgcggacaagauuugccgcaacuucuaugauuuugugaucaaggccgacucuaaaaaucucggguucagccugaagaaaauccgggaacuuaugcuggaucuccccaacgcuaauaugcugagagaccaucaguuugauaccgugcgcuccaaguucuacacacuucuggacuuuauuaucuaccagcacuaucucgaggagaaaagccggauugacaacauggucgagaagcugagaaugacccugaaagaggaagagaaggaagugcucuacgccgcugaggccaagaucguuuggaaugccauuggagcuaaagugaucaacaagcuggucccuaugaugaacggcgaugcgcuuaaagaaauuaagcgcaaaaaucgggacagaaagcugccccagucugugaucgccacgguucaagugaacuccgaugcuaaugucuucagcgggcucaucuauuuucugacacuuuuccuggacggaaaggagauuaacgagauggugucuaaucucaucaccaaauuugaaaacauugauucccugcugcacgucgaccgcgagaucuacaagagcgaugaaaaagaccucgaucuggagauugagaaacuugcccuguucuucaaaggcgugguucggccuaaugccaagacagacaccggcgcuggggaaaucuccaagucuuuuagcaucuuccaguccgccgagagaauuaucgaagaacucaaauuuauuaagaacgugacccgcauggauaaugaaaucuuccccucugagggagucuuucuggacgcggcuaacgugcugggcguuagaggggaugacuucgacuuuagcaaugaguucgugggagaugaccuucauuccgaugccaacaaaaagauuaucaauaaaaucaacggcacaaaggaagaccggaaucuccggaacuuuauuaucaacaaugucguuaagagccgcagauuccaguauauugcccggcacaugaacacgcauuacgugaaacaacuggcuaauaacgagacccugaauagauuugugcucaacaagaugggggaugccaaaaucauuaaucgcuauuacgaaucuaucuccggaaacacaccgaauaucgagguccggagccagauugacuaccuggugaagagacuucgcucuuucuccuuugaagaucugaacgacgugaaacagaaggucagaccuggcaccaaugagagcaucgagaaagaaaagaagaaagcucucgugggccugugucugacaauucaguaucuuguuuacaagaaccucgugaauaucaacgcccgguauaccacggcguucuacugccuggagcgcgauucuaaacugaagggguucggagucgacguguggagagauuuugaaagcuauacagcccucaccaaucacuucauuaaagagggcuaccugcccguucggaaggcugaaauccuucgcgccaaccugaagcaccucgacugugaggauggguuuaaauauuacagaaaccaagugacccaucugaaugcuauucgggucgccuacaaguauaucaacgagaucaaauccgugcacagcuacuucgcgcuguaucauuacauuaugcagcgccaccuuuaugacucucuccaggccaaggcuaaagacuccagcggauuuguuaucgaugcccugaagaaguccuucgaacauaaaauuuacucuaaggaccugcuccacgugcugcacagcccuuuuggcuauaauacagcuagauacaaaaaccuuuccaucgaggcccuguucgauaagaaugaaucucggcccgaggucaacccccucagcaccaaugacggguccggcccuaaaaagaagcgcaaaguggccgcugcguacccguaugaugugcccgacuacgccuga

SEQ ID NO: 14381 - RNA, 2940 nt, Artificial Sequence
  Cas13d variant__Anaerobic digester metagenome 15706__NLS-dAdmCas13d-NLS-HA
augagccccaagaaaaagagaaaaguggaggccuccaacaauaagcggaaaaccaaggcuaaggccgcgggccugaaaucugucuucuuugaccagaagcaagcuguucucacaacguucgccaaagggaacaauagccagaucgaaaagaaaguggugaacuccgaggucaaggaucugcgccagccuccggccuuugaccuugaacugaaggagaaaaccuucuacauuucuggaaagaauaacaucaauacaagcagagaaaacccccucgcuuccgccucucugccucuuagcaaacggcagcgcauuagagcugagcggaucaagcgcgccagagaggaaaaucggcccuaucacaacgugaaacgcguuggcgaggaugaccugagagcgaaggccgaucucgaaaaacauuacuuugggaaggaguauuccgacaaucugaagauucaaaucaucuacaacauucuggauaucaauaaaauuaucagcccuuauauuaacgacaucguguacucuaugaauaaccucgcucggaacgaugaguauauugacggaaagaucgaugucaucggcucccugagcucuaccacagacuacuccagcuucaugucucccaauaaagaucuugaaaaggagaaaaaguuuuccuuccaccgcgaaaacuacaagaaauuuguggaggccagcaagccuuauaugagauacuaugggaaaguuuucauucgggacgugaagaaauccaagcugucuaccggaaagggcgaaaagaucgaggucauguaccgcagcgacgaggaaauuuuuacaaucuuccagauucucuccuauguggcucagagcaucauggccaaugauaucggcaacaagucuuccauucuggcgaucgagaaauacccggccagauuugugggguuccuuagcgaccugcucaagaccaaaacgaaugaugucaaccggauguucauugacaauaacucucagaccaauuuuuggguucuguucagcaucuuuggacugcaagaucauacauccggcgcugacaagauuugcagaaacuucuaugauuuugugaucaaggccgacucuaaaaaucucggguucagccugaagaaaauccgcgaacuuaugcuggaucuccccaacgcuaauaugcugcgggaccaccaguuugauaccgugagauccaaguucuacacacuucuggacuuuauuaucuaccagcauuaucucgaggagaaaagccgcauugacaacauggucgagaagcugcggaugacccugaaagaggaagagaaggaagugcucuacgccgccgaggcuaagaucguuuggaaugcgauuggagccaaagugaucaacaagcuggucccuaugaugaacggcgaugcucuuaaagaaauuaagagaaagaaucgcgaccggaagcugccccagucugugaucgccacgguucaagugaacuccgaugccaaugucuucagcgggcucaucuauuuucugacacuuuuccuggacggaaaggagauuaacgagauggugucuaaucucaucaccaaauuugaaaacauugauucccugcugcacgucgacagagagaucuacaagagcgaugaaaaagaccucgaucuggagauugagaaacuugcucuguucuucaaaggcgugguucgcccuaaugccaagacagacaccggcgcgggggaaaucuccaagucuuuuagcaucuuccaguccgcugagcggauuaucgaagaacucaaauuuauuaagaacgugaccagaauggauaaugaaaucuuccccucugagggagucuuucuggacgccgccaacgugcugggcguucgcggggaugacuucgacuuuagcaaugaguucgugggagaugaccuucacuccgaugcuaacaaaaagauuaucaauaaaaucaacggcacaaaggaagaccggaaucucagaaacuuuauuaucaacaaugucgugaaaagccggcgcuuccaguauauugccagacauaugaacacgcacuacgugaaacaacuggcuaauaacgagacccugaaucgguuuguucucaacaagaugggggaugccaaaaucauuaauagauauuacgaaucuaucuccggaaacacaccgaauaucgagguccgcagccagauugacuaccuggugaagcggcuuagaucuuucuccuuugaagaucugaacgacgugaaacagaagguccgcccuggcaccaaugagagcaucgagaaagaaaagaagaaagcgcucgugggccugugucugacaauucaguaucuuguuuacaagaaccucgugaauaucaacgccagauauaccacggcuuucuacugccuggagcgggauucuaaacugaagggguucggagucgacguguggcgcgauuuugaaagcuauacagcccucaccaaucauuucauuaaagagggcuaccugcccguuagaaaggcugaaauccuucgggccaaccugaagcaccucgacugugaggauggguuuaaauauuacgcgaaccaagugaccgcccugaaugcuauucgcgucgccuacaaguauaucaacgagaucaaauccgugcacagcuacuucgcucuguaucauuacauuaugcagagacaccuuuaugacucucuccaggccaaggccaaagacuccagcggauuuguuaucgaugcucugaagaaguccuucgaacauaaaauuuacucuaaggaccugcuccacgugcugcauagcccuuuuggcuauaauacagcgcgguacaaaaaccuuuccaucgaggcccuguucgauaagaaugaaucucgccccgaggucaacccccucagcaccaaugacggguccggcccuaaaaagaagagaaaaguggcugccgccuacccguaugaugugcccgacuacgcuuga

SEQ ID NO: 14382 - RNA, 2892 nt, Artificial Sequence
  Cas13d variant__Eubacterium siraeum DSM15702__EsCas13d-HA
augggcaagaaaauccacgccagagaccugcgggagcagcgcaagaccgauagaacagaaaaauucgcugaccaaaacaagaaacgggaggccgaacgcgcggugcccaagaaggaugcugccgucagcguuaaauccgugucuagcguguccucuaagaaagacaaugucacaaagagcauggccaaagcugccggggugaaguccguuuuugcugugggaaacaccgucuacaugacaucuuucggcagagggaaugaugccgugcucgagcagaagauuguugacaccagccaugaaccucugaacaucgaugacccggcguaucagcuuaauguggucacaaugaacggauacuccgugaccggccaccgcggggagacagugagcgccgucaccgauaauccccugcggagauuuaacggacggaaaaaggacgagccugaacagucuguucccacggauaugcucugccugaaaccuacccuugagaagaaauucuuuggcaaggaauuugacgauaauauucauauccaacugauuuauaacauccucgacaucgagaaaauucuggcuguguacuccacaaaugccaucuaugcucugaacaauaugagcgccgacgagaacauugaaaauucugauuucuucaugaagcgcaccacagacgagaccuuugaugacuucgaaaagaaaaaggaguccacgaacagcagagaaaaagcggauuuugacgccuucgagaaguuuaucggcaacuaccggcucgcuuauuucgccgaugcuuucuacgugaauaaaaagaaccccaaggggaaagccaagaauguccugcgcgaggacaaagaacuuuacucugugcugacacucauuggaaagcugagacacugguguguucauuccgaggaaggccgggccgaguuuuggcuuuauaaacuggaugaacucaaggacgauuucaagaacgugcuggacgucguguacaaucgcccuguugaggagaucaacaauagauuuauugaaaacaauaaagugaacauccagauccuggggagcgucuauaagaauaccgacauugcugagcucgugcgguccuacuaugaauuucugaucacgaaaaaguacaaaaacaugggauuuucuauuaagaaacuuagagagagcaugcuggaaggcaaaggguaugcggauaaggaguacgacuccguccgcaauaaacucuaccagaugaccgauuucauccuguauaccggauacauuaacgaggacagcgaucgggccgacgaucuugugaauacacugagaucuucccucaaggaagacgauaaaacgaccguuuauugcaaggaggcugacuaccuguggaaaaaguaucgcgaaagcauccgggagguggccgaugcccuggacggcgauaacaucaagaaacucucuaagagcaacauugagauccaggaagacaaacugagaaaguguuuuauuuccuacgcugacucugucagcgaguucacaaaacuuaucuaucugcucacccgcuuucuguccggcaaggaaauuaaugaucuugugacaacccugaucaacaaguucgacaauauccggagcuuucucgagauuauggaugaacuggggcuggacagaacguucacagccgaguacucuuucuucgagggauccaccaaauaccucgcggaacugguugagcuuaacagcuucgugaagucuugcuccuuugauaucaaugcuaaacgcaccauguaucgggacgcccuggauauucucggcaucgaaagcgacaagacagaggaagauauugagaaaaugaucgacaacauucugcaaaucgaugccaauggggacaagaagcugaaaaagaacaauggacuuagaaacuucaucgcuuccaaugucauugauucuaaccgcuuuaaauaccucgugcgguauggcaauccgaagaaaaucagagagaccgccaaguguaagcccgcugugcgguucguucugaacgaaauuccugacgcccagaucgagcgcuacuaugaagcgugcugucccaaaaauacagcccugugcagcgcuaacaagagacgggagaaacucgccgacaugauugcugaaaucaaguuugagaacuucuccgaugccgggaauuaccagaaagcgaacgucacgucuagaaccagcgaggccgaaaucaagcgcaaaaaucaggcuauuauccggcuguaucuuacagugauguacauuaugcugaagaaccucgugaaugucaacgccagauacgugaucgcuuuucacuguguugagcgcgacaccaagcuguaugccgaauccggacuggaggugggcaauauugagaaaaacaagacaaaucuuaccauggccgucaugggcgugaaacucgaaaacgggaucaucaagacggaguucgauaagagcuuugcugaaaaugcggccaacagauaccugcggaaugcucgcugguauaagcugauucucgacaaccugaagaaaucugagagagccguugugaaugaguuccggaacaccgucugccaccuuaacgccauccgcaauauuaacaucaauauuaaggaaaucaaagagguggaaaacuacuuugcucuguaucauuaccucauccaaaagcaccuggagaauagauucgccgauaaaaagguugaacgggacacaggagauuuuauuuccaagcuggaggaacauaaaaccuauuguaaggacuucgugaaagcguacugcacaccuuucggcuacaaccuuguccgcuauaagaaucucaccaucgaugggcuguuugacaaaaacuaccccggaaaggaugacagcgacgagcagaaguauccguacgaugugccugacuaugcuuga

SEQ ID NO: 14383 - RNA, 2892 nt, Artificial Sequence
  Cas13d variant__Eubacterium siraeum DSM15702__dEsCas13d-HA
augggcaagaaaauccacgccagagaccugcgggagcagcgcaagaccgauagaacagaaaaauucgcugaccaaaacaagaaacgggaggccgaacgcgcggugcccaagaaggaugcugccgucagcguuaaauccgugucuagcguguccucuaagaaagacaaugucacaaagagcauggccaaagcugccggggugaaguccguuuuugcugugggaaacaccgucuacaugacaucuuucggcagagggaaugaugccgugcucgagcagaagauuguugacaccagccaugaaccucugaacaucgaugacccggcguaucagcuuaauguggucacaaugaacggauacuccgugaccggccacagaggggagacagugagcgccgucaccgauaauccccugcgcagauuuaacggacggaaaaaggacgagccugaacagucuguucccacggauaugcucugccugaaaccuacccuugagaagaaauucuuuggcaaggaauuugacgauaauauucauauccaacugauuuauaacauccucgacaucgagaaaauucuggcuguguacuccacaaaugccaucuaugcucugaacaauaugagcgccgacgagaacauugaaaauucugauuucuucaugaagcgcaccacagacgagaccuuugaugacuucgaaaagaaaaaggaguccacgaacagcagagaaaaagcggauuuugacgccuucgagaaguuuaucggcaacuaccggcucgcuuauuucgccgaugcuuucuacgugaauaaaaagaaccccaaggggaaagccaagaauguccugcgcgaggacaaagaacuuuacucugugcugacacucauuggaaagcuggcccacugguguguugcuuccgaggaaggcagagcggaguuuuggcuuuauaaacuggaugaacucaaggacgauuucaagaacgugcuggacgucguguacaaucggccuguugaggagaucaacaaucgcuuuauugaaaacaauaaagugaacauccagauccuggggagcgucuauaagaauaccgacauugccgagcucgugagauccuacuaugaguuccugaucacgaaaaaguacaaaaacaugggauuuucuauuaagaaacuucgggaaagcaugcuggaaggcaaaggguaugcugauaaggaguacgacuccgucagaaauaaacucuaccagaugaccgauuucauccuguauaccggauacauuaacgaggacagcgaucgcgccgacgaucuugugaauacacugcggucuucccucaaggaagacgauaaaacgaccguuuauugcaaggaggccgacuaccuguggaaaaaguauagagaaagcauccgcgagguggcugaugcccuggacggcgauaacaucaagaaacucucuaagagcaacauugagauccaggaagacaaacugcggaaguguuuuauuuccuacgcggacucugucagcgaguucacaaaacuuaucuaucugcucaccagauuucuguccggcaaggaaauuaaugaucuugugacaacccugaucaacaaguucgacaauauccgcagcuuucucgagauuauggaugaacuggggcuggaccggacguucacagcugaguacagcuuuuucgagggauccaccaaauaccucgccgaacugguugagcuuaacagcuucgugaagucuugcuccuuugauaucaaugccaaaagaaccauguaucgcgacgcucuggauauucucggcaucgaaagcgacaagacagaggaagauauugagaaaaugaucgacaacauucugcaaaucgaugccaauggggacaagaagcugaaaaagaacaauggacuucggaacuucaucgcuuccaaugucauugauucuaacagauuuaaauaccucgugcgcuauggcaauccgaagaaaauccgggagaccgccaaguguaagcccgcggugagauucguucugaacgaaauuccugacgcccagaucgagcgguacuaugaggcuugcugucccaaaaauacagcccugugcagcgcuaacaagcgcagagaaaaacucgccgacaugauugcggaaaucaaguuugagaacuucuccgaugccgggaauuaccagaaagcuaacgucacgucucggaccagcgaggccgaaaucaagcggaaaaaucaggcuauuauccgccuguaucuuacagugauguacauuaugcugaagaaccucgugaaugucaacgcccgguacgugaucgccuuucauuguguugagagagacaccaagcuguaugcugaauccggacuggaggugggcaauauugagaaaaacaagacaaaucuuaccauggcggucaugggcgugaaacucgaaaacgggaucaucaagacggaguucgauaaaucuuuugccgaaaaugcugccaaccgcuaccugagaaaugcccggugguauaagcugauucucgacaaccugaagaaaucugagcgcgcuguugugaaugaguucgccaacaccgucugcgcgcuuaacgcuaucagaaauauuaacaucaauauuaaggaaaucaaagagguggaaaacuacuuugcccuguaucacuaccucauccaaaagcaccuggagaaucgguucgccgauaaaaagguugaacgcgacacaggagauuuuauuuccaagcuggaggaacauaaaaccuauuguaaggacuucgugaaggcuuacugcacaccuuucggcuacaaccuugucagauauaagaaucucaccaucgaugggcuguuugacaaaaacuaccccggaaaggaugacagcgacgagcagaaguauccguacgaugugccugacuaugccuga

SEQ ID NO: 14384 - RNA, 2964 nt, Artificial Sequence
  Cas13d variant__Eubacterium siraeum DSM15702__NLS-EsCas13d-NLS-HA
augagccccaagaaaaagagaaaaguggaggccuccggcaagaaaauccacgcucgggaccugcgcgaacagagaaagaccgaucggacagagaaguucgccgaccaaaacaaaaagcgcgaagcggagagagcugucccuaaaaaggaugccgccguuucugugaaaagcguguccucugucagcuccaagaaggacaaugugacgaaaucuauggcuaaggccgcugggguuaaaagcguguuugccgucggaaacaccguguacaugacauccuucggccgggggaaugaugcgguucucgaacagaagauuguggacaccagccaugagccgcugaacaucgaugaccccgccuaucagcuuaaugucgugacaaugaacggauacucugugaccggccaccgcggggagacagucuccgcuguuaccgauaauccucugagacgguuuaacggacgcaaaaaggacgaacccgagcagagcgugccuacggauaugcucugccugaaacccacccuugaaaagaaguucuuuggcaaagaguucgacgauaauauucauauccaacugauuuauaacauccucgacaucgagaagauucuggccguguacucuacaaaugcuaucuaugcccugaacaauauguccgcggacgaaaacauugagaauagcgauuucuucaugaaaagaaccacagacgaaaccuuugaugacuucgagaagaaaaaggaaucuacgaacucccgggagaaggccgauuuugacgcuuucgagaaauuuaucggcaacuaccgccucgccuauuucgcugaugccuucuacgucaauaagaaaaacccuaaggggaaagccaagaaugugcugagagaagacaaggagcuuuacagcguucugacacucauuggaaaacugcggcacuggugugugcauuccgaagagggccgcgcugaauuuuggcuuuauaagcuggaugagcucaaagacgauuucaagaacguccuggacgugguuuacaauagaccgguggaggaaaucaacaaucgguuuauugagaacaauaaagucaacauccagauccuggggucuguguauaagaauaccgacauugcggaacucgucagaagcuacuaugaguuccugaucacaaagaaauacaagaacaugggauuuuccauuaaaaagcugcgcgaaagcaugcuugagggcaaaggguaugccgauaaggaguacgacucugugcggaauaaacucuaccagaugaccgauuucauccuguauaccggauacauuaacgaagacuccgauagagcugacgaucuuguuaauacacugcgcagcucucucaaggaggacgauaagacgaccguguauugcaaagaagccgacuaccuguggaagaaauaucgggagagcaucagagaggucgccgaugcucuggacggcgauaacaucaagaaacucuccaagucuaacauugaaauccaggaggacaagcugcgcaaauguuuuauuagcuacgccgacuccgugagcgaauuuacaaaacuuaucuaucugcucacccgguuucugucuggcaaagagauuaaugaucuuguuacaacccugaucaacaaguucgacaauaucagauccuuucucgaaauuauggaugagcuggggcuggaccgcacguucacagcggaguacagcuuuuucgaaggaucuaccaaauaccucgcugagcugguggaacuuaacuccuucgucaagagcugcuccuuugauaucaaugccaagcggaccauguauagagacgcccuggauauucucggcaucgagucugacaaaacagaagaggauauugagaagaugaucgacaacauucugcaaaucgaugcuaauggggacaaaaagcugaaaaagaacaauggacuucgcaacuucaucgccagcaaugugauugauuccaaccgguuuaaguaccucgugagauauggcaaucccaaaaagauccgggaaaccgcuaaauguaagccugccguucgcuucguccugaacgagauucccgacgcgcagaucgaaagauacuaugaggccugcuguccuaaaaauacagcucugugcucugccaacaagcggagagaaaaacucgcugacaugauugccgagaucaaguuugagaacuucagcgaugcggggaauuaccagaaggccaacgugacgucccgcaccagcgaagcugagaucaaacggaagaaucaggccauuaucagacuguaucuuacagugauguacauuaugcugaaaaaccucgucaaugugaacgcucgcuacguuaucgccuuucacuguguggaaagagacaccaagcuguaugccgagucuggacuggaggucggcaauauugaaaagaacaagacaaaucuuaccauggcugugaugggcguuaagcucgagaacgggaucaucaaaacggaguucgauaaguccuuugcggagaaugccgcuaaccgguaccugcgcaaugccagaugguauaaacugauucucgacaaccugaagaaaagcgaacgggccguggucaaugaguuccgcaacaccgugugccaccuuaacgcuaucagaaauauuaacaucaauauuaaggagaucaaggaaguugagaacuacuuugcccuguaucauuaccucauccaaaaacaccuggaaaaucgguucgcggauaagaaaguggagcgcgacacaggagauuuuauuucuaagcuggaagaacauaaaaccuauuguaaggacuucgucaaggcuuacugcacacccuucggcuacaaccuugugagauauaaaaaucucaccaucgaugggcuguuugacaagaacuacccgggaaaagaugacuccgacgagcagaagggcagcgggccuaaaaagaagcggaaaguggccgccgcuuaucccuacgaugucccugacuaugccuga

SEQ ID NO: 14385 - RNA, 2964 nt, Artificial Sequence
  Cas13d variant__Eubacterium siraeum DSM15702__NLS-dEsCas13d-NLS-HA
augagccccaagaaaaagagaaaaguggaggccuccggcaagaaaauccacgcucgggaccugcgcgaacagagaaagaccgaucggacagagaaguucgccgaccaaaacaaaaagcgcgaagcggagagagcugucccuaaaaaggaugccgccguuucugugaaaagcguguccucugucagcuccaagaaggacaaugugacgaaaucuauggcuaaggccgcugggguuaaaagcguguuugccgucggaaacaccguguacaugacauccuucggccgggggaaugaugcgguucucgaacagaagauuguggacaccagccaugagccgcugaacaucgaugaccccgccuaucagcuuaaugucgugacaaugaacggauacucugugaccggccaccgcggggagacagucuccgcuguuaccgauaauccucugagacgguuuaacggacgcaaaaaggacgaacccgagcagagcgugccuacggauaugcucugccugaaacccacccuugaaaagaaguucuuuggcaaagaguucgacgauaauauucauauccaacugauuuauaacauccucgacaucgagaagauucuggccguguacucuacaaaugcuaucuaugcccugaacaauauguccgcggacgaaaacauugagaauagcgauuucuucaugaaaagaaccacagacgaaaccuuugaugacuucgagaagaaaaaggaaucuacgaacucccgggagaaggccgauuuugacgcuuucgagaaauuuaucggcaacuaccgccucgccuauuucgcugaugccuucuacgucaauaagaaaaacccuaaggggaaagccaagaaugugcugagagaagacaaggagcuuuacagcguucugacacucauuggaaaacuggcucacugguguguggcguccgaagagggccgggccgaauuuuggcuuuauaagcuggaugagcucaaagacgauuucaagaacguccuggacgugguuuacaaucgcccgguggaggaaaucaacaauagauuuauugagaacaauaaagucaacauccagauccuggggucuguguauaagaauaccgacauugcugaacucguccggagcuacuaugaguuccugaucacaaagaaauacaagaacaugggauuuuccauuaaaaagcugagagaaagcaugcuugagggcaaaggguaugccgauaaggaguacgacucugugcgcaauaaacucuaccagaugaccgauuucauccuguauaccggauacauuaacgaagacuccgaucgggccgacgaucuuguuaauacacugagaagcucucucaaggaggacgauaagacgaccguguauugcaaagaagcugacuaccuguggaagaaauaucgcgagagcauccgggaggucgccgaugcgcuggacggcgauaacaucaagaaacucuccaagucuaacauugaaauccaggaggacaagcugagaaaauguuuuauuagcuacgcugacuccgugagcgaauuuacaaaacuuaucuaucugcucacccgcuuucugucuggcaaagagauuaaugaucuuguuacaacccugaucaacaaguucgacaauauccgguccuuucucgaaauuauggaugagcuggggcuggacagaacguucacagccgaguacagcuuuuucgaaggaucuaccaaauaccucgccgagcugguggaacuuaacuccuucgucaagagcugcuccuuugauaucaaugcuaagcgcaccauguaucgggacgcccuggauauucucggcaucgagucugacaaaacagaagaggauauugagaagaugaucgacaacauucugcaaaucgaugcuaauggggacaaaaagcugaaaaagaacaauggacuuagaaacuucaucgccagcaaugugauugauuccaaccgcuuuaaguaccucgugcgguauggcaaucccaaaaagaucagagaaaccgcgaaauguaagccugccguucgguucguccugaacgagauucccgacgcucagaucgaacgcuacuaugaggccugcuguccuaaaaauacagcucugugcucugccaacaagagacgggaaaaacucgcggacaugauugccgagaucaaguuugagaacuucagcgaugcugggaauuaccagaaggccaacgugacguccagaaccagcgaagcugagaucaaacgcaagaaucaggccauuauccggcuguaucuuacagugauguacauuaugcugaaaaaccucgucaaugugaacgccagauacguuaucgcuuuucauuguguggaacgcgacaccaagcuguaugcggagucuggacuggaggucggcaauauugaaaagaacaagacaaaucuuaccauggccgugaugggcguuaagcucgagaacgggaucaucaaaacggaguucgauaaguccuuugcugagaaugccgccaacagauaccugcggaaugcucgcugguauaaacugauucucgacaaccugaagaaaagcgaaagagccguggucaaugaguucgcgaacaccgugugcgcucuuaacgccauccggaauauuaacaucaauauuaaggagaucaaggaaguugagaacuacuuugcccuguaucacuaccucauccaaaaacaccuggaaaaucgcuucgcugauaagaaaguggagagagacacaggagauuuuauuucuaagcuggaagaacauaaaaccuauuguaaggacuucgucaaggccuacugcacacccuucggcuacaaccuugugcgguauaaaaaucucaccaucgaugggcuguuugacaagaacuacccgggaaaagaugacuccgacgagcagaagggcagcgggccuaaaaagaagcgcaaaguggcggcugccuaucccuacgaugucccugacuaugccuga

SEQ ID NO: 14386 - RNA, 3402 nt, Artificial Sequence
  Cas13d variant__Eubacterium siraeum DSM15702__PspCas13b-NES(HIV)-3xHA
augaacauccccgcccugguggagaaucagaagaaauacuucggcaccuauagcgucauggcuaugcucaacgcccaaacaguucuggaccacauucagaagguggcggauaucgaaggggagcagaaugaaaacaaugagaaccuuugguuucauccugugaugucccaccuguacaaugcuaaaaacggauaugacaagcagccggagaaaacgauguucauuaucgagagacuccaaucuuacuuucccuuccugaagauuauggccgagaaucagcgggaauauagcaacggcaaguacaaacagaaucgcgucgaggugaacuccaaugauaucuuugaaguucuuaagagagccuucggggugcugaaaauguaucgggaccucaccaaccauuacaagacauacgaggagaaacugaaugauggaugcgaauuucugaccucuacagagcagccucucagcggcaugaucaacaacuauuacaccgucgcucugcgcaauaugaacgaaagauauggguacaagacagaggaccuugccuucauucaagauaagcgguuuaaauucgugaaggacgcuuauggaaagaagaaaucccagguuaauaccggcuuuuuccugucucuccaggauuacaacggcgacacgcagaagaaacugcaccuuagcggggugggaaucgcccugcucauuugucuguuucuggauaagcaauauaucaauauuuuccucucccgccugcccaucuucagcucuuacaacgcgcaguccgaagagagacggauuaucauccgcagcuuuggcauuaauucuaucaaacuuccuaaagaccggauucauuccgaaaagagcaacaaaucugucgccauggauaugcugaaugaagugaagagaugccccgacgaacucuucaccacacuguccgcugaaaaacagagccgcuuuagaaucauuuccgacgaucacaacgaggugcuuaugaagcggucuagcgaccgcuucgucccucugcuccugcaauacaucgauuaugggaagcuguuugaccacaucagauuccauguuaauaugggaaaacuccgguaccugcuuaaggccgauaaaaccuguauugacggccagacaagagugcgcgugaucgaacagccgcugaacggguuuggacggcucgaggaggcugaaaccaugagaaagcaggagaauggcacguucggcaacuccgggauucgcauccgggauuuugaaaauaugaaaagagacgaugccaaccccgcgaacuauccuuacauugucgacacauauacccacuacauccuggagaauaacaagguggaaauguucaucaaugauaaggaggacagcgcuccccuucugccuguuauugaggacgaucgcuauguggucaaaacaauccccucuugccggauguccacccucgaaauuccggcuauggccuuucauauguuccuguuuggaagcaagaaaaccgagaagcugaucguggacguucacaacagauacaaacgccucuuccaagcuaugcagaaggaagaggugacagccgagaauauugccucuuucggcaucgcugaaagcgaucugccucagaagauucuugaccugaucuccgggaacgcgcacggaaaagaugucgacgccuuuauccggcucacgguggaugacaugcugaccgauacagagagacgcauuaagcgguucaaagacgauagaaagucuauccggagcgcugacaauaaaaugggcaagcgcggguuuaaacagauuuccaccggaaagcuggccgauuuccuugccaaggacaucguccucuuucaacccagcgugaacgacggcgaaaauaaaauuacaggccugaacuacagaaucaugcagucugcuaucgccguuuaugauuccggggacgauuacgaggcgaagcagcaguucaaacugauguuugaaaaggcucggcucauuggaaaaggcaccacggagccucaucccuuccuguauaagguguuugccagaagcauccccgccaaugcugucgaguucuacgaacgcuaucuuauugagcggaaguuuuaccugacagggcucucuaacgaaaucaaaaagggaaauagaguggacguuccuuucauucgcagagaucaaaacaaauggaagaccccggccaugaaaacccugggccggaucuauuccgaggaccugcccguggaacuuccucgccagauguuugauaaugagaucaagagccaccucaagucccugccccagauggaggggauugacuucaacaacgcuaaugucacauaccugaucgccgaauacaugaaaagagugcucgaugacgauuuccagaccuuuuaucaauggaaccggaauuaccgcuauauggacaugcugaagggcgaguacgauagaaaaggaucucuucagcauuguuucacaagcguggaggagcgggaaggccuguggaaggagcgcgcguccagaacggagcgguaucgcaaacaggccucuaacaagauuagaagcaaucggcaaaugagaaacgcuuccagcgaagagaucgaaaccauucucgacaagcgccugucuaauucccggaacgaguaccagaaaagcgagaagguuaucagacgcuaucggguccaggacgcccugcuuuuucuccuggcuaaaaagacacugaccgaacucgccgauuucgacggggagagauuuaaacugaaggaaaucaugccugaugcggagaaaggcauucuuucugaaaucaugcccauguccuucacauuugagaagggagggaagaaauacaccauuacgagcgagggaaugaagcugaaaaauuacggcgacuucuuugugcucgccucugauaagcgcaucgggaaccugcuggaacuugugggcagcgacauugucuccaaagaggauaucauggaagaguucaauaaguaugaccagugccggccggaaauuagcucuaucguguuuaaccucgagaagugggcuuucgauaccuacccugagcuguccgccagaguugaccgcgaagagaaaguggauuucaagagcauccugaaaauucuccugaauaacaagaauaucaacaaagaacaauccgacauucuucggaagaucagaaacgcuuuugaccacaauaacuaucccgauaagggagucguggagauuaaagcccugccugaaaucgccaugucuaucaagaaagccuucggcgaguacgcgauuaugaaggggagccuccagcugcccccucuggagcggcuuacacugggauccucuuaucccuacgacguuccggauuaugccuacccuuacgacgugcccgauuaugcuuaccccuaugacgucccugauuacgccuga

SEQ ID NO: 14387 - RNA, 2748 nt, Artificial Sequence
  Cas13d variant__Gut metagenome assembly P1E0-k21__P1E0Cas13d-HA
auggagagagaagugaagaaacccccuaagaaaagccuggccaaggcugccggccucaaauccaccuucgucaucucuccgcaggagaaggaacuggcgaugacagcuuuugggcggggaaacgacgcccuucugcaaaagcgcauuguugauggcguggugagagacgucgccggggagaaacagcaguuccaggugcaacggcaggaugaaagccgcuuuagacuccagaauagccggcuggcugaccgcacgguuaccgccgaugacccccuucacagagcugagacaccucggcgccagccccugggagccggcauggaucaacucagacggaaggcgauccuggagcagaaauacuucgggcgcaccuuugacgauaacauucauauccagcugauuuauaauauccucgacauccacaagaugcuggccgugccugcuaaccauauuguccacacacuuaaucugcucggaggcuacggcgaaaccgauuucguggggaugcugcccgccggacuuccuuaugacaaacugagaguugugaagaagaaaaacggcgauacagucgacaucaaggcugacauugccgcguacgccaaacggccgcagcucgcuuaucugggggccgcuuuuuacgaugugacccccggaaagucuaaacgcgacgccgccagaggccgggugaagagagagcaagaugucuaugcuauccugagccucaugucccugcuucgccaguucugcgcgcaugacucuguucggauuugggggcagaauacgaccgccgcucuguaccaccuccaagcccugccucaggauaugaaagaccuucuggaugacggauggagacgcgcccucggcggcgugaacgaucacuuucuggacacaaauaaggugaaccugcucacccuguucgaauacuauggggcugagacaaagcaggcccgggucgcgcuuacccaggauuuuuacagauucgugguucugaaagagcaaaagaauaugggauuuagccuccgccggcugagagaggagcuucugaaacuccccgacgcugccuaucugacgggccaggaauacgacuccgugcgccagaagcuguauaugcuccuggauuuccuucugugucggcucuacgcccaggagagagcugaccgcugcgaggaacuggucagcgcccugcggugugcucuuucugaugaggaaaaagacacaguguaucaagccgaggcggccgcucucuggcaggcccugggggauacccugagacggaagcuccugccucuucugaagggcaaaaagcuccaggacaaagauaagaaaaaguccgacgaacugggacugagccgcgauguucuugacgggguccucuucagacccgcucagcaaggaucucgggccaacgcggauuacuuuugcagacugaugcaucuguccacaugguucauggacggcaaggagaucaauacccuccugaccacacuuauuagcaaacuggaaaacaucgauucucuccgcuccgugcuggagagcaugggccuggccuacuccuuugugccggcuuaugccauguucgaccacucucgguacaucgcugggcagcuuagagucgugaauaacauugcccgcaugagaaagccugccaucggagcuaaacgggagauguaucgcgcggccguugugcuccugggcgucgacagccccgaagcugccgccgcuauuacggaugaccugcuccagaucgauccugagaccgggaaggugagaccccgguccgacagcgcccgcgauacaggacugagaaacuuuauugcgaauaacguuguggaaucucggcgcuucaccuaccuucugagauauaugacacccgagcaggcucggguccucgcccaaaaugaaaaacugaucgccuuugugcuguccaccgugccugacacgcagcuugagcgcuacuguagaacaugcggccgggaggauaucaccgggagaccggcucagauucgcuaucucaccgcccaaaucaugggcguucgguacgaauccuucacagacgucgagcagagaggacgcggcgauaaccccaagaaggaacgguacaaagcgcugauugggcuguaucucaccgugcuguaccuugcugugaagaauauggucaacuguaaugccagauaugugaucgccuuuuacugccgcgaccgggauacagcucuguaucagaaagagguuuguugguacgaccucgaggaagauaagaaaucuggaaagcagagacaaguggaggacuauacggcccugacccgcuacuucgucagccagggcuaccugaaccggcaugcuugcggguaucuuagauccaauaugaacggaauuucuaauagccugcucacagccuaccggaacgcgguggaccaccugaaugccaucccuccccucggcucccugugucgcgauaucgggagaguugacagcuauuuugcucuuuaccacuaugccgugcagcaguaccugaacggccgguauuaccgcaaaaccccuagagaacaagaacucuucgcugccauggcccagcaucggacauggugcucugaucuggucaaggcucugaauacccccuuuggauacaaccuugcgagauauaagaaccuguccauugacggccucuucgaucgcgaaggggaccacgugguucgggaggauggagagaaaccggccgaauacccuuaugacgugcccgauuacgcuuga

SEQ ID NO: 14388 - RNA, 2748 nt, Artificial Sequence
  Cas13d variant__Gut metagenome assembly P1E0-k21__dP1E0Cas13d-HA
auggagagagaagugaagaaacccccuaagaaaagccuggccaaggcugccggccucaaauccaccuucgucaucucuccgcaggagaaggaacuggcgaugacagcuuuugggcggggaaacgacgcccuucugcaaaagcgcauuguugauggcguggugagagacgucgccggggagaaacagcaguuccaggugcaacggcaggaugaaagccgcuuuagacuccagaauagccggcuggcugaccgcacgguuaccgccgaugacccccuucacagagcugagacaccucggcgccagccccugggagccggcauggaucaacucagacggaaggcgauccuggagcagaaauacuucgggcgcaccuuugacgauaacauucauauccagcugauuuauaauauccucgacauccacaagaugcuggccgugccugcuaaccauauuguccacacacuuaaucugcucggaggcuacggcgaaaccgauuucguggggaugcugcccgccggacuuccuuaugacaaacugagaguugugaagaagaaaaacggcgauacagucgacaucaaggcugacauugccgcguacgccaaacggccgcagcucgcuuaucugggggccgcuuuuuacgaugugacccccggaaagucuaaacgcgacgccgccagaggccgggugaagagagagcaagaugucuaugcuauccugagccucaugucccugcuugcgcaguucugcgccgcugacucuguucgcauuugggggcagaauacgaccgccgcccuguaccaucuccaagcucugccucaggauaugaaagaccuucuggaugacggauggcggagagcccucggcggcgugaacgaucacuuucuggacacaaauaaggugaaccugcucacccuguucgaauacuauggggcggagacaaagcaggcucgcgucgcccuuacccaggauuuuuaccgguucgugguucugaaagagcaaaagaauaugggauuuagccucagacgccugcgggaggagcuucugaaacuccccgacgccgcuuaucugacgggccaggaauacgacuccgugagacagaagcuguauaugcuccuggauuuccuucugugucgccucuacgcccaggagcgggcugacagaugcgaggaacuggucagcgcccugcgcugugcgcuuucugaugaggaaaaagacacaguguaucaagccgaggcugccgcucucuggcaggcccugggggauacccugcggagaaagcuccugccucuucugaagggcaaaaagcuccaggacaaagauaagaaaaaguccgacgaacugggacugagccgggauguucuugacgggguccucuuccgccccgcgcagcaaggaucuagagccaacgcugauuacuuuugccggcugaugcaccuguccacaugguucauggacggcaaggagaucaauacccuccugaccacacuuauuagcaaacuggaaaacaucgauucucucagauccgugcuggagagcaugggccuggccuacuccuuugugccggcuuaugccauguucgaccauucucgcuacaucgccgggcagcuucgggucgugaauaacauugcuagaaugcgcaagccugcgaucggagccaaaagagagauguaucgggcugccguugugcuccugggcgucgacagccccgaagccgcugccgcgauuacggaugaccugcuccagaucgauccugagaccgggaaggugcgccccagauccgacagcgcucgggauacaggacugcgcaacuuuauugccaauaacguuguggaaucuagacgguucaccuaccuucugcgcuauaugacacccgagcaggccagaguccucgcucaaaaugaaaaacugaucgccuuugugcuguccaccgugccugacacgcagcuugagcgguacugucgcacaugcggcagagaggauaucaccgggcggccggcgcagauuagauaucucaccgcucaaaucaugggcguucgcuacgaauccuucacagacgucgagcagcggggaagaggcgauaaccccaagaaggaacgcuacaaagcccugauugggcuguaucucaccgugcuguaccuugccgugaagaauauggucaacuguaaugcucgguaugugaucgccuuuuacugcagagaccgcgauacagcucuguaucagaaagagguuuguugguacgaccucgaggaagauaagaaaucuggaaagcagcggcaaguggaggacuauacggcccugaccagauacuucgucagccagggcuaccugaaccgccacgcgugcggguaucuucgguccaauaugaacggaauuucuaauagccugcucacagccuacgcuaacgccguggacgcucugaaugccaucccuccccucggcucccuguguagagauaucgggcggguugacagcuauuuugcccuuuaccauuaugcugugcagcaguaccugaacggccgcuauuacagaaaaaccccucgggaacaagaacucuucgcggccauggcucagcaccgcacauggugcucugaucuggucaaggcccugaauacccccuuuggauacaaccuugccagauauaagaaccuguccauugacggccucuucgaucgggaaggggaccacgugguuagagaggauggagagaaaccggcugaauacccuuaugacgugcccgauuacgccuga

SEQ ID NO: 14389 - RNA, 2820 nt, Artificial Sequence
  Cas13d variant__Gut metagenome assembly P1E0-k21__NLS-P1E0Cas13d-NLS-HA
augagccccaagaaaaagagaaaaguggaggccuccgaacgggaggucaagaaaccuccgaagaagucucuggcuaaagccgcgggccucaagagcaccuucguuaucucuccccaggaaaaagagcuggcuaugacagccuuugggcgcggaaacgacgcccuucugcaaaagagaauuguggauggcgugguccgggacguggcuggggaaaaacagcaguuccagguucaacgccaggaugaguccagauuucggcuccagaauagccgccuggccgacagaacggugaccgcugaugacccucuucaccgggccgagacaccccgcagacagccucugggagcgggcauggaucaacuccggcgcaaggccauccuggaacagaaguacuucgggagaaccuuugacgauaacauucauauccagcugauuuauaauauccucgacauccacaaaaugcuggcuguccccgccaaccauauugugcacacacuuaaucugcucggaggcuacggcgagaccgauuucguugggaugcugccugcuggacuuccguaugacaagcugcggguggucaaaaagaaaaacggcgauacaguggacaucaaggccgacauugcggccuacgcuaaacgcccccagcucgccuaucugggggcugccuuuuacgaugugaccccuggaaaguccaagagagacgccgcucggggcagagucaaacgcgaacaagauguuuaugcgauccugucucucaugagccugcuucggcaguucugcgcccaugacuccgugagaauuugggggcagaauacgaccgcugcccuguaccaccuccaagcccugccccaggauaugaaggaccuucuggaugacggauggcgccgggcucucggcggcgugaacgaucacuuucuggacacaaauaaagucaaccugcucacccuguucgaguacuauggggccgagacaaagcaggcgagaguggcucuuacccaggauuuuuaccgcuucguugugcugaaagaacaaaagaauaugggauuuagccuccggagacugcgcgaggaacuucugaagcucccugacgccgccuaucugacgggccaggaguacgacucuguccggcagaaacuguauaugcuccuggauuuccuucuguguagacucuacgcucaggaacgcgccgaccggugcgaggagcugguguccgcucugagaugugcccuuagcgaugaagagaaggacacaguuuaucaagcggaagccgcugcccucuggcaggcucugggggauacccugcggcgcaaacuccugccccuucugaagggcaaaaagcuccaggacaaggauaaaaagaaaucugacgagcugggacuguccagagaugugcuugacgggguccucuuccggccggcccagcaaggaagcagagcgaacgccgauuacuuuugccgccugaugcaucugucuacaugguucauggacggcaaggaaaucaauacccuccugaccacacuuauuuccaaacuggagaacaucgauagccuccgguccgugcuggagucuaugggccuggcuuacagcuuugucccugccuaugcuauguucgaccacuccagauacaucgccgggcagcuucgcgugguuaauaacauugccagaaugcggaagcccgcuaucggagcgaagcgcgaaauguauagagccgcugugguccuccugggcguggacagcccugaggccgccgcugccauuacggaugaccugcuccagaucgaucccgaaaccgggaaaguucggccccgcucugacuccgcgagagauacaggacugcggaacuuuauugcuaauaacguggucgagagccgcagauucaccuaccuucugcgguauaugacaccugaacaggcccgcgugcucgcccaaaaugagaagcugaucgcuuuugugcugucuaccguuccggacacgcagcuugagagauacugucggacaugcggcagagaagauaucaccgggcgccccgcccagauucgguaucucaccgcgcaaaucaugggcgucagauacgagagcuucacagacguggaacagcgcggacggggcgauaacccuaaaaaggagagauacaaagcucugauugggcuguaucucaccgugcuguaccuugccgucaagaauauggugaacuguaaugcccgcuauguuaucgcuuuuuacugccgggacagagauacagcccuguaucagaaagagguguguugguacgaccucgaagaggauaagaaguccggaaaacagcgccaagucgaagacuauacggcucugacccgguacuucgugucucagggcuaccugaacagacaugccugcggguaucuucggagcaauaugaacggaauuuccaauagccugcucacagcguaccgcaacgccguugaccaccugaaugcuauucccccucucggcucucuguguagagauaucgggcggguggacuccuauuuugcccuuuaccacuaugcuguccagcaguaccugaacggccgcuauuacagaaagacaccccgggagcaagaacucuucgccgccauggcucagcauagaaccuggugcagcgaucuggugaaagcgcugaauaccccguuuggauacaaccuugcccgcuauaagaaccugucuaucgacggccucuucgaucgggagggggaccacguugugagagaggauggagaaaaaccugcugagggcuccgggcccaagaagaaacgcaaggucgccgccgcuuacccuuaugacgugcccgauuacgccuga

SEQ ID NO: 14390 - RNA, 2820 nt, Artificial Sequence
  Cas13d variant__Gut metagenome assembly P1E0-k21__NLS-dP1E0Cas13d-NLS-HA
augagccccaagaaaaagagaaaaguggaggccuccgaacgggaggucaagaaaccuccgaagaagucucuggcuaaagccgcgggccucaagagcaccuucguuaucucuccccaggaaaaagagcuggcuaugacagccuuugggcgcggaaacgacgcccuucugcaaaagagaauuguggauggcgugguccgggacguggcuggggaaaaacagcaguuccagguucaacgccaggaugaguccagauuucggcuccagaauagccgccuggccgacagaacggugaccgcugaugacccucuucaccgggccgagacaccccgcagacagccucugggagcgggcauggaucaacuccggcgcaaggccauccuggaacagaaguacuucgggagaaccuuugacgauaacauucauauccagcugauuuauaauauccucgacauccacaaaaugcuggcuguccccgccaaccauauugugcacacacuuaaucugcucggaggcuacggcgagaccgauuucguugggaugcugccugcuggacuuccguaugacaagcugcggguggucaaaaagaaaaacggcgauacaguggacaucaaggccgacauugcggccuacgcuaaacgcccccagcucgccuaucugggggcugccuuuuacgaugugaccccuggaaaguccaagagagacgccgcucggggcagagucaaacgcgaacaagauguuuaugcgauccugucucucaugagccugcuugcccaguucugcgcugccgacuccgugcggauuugggggcagaauacgaccgccgcucuguaccaucuccaagcccugccccaggauaugaaggaccuucuggaugacggauggagacgcgcgcucggcggcgugaacgaucacuuucuggacacaaauaaagucaaccugcucacccuguucgaguacuauggggcugagacaaagcaggcccggguggcccuuacccaggauuuuuacagauucguugugcugaaagaacaaaagaauaugggauuuagccuccgccggcugagagaggaacuucugaagcucccugacgcugccuaucugacgggccaggaguacgacucuguccgccagaaacuguauaugcuccuggauuuccuucugugucggcucuacgcucaggaaagagccgaccgcugcgaggagcugguguccgcgcugcggugugcccuuagcgaugaagagaaggacacaguuuaucaagcugaagccgcugcccucuggcaggcgcugggggauacccugagacggaaacuccugccccuucugaagggcaaaaagcuccaggacaaggauaaaaagaaaucugacgagcugggacugucccgcgaugugcuugacgggguccucuucagaccggcccagcaaggaagccgggcuaacgccgauuacuuuugcagacugaugcaccugucuacaugguucauggacggcaaggaaaucaauacccuccugaccacacuuauuuccaaacuggagaacaucgauagccuccgcuccgugcuggagucuaugggccuggcuuacagcuuugucccugccuaugccauguucgaccauucccgguacaucgcugggcagcuuagagugguuaauaacauugcgcgcaugagaaagcccgccaucggagcuaagcgggaaauguaucgcgccgccgugguccuccugggcguggacagcccugaggcugccgcggcuauuacggaugaccugcuccagaucgaucccgaaaccgggaaaguuagaccccggucugacuccgcccgcgauacaggacugagaaacuuuauugccaauaacguggucgagagccggcgcuucaccuaccuucugagauauaugacaccugaacaggcucgggugcucgcccaaaaugagaagcugaucgcguuugugcugucuaccguuccggacacgcagcuugagcgcuacuguagaacaugcggccgggaagauaucaccgggagacccgcucagauucgcuaucucaccgcccaaaucaugggcguccgguacgagagcuucacagacguggaacagagaggacgcggcgauaacccuaaaaaggagcgguacaaagcccugauugggcuguaucucaccgugcuguaccuugcugucaagaauauggugaacuguaaugccagauauguuaucgcuuuuuacugccgcgaccgggauacagcccuguaucagaaagagguguguugguacgaccucgaagaggauaagaaguccggaaaacagagacaagucgaagacuauacggcgcugacccgcuacuucgugucucagggcuaccugaaccggcacgccugcggguaucuuagaagcaauaugaacggaauuuccaauagccugcucacagcuuacgccaacgcuguugacgcccugaaugccauucccccucucggcucucugugucgggauaucgggcgcguggacuccuauuuugcucuuuaccauuaugcgguccagcaguaccugaacggcagauauuaccggaagacaccccgcgagcaagaacucuucgccgcuauggcccagcacagaaccuggugcagcgaucuggugaaagcccugaauaccccguuuggauacaaccuugcucgguauaagaaccugucuaucgacggccucuucgauagagagggggaccacguugugcgcgaggauggagaaaaaccugccgagggcuccgggcccaagaagaaacggaaggucgcggcugccuacccuuaugacgugcccgauuacgccuga

SEQ ID NO: 14391 - RNA, 2862 nt, Artificial Sequence
  Cas13d variant__Ruminococcus albus __RaCas13d-HA
auggccaagaaaagcaagggcaugucccugagagagaaacgggaacucgagaagcagaaacgcauccaaaaggcugccgugaacucugucaaugacacccccgaaaagacagaggaagcgaacguugugagcgugaaugucagaacguccgcugagaacaaacacucuaagaaaagcgccgccaaggcucuggggcuuaaauccggacuggugauuggcgaugagcucuaccugaccucuuucgggcggggaaaugaagccaaacuugagaagaagaucagcggcgacacaguugaaaagcuggggauuggagcuuuugagguggccgagcgcgaugaauccacccucacacuggagagcggcagaaucaaagacaagaccgcgcggccuaaagauccgcgccauauuacagucgacacccagggcaaguucaaagaagauaugcuggggaucagaucugugcucgagaagaagaucuuuggaaaaacguucgacgauaacauucacguucagcuggccuauaauauccuugacguggaaaagauuauggcucaguacgucuccgauaucguguauaugcugcauaacaccgacaaaacagagcggaaugauaaccucaugggcuacaugagcauucgcaauaccuauaagacauuuugcgacaccucuaaccugcccgacgauacgaaacaaaagguggagaaucagaagagagaguucgacaaaaucauuaaguccgggcggcuuggauacuuuggcgaagccuucauggucaacagcggaaauucuacaaaacugcgcccugaaaaggagaucuaucacaucuuugcucucauggccucccugagacagagcuacuuccauggguacguuaaagauaccgacuaucagggcacaaccugggcguacacccuggaagauaagcucaagggccccucccacgaguuucgggagacaauugacaaaaucuucgaugaaggguuuucuaagauuagcaaagacuucggaaagaugaacaaagugaaccugcaaauccuugagcagaugauuggcgaacuguauggguccaucgagcgccagaaucucacgugugauuacuaugacuucauccagcugaagaagcacaaauaccuuggauuuagcauuaagagacugcgggaaaccaugcucgagacaaccccugccgagugcuauaaagcugaauguuacaacucugagagacaaaagcuguacaaacugaucgauuuccucauuuaugaccuguacuauaaucgcaagcccgcccggaucgaagagauuguggacaaacuuagagaguccgucaacgaugaagagaaggaaagcaucuacucuguggaggcuaaguauguuuacgaaagccuguccaaagugcucgacaagucucugaaaaauagcgucuccggcgagacaaucaaggaucuucagaaacgcuaugacgaugagaccgccaaccggauuugggacaucagccagcauucuauuuccgggaaugugaacugcuuuuguaagcugaucuacauuaugacgcucaugcuggauggaaaggaaaucaaugaccugcucacaacccugguuaacaaauucgauaauauugccagcuuuaucgacgugauggaugagcuuggccuggaacacucuuucaccgacaacuacaagauguuugcugauuccaaagcgaucugccucgaccugcaauucauuaauagcuuugccagaauguccaagaucgacgaugagaaaucuaagcgccagcuguuccgggacgcucuugucauucucgauaucggcaacaaggacgaaacauggauuaauaacuaucuggauagcgacaucuuuaaacuggauaaggaggggaacaaacucaagggagccagacaugacuuccgcaauuuuaucgccaacaaugugauuaaauccucucgguucaaguaccuggucaaguauagcuccgcugauggcaugaucaaacuuaagaccaacgagaaacugauuggguucgugcucgacaagcugccugaaacacagaucgauagauacuaugagagcuguggacuggacaaugccguuguggauaaaaagguccgcauugaaaaacuuucuggccucauccgggacaugaaguuugacgauuucuccggggugaagacgagcaacaaagcgggcgacaaugauaagcaggacaaagcuaaguaccaagccaucauuucucuguaucugaugguucucuaccagaucgugaaaaacaugauuuacgucaauuccagauaugugaucgccuuucacugccuggagcgggauuucggaauguacggcaaggacuuugggaaguauuaccagggaugucgcaaacuuaccgaucacuucauugaagagaaguauaugaaagagggcaagcuggggugcaacaaaaaggugggaagauaccucaagaauaacaucagcuguugcacagacggccugaucaauaccuaucggaaccagguugaucauuuugcugucgugagaaaaauugggaauuacgccgcuuacaucaagucuauuggcagcugguucgaacuguaucacuacgugauccaacgcauugucuuugacgaguaucgguucgcccuuaacaacacagaauccaauuacaaaaacagcaucauuaagcaucacaccuauugcaaagauauggugaaggcgcucaauacgccguuuggauacgaccugcccagauauaagaaccugucuaucggcgaccucuucgaucgcaauaacuaccugaauaaaaccaaggaguccaucgacgccaacagcuccauugauucucaguacccuuaugacguucccgauuacgcuuga

SEQ ID NO: 14392 - RNA, 2934 nt, Artificial Sequence
  Cas13d variant__Ruminococcus albus __NLS-RaCas13d-NLS-HA
augagccccaagaaaaagagaaaaguggaggccuccgcuaagaaaucuaagggcaugagccugcgggaaaagcgcgagcucgaaaaacagaagagaauccaaaaagccgcggucaacuccguuaaugacaccccugagaagacagaagaggcuaacguggugucugucaaugugcggacgagcgccgagaacaaacacuccaagaagucugccgcuaaagcccuggggcuuaagagcggacugguuauuggcgaugaacucuaccugaccuccuucgggcgcggaaaugaggcuaaacuugaaaagaaaaucagcggcgacacaguggagaagcuggggauuggagccuuugaggucgcggaaagagaugagucuacccucacacuggaauccggccggaucaaagacaagaccgcccgcccgaaggaucccagacauauuacaguggacacccagggcaaauucaaggaggauaugcuggggauccggagcguucucgaaaagaagaucuuuggaaaaacguucgacgauaacauucacgugcagcuggcuuauaauauccuugacgucgagaagauuauggcccaguacgugucugauaucguguauaugcugcauaacaccgacaagacagagcgcaaugauaaccucaugggcuacauguccauuagaaauaccuauaaaacauuuugcgacaccagcaaccugccugacgauacgaagcaaaaagucgaaaaucagaagcgggaguucgacaaaaucauuaagucugggcgccuuggauacuuuggcgaggcuuucaugguuaacuccgggaauagcacaaagcugagacccgaaaaagaaaucuaucacaucuuugcccucauggcgucccugcggcagucuuacuuccauggauacgugaaggauaccgacuaucagggcacaaccugggccuacacccuggaggauaaacucaagggcccuagccacgaguuucgcgaaacaauugacaaaaucuucgaugagggguuuuccaagauuagcaaggacuucggaaaaaugaacaaggugaaccugcaaauccuugaacagaugauuggcgagcuguaugggucuaucgaaagacagaaucucacgugugauuacuaugacuucauccagcugaaaaagcacaaauaccuuggauuuuccauuaagcggcugagagagaccaugcucgagacaacccccgcugaaugcuauaaagccgaguguuacaacagcgaacgccaaaagcuguacaagcugaucgauuuccucauuuaugaccuguacuauaaucggaaaccugcuagaaucgaggagauugucgacaaacuucgcgaaucugugaacgaugaggaaaaagagagcaucuacuccguugaagccaaguauguguacgagucucugagcaaaguccucgacaagucccugaagaauagcgugucuggcgagacaaucaaagaucuucagaagcgguaugacgaugaaaccgccaacagaauuugggacaucucccagcauagcauuucugggaauguuaacugcuuuuguaaacugaucuacauuaugacgcucaugcuggauggaaaggagaucaaugaccugcucacaacccuggugaacaaauucgauaauauugcuuccuuuaucgacgucauggaugaacuuggccuggagcacagcuucaccgacaacuacaagauguuugcggauuccaaggccaucugccucgaccugcaauucauuaauucuuuugcucgcaugagcaaaaucgacgaugaaaaguccaaacggcagcuguucagagacgcccuugugauucucgauaucggcaacaaggacgagacauggauuaauaacuaucuggauucugacaucuuuaaacuggauaaggaggggaacaagcucaaaggagcccgccaugacuuccggaauuuuaucgcuaacaaugucauuaagagcuccagauucaaauaccuggugaaguauagcucugccgauggcaugaucaaacuuaagaccaacgaaaaacugauuggguucguucucgacaagcugccggagacacagaucgaucgcuacuaugaauccuguggacuggacaaugcgguggucgauaagaaagugcggauugagaaacuuagcggccucaucagagacaugaaguuugacgauuucucugggguuaagacguccaacaaagcuggcgacaaugauaagcaggacaaggccaaauaccaagccaucauuagccuguaucugauggugcucuaccagaucgucaagaacaugauuuacguuaauucucgguaugugaucgcuuuucacugccuggaacgcgauuucggaauguacggcaaagacuuugggaaguauuaccagggauguagaaaacuuaccgaucacuucauugaggagaaguauaugaaggaaggcaaacuggggugcaacaagaaagugggacgguaccucaagaauaacaucagcuguugcacagacggccugaucaauaccuauagaaaccaggucgaucauuuugccguggugcgcaaaauugggaauuacgcugccuacaucaaguccauuggcagcugguucgagcuguaucacuacgucauccaacggauuguguuugacgaauauagauucgcgcuuaacaacacagagucuaauuacaagaacuccaucauuaaacaucacaccuauugcaaggauaugguuaaagcccucaauacgcccuuuggauacgaccugccucgcuauaagaaccugagcaucggcgaccucuucgauagaaauaacuaccugaauaaaaccaaggaguccaucgacgcuaacucuagcauugauucccaggggucuggacccaagaaaaagcggaaaguggccgcugccuacccuuaugacguccccgauuacgcguga

SEQ ID NO: 14393 - RNA, 2829 nt, Artificial Sequence
  Cas13d variant__Ruminococcus flavefaciens FD1__RffCas13d-HA
augaagaaaaagaugagccugagagagaaacgggaagccgagaagcaggcuaaaaaggccgcguacuccgcugccucuaagaacaccgacagcaaacccgccgaaaagaaagcugagacaccuaagccggccgaaaucauuuccgauaauucucgcaacaaaacggcugugaaggccgcgggccucaagagcaccaucauuuccggggacaaacuguauaugacaucuuucggaaagggcaaugccgcugucaucgagcaaaagauugauaucaacgacuacagcuuuuccgccaugaaggauacccccagccuugagguugacaaagcugaaucuaaggagaucuccuucagcucucaccauccuuuugugaaaaaugauaagcugacaaccuauaacccccucuacgggggaaaggacaauccugaaaaacccgugggcagagauaugcuggggcuuaaggacaaacuggaggagcgguauuucggaugcacauuuaacgauaaucuccacauucagaucauuuacaacauccuggacauugaaaagauccuggccguccauuccgcgaauauuaccacggcccucgaucacaugguggacgaggacgaugaaaaauaucugaacagcgacuacaucggcuacaugaauaccaucaacacauaugauguuuucauggacccuucuaaaaauuccagccuuuccccgaaggaucgcaaaaacauugacaacucuagagcuaaguuugagaaacugcucagcaccaagcggcugggcuacuucggguuugauuaugacgccaauggaaaagauaagaagaaaaacgaagagaucaagaaacgccuuuaccaucugacagcuuucgccggccagcucagacagugguccuuucacagcgccgggaauuauccccggaccuggcuguacaagcuggacucucucgauaaagaguaucuggacacgcuugaccacuacuucgauaagcgcuuuaacgacauuaaugaugacuucgugacaaagaacgcuaccaaucuguacauccucaaagaagucuucccugaggcgaacuuuaaggauauugccgaccuguauuacgauuucaucgugaucaaaucccauaagaauaugggauuuagcauuaaaaagcugagagaaaagaugcuugagugugacggcgcugaucggaucaaggaacaagacauggauucuguucgcagcaagcucuauaaacugauugacuucugcaucuuuaaguacuaucacgaguuccccgagcuguccgagaaaaacguggauauucucagagccgccgucucugacacaaagaaagacaaucuguacagcgaugaagcugcccggcuuugguccaucuuuaaggaaaaguuccugggguuuugugacaaaaucguggugugggucaccggagagcaugaaaaggauauuaccagcguuaucgacaaagaugcguaucgcaacagaucuaauguguccuacuucagcaagcucauguacgcuaugugcuuuuuccuggacggcaaagagauuaacgaucuucugacaacgcucaucaauaaguuugacaacauugccaaccagaucaagaccgccaaagagcugggcauuaauacagcuuucgugaagaacuaugauuucuuuaaucacucugaaaaauacgucgacgagcugaacaucgugaagaauaucgcccggaugaaaaagccuuccagcaacgcuaagaaagccauguaucacgaugcgcucaccauucuggggauccccgaagacauggaugagaaggcccuugacgaggaacuggaccucauucuggagaaaaagacagauccgguuaccggaaaaccucugaagggcaaaaauccccuuagaaacuucaucgcuaauaacgugauugaaaauucccgcuuuaucuaccucaucaaguucuguaacccugagaauguccggaagauugugaacaauacgaaaguuacagaauuugugcugaagagaauccccgacgcccagauugagcgcuauuacaaaucuugcaccgauagcgagaugaaucccccuaccgaaaagaaaaucacagagcuggcugggaagcucaaggacaugaacuucggaaauuuucggaacgucagacaguccgccaaagaaaauauggagaaggaacgcuucaaagcggugauuggccuguaucuuaccgucguguaccggguugugaagaaccuggucgaugugaacucuagauacaucauggccuuucauagccucgagcgcgacucccaacuguauaacguuagcguggauaaugacuaccuggcucuuacagauacgcucgucaaagagggggacaacucucgguccagauaucuggccggaaauaagcgccugcgggauugugugaagcaggacaucgacaacgcuaaaaagugguucgugagcgauaaauacaauucuauuaccaaguauagaaacaauguugcccaccucacagccguccggaacugcgcugaauuuaucggcgacauuaccaaaaucgauuccuacuucgcgcuguaucauuaccuuauucagcgccagcuggccaagggccucgaccacgagagaagcggguuugaucggaauuacccgcaauaugcuccccuguucaaguggcauacauacgugaaagacguggucaaggcccugaacgccccuuucggauauaacauccccagauuuaaaaaucuuucuaucgaugcucucuucgaccgcaacgaaauuaagaaaaaugauggcgagaaaaagagcgacgauuacccuuaugacgugcccgauuacgccuga

SEQ ID NO: 14394 - RNA, 2901 nt, Artificial Sequence
  Cas13d variant__Ruminococcus flavefaciens FD1__NLS-RffCas13d-NLS-HA
augagccccaagaaaaagagaaaaguggaagccuccaagaaaaagaugucucugcgggaaaagcgcgaggcugaaaaacaggccaagaaagcggcuuacagcgccgccuccaagaacaccgacucuaaaccugcugagaagaaggccgaaacaccgaaacccgcugagaucauuagcgauaauuccagaaacaagacggccgucaaagcggccggccucaagucuaccaucauuagcggggacaaacuguauaugacauccuucggaaagggcaaugcugccguuaucgagcagaaaauugauaucaacgacuacagcuuuucugcuaugaaggauaccccuucccuugaaguggacaaggccgagagcaaagaaaucucuuucuccagccaccaucccuuugugaagaaugauaaacugacaaccuauaacccucucuacgggggaaaggacaaucccgagaaaccugucggccgggauaugcuggggcuuaaggacaagcuggaggaacgcuauuucggaugcacauuuaacgauaaucuccacauucaaaucauuuacaacauccuggacauugagaaaauccuggcggugcauucugccaauauuaccacggcucucgaucacaugguugacgaagacgaugagaaguaucugaacuccgacuacaucggcuacaugaauaccaucaacacauaugauguguucauggacccgagcaaaaauuccucucuuagccccaaggaucggaaaaacauugacaacuccagagccaaguuugaaaagcugcucagcaccaaacgccugggcuacuucggguuugauuaugacgcuaauggaaaggauaaaaagaaaaacgaggagaucaagaagagacuuuaccaucugacagccuucgccggccagcuccggcaguggucuuuucacuccgcugggaauuauccucgcaccuggcuguacaaacuggacagccucgauaaggaauaucuggacacgcuugaccacuacuucgauaaaagauuuaacgacauuaaugaugacuucgucacaaagaacgcgaccaaucuguacauccucaaagagguguuccccgaagccaacuuuaaggauauugcugaccuguauuacgauuucaucguuaucaaaucucauaagaauaugggauuuagcauuaagaaacuucgggagaagaugcuggaaugugacggcgccgaucgcaucaaagagcaagacauggauuccgugagaucuaagcucuauaaacugauugacuucugcaucuuuaaguacuaucacgaguucccugaacugagcgagaagaacgucgauauucuccgggccgcuguguccgacaccaaaaaggacaaucuguacagcgaugaagccgcgcgccuuuggucuaucuuuaaagagaaguuccugggguuuugugacaaaaucguggucuggguuacaggagaacaugagaaggauauuaccuccgugaucgacaaggaugcuuauagaaaccggagcaaugugucuuacuucuccaaacucauguacgccaugugcuuuuuccuggacggcaaggagauuaacgaucuucugacaacgcucaucaauaaauuugacaacauugccaaccagaucaagaccgcuaaagaacugggcauuaauacagccuucgucaagaacuaugauuucuuuaaucacagcgagaaguacguggacgaacugaacaucguuaaaaauaucgcuagaaugaagaaacccuccucuaacgccaagaaagcgauguaucacgaugcccucaccauucuggggaucccggaggacauggaugagaaggcucuugacgaagaacuggaccucauucuggagaaaaagacagauccugugaccggaaagccccugaaaggcaagaauccucuucgcaacuucaucgccaauaacgucauugagaauagccgguuuaucuaccucaucaaauucuguaaccccgaaaaugugagaaagauuguuaacaauacgaaagugacagaguuuguccugaagcgcauccccgacgcucagauugagcgguauuacaaguccugcaccgauucugaaaugaacccuccgaccgagaaaaagaucacagaacuggccgggaaacucaaggacaugaacuucggaaauuuuagaaacgugcgccagagcgcgaaagagaauauggaaaaggagcgguucaaggccgucauuggccuguaucuuaccgugguuuacagaguggucaaaaaccugguggauguuaauucccgcuacaucauggcuuuucauagccucgagcgggacucucaacuguauaacguguccgucgauaaugacuaccuggcccuuacagauacgcucgugaaggaaggggacaacagcagaucucgcuaucuggcuggaaauaaacggcugagagauugugugaagcaggacaucgacaacgccaaaaagugguucguuuccgauaaguacaauagcauuaccaaauaucggaacaaugucgcccaccucacagcugugcgcaacugcgcggaguuuaucggcgacauuaccaagaucgauucuuacuucgcccuguaucauuaccuuauucagagacagcuggcuaaaggccucgaccacgaacggagcggguuugauagaaauuacccccaauaugccccucuguucaaguggcauacauacgugaaagacgucgugaaggcccugaacgcucccuucggauauaacaucccucgcuuuaagaaucuuuccaucgaugcccucuucgaccggaacgagauuaaaaagaaugauggcgagaaaaagagcgacgaugggucuggacccaaaaagaaaagaaagguugcggcugccuacccguaugacgugccugauuacgccuga

SEQ ID NO: 14395 - RNA, 2931 nt, Artificial Sequence
  Cas13d variant__Ruminococcus flavefaciens XPD3002__RfxCas13d-HA
augaucgagaagaaaaagagcuucgccaaaggcaugggggugaaguccacccuggucucuggaagcaaaguuuacaugacaacguuugcugaaggcuccgacgccagacucgagaagauuguggaaggggauucuauccggagcgugaacgagggagaagcguucuccgcugagauggccgacaagaaugccggcuauaaaauugggaacgcuaaguuuucucaccccaaaggauacgccgucguggcuaauaacccucuguauaccggcccgguucagcaagauaugcuuggccugaaggagacacucgaaaaacgcuacuucggggagagcgccgacggaaaugauaacaucugcauucaggugauccauaauauccuggacauugaaaagauccuugcggaguauauuaccaacgccgcuuacgccgucaauaacaucuccggccuggauaaggacauuaucggguuuggaaaauucagcacaguguauaccuacgaugaguuuaaggaccccgaacaccauagagcugccuucaauaacaaugauaaacucauuaacgcgaucaaggcccaguacgacgaguuugauaauuuccuggacaacccucggcugggcuauuuugggcaggcuuucuuuucuaaagaaggacgcaacuacaucauuaauuauggcaacgaguguuacgacauccucgcccugcuuuccggccugagacacuggguugugcauaauaacgaagaggagagccggauuucucgcacauggcucuauaaucuggauaagaaccuugacaaugaauacaucuccacccugaacuaucucuacgauagaauuacgaaugagcugaccaacagcuucucuaaaaauuccgcugccaacgucaauuacaucgccgaaacacuggggaucaaccccgcugaguucgcggaacaauauuuucgguucagcauuaugaaggagcagaagaaucucggauuuaacaucaccaaacugcgcgaggugaugcuugacagaaaggauauguccgaaauucggaaaaaccacaagguguucgacucuauccgcacaaaagucuacaccaugauggauuuuguuauuuauagauacuauaucgaggaagacgccaagguggcugccgccaauaagagccugccugauaacgagaaaucccucagcgaaaaggacaucuucgugauuaaucugcggggcucuuuuaacgaugaccagaaagacgcucuuuacuaugaugaggccaaucgcaucuggagaaagcuggagaacauuaugcacaauaucaaagaguuccgggggaacaagacgagagaauacaagaaaaaggacgcgccccgccucccucggauucugccggcuggaagagaugucuccgccuuuagcaaacugauguacgcccucacaauguuccuggacggcaaggaaaucaaugaucuucugaccacacucauuaacaaauuugacaauauccagucuuuccugaaggugaugccccuuaucgggguuaacgcuaaguuuguggaggaguaugccuucuucaaagauagcgcuaagauugccgacgaacugcgccucaucaaauccuuugcgcggaugggagagccuauugccgaugcuagacgcgccauguacaucgacgcuauucggauccugggcaccaaucugucuuaugaugaacucaaggcccuggcggacaccuucagccuugaugagaacggcaauaaacugaagaaagggaagcauggaaugagaaacuuuaucauuaacaaugucaucuccaacaagcgcuuccacuaccucauucgguauggcgaccccgcccaucugcacgaaaucgcuaaaaaugaggccgugguuaaguuugugcuggggagaauugcugacauccagaaaaagcaaggacagaacggcaaaaaucagaucgaucgcuacuaugagacaugcauugggaaggacaagggcaaaagcgucucugaaaagguggaugcccuuacgaaaaucauuaccggaaugaacuacgaccaauucgauaagaaacgguccgucaucgaggacacaggcagagaaaaugccgagcgggaaaaguuuaagaaaauuaucagccucuaccugaccgugaucuaucacauucugaagaacaucguuaauauuaacgcucgcuacgugaucggguuccauugugucgagagagaugcgcagcucuauaaagagaagggauacgacauuaaucugaaaaagcuggaagagaagggcuuuucuuccgugacaaaacuuugcgccgggaucgaugaaaccgcuccugacaagcggaaagauguugagaaggaaauggccgagagagccaaagagagcauugacucccucgaaucugcuaaccccaagcuguaugccaauuacaucaaauauagcgaugagaagaaggcggaagaguucacgcgccagaucaaccgggagaaagcuaagacagcccugaaugccuaccuuagaaacaccaaauggaacgugauuauccgcgaagaccuccugagaauugacaauaagaccuguacacuguuucggaacaaagcuguccaccucgagguggcccgcuacgugcaugcguauaucaaugauauugcugaaguuaacuccuacuuccaacuguaucacuacaucaugcagagaaucauuaugaaugagcgguaugaaaagucuagcggaaaggucuccgaguacuuugacgccgugaacgaugagaaaaaguauaaugaccgccuucugaaacuccugugcgugccguucggcuacuguaucccuagauucaagaaccugagcauugaagcccuuuuugaucggaaugaggcugccaaauucgacaaggaaaagaaaaaggucucugggaacuccuaccccuaugaugugccugacuacgcuuga

SEQ ID NO: 14396 - RNA, 2931 nt, Artificial Sequence
  Cas13d variant__Ruminococcus flavefaciens XPD3002__dRfxCas13d-HA
augaucgagaagaaaaagagcuucgccaaaggcaugggggugaaguccacccuggucucuggaagcaaaguuuacaugacaacguuugcugaaggcuccgacgccagacucgagaagauuguggaaggggauucuauccggagcgugaacgagggagaagcguucuccgcugagauggccgacaagaaugccggcuauaaaauugggaacgcuaaguuuucucaccccaaaggauacgccgucguggcuaauaacccucuguauaccggcccgguucagcaagauaugcuuggccugaaggagacacucgaaaaacgcuacuucggggagagcgccgacggaaaugauaacaucugcauucaggugauccauaauauccuggacauugaaaagauccuugcggaguauauuaccaacgccgcuuacgccgucaauaacaucuccggccuggauaaggacauuaucggguuuggaaaauucagcacaguguauaccuacgaugaguuuaaggaccccgaacaccauagagcugccuucaauaacaaugauaaacucauuaacgcgaucaaggcccaguacgacgaguuugauaauuuccuggacaacccucggcugggcuauuuugggcaggcuuucuuuucuaaagaaggacgcaacuacaucauuaauuauggcaacgaguguuacgacauccucgcccugcuuuccggccuggcucacuggguuguggccaauaacgaagaggagagcagaauuucucggacauggcucuauaaucuggauaagaaccuugacaaugaauacaucuccacccugaacuaucucuacgaucgcauuacgaaugagcugaccaacagcuucucuaaaaauuccgccgcuaacgucaauuacaucgcggaaacacuggggaucaaccccgccgaguucgcugaacaauauuuuagauucagcauuaugaaggagcagaagaaucucggauuuaacaucaccaaacugcgggaggugaugcuugaccgcaaggauauguccgaaauucggaaaaaccauaagguguucgacucuaucagaacaaaagucuacaccaugauggauuuuguuauuuaucgcuacuauaucgaggaagacgccaagguggccgcugccaauaagagccugccugauaacgagaaaucccucagcgaaaaggacaucuucgugauuaaucugagaggcucuuuuaacgaugaccagaaagacgcgcuuuacuaugaugaggcuaaucggaucuggcgcaagcuggagaacauuaugcacaauaucaaagaguucagagggaacaagacgcgggaauacaagaaaaaggacgcccccagacucccucgcauucugccggccggacgggaugucuccgcuuuuagcaaacugauguacgcccucacaauguuccuggacggcaaggaaaucaaugaucuucugaccacacucauuaacaaauuugacaauauccagucuuuccugaaggugaugccccuuaucgggguuaacgcuaaguuuguggaggaguaugccuucuucaaagauagcgcgaagauugccgacgaacugagacucaucaaauccuuugcucgcaugggagagccuauugccgaugcucggagagccauguacaucgacgcgauucgcauccugggcaccaaucugucuuaugaugaacucaaggcccuggcugacaccuucagccuugaugagaacggcaauaaacugaagaaagggaagcacggaaugcggaacuuuaucauuaacaaugucaucuccaacaagagauuccauuaccucauucgcuauggcgaccccgcccaccuucaugaaaucgcuaaaaaugaggccgugguuaaguuugugcuggggcggauugccgacauccagaaaaagcaaggacagaacggcaaaaaucagaucgauagauacuaugagacaugcauugggaaggacaagggcaaaagcgucucugaaaagguggaugcucuuacgaaaaucauuaccggaaugaacuacgaccaauucgauaagaaacgcuccgucaucgaggacacaggccgggaaaaugcggagagagaaaaguuuaagaaaauuaucagccucuaccugaccgugaucuaucacauucugaagaacaucguuaauauuaacgcccgguacgugaucggguuccacugugucgagcgcgaugcucagcucuauaaagagaagggauacgacauuaaucugaaaaagcuggaagagaagggcuuuucuuccgugacaaaacugugcgccgggaucgaugaaaccgccccugacaagagaaaagauguugagaaggaaauggcugagcgggccaaagagagcauugacucccucgaaucugcgaaccccaagcuguaugcuaauuacaucaaauauagcgaugagaagaaggccgaagaguucacgagacagaucaaccgcgagaaagccaagacagcucugaaugccuaccuucggaacaccaaauggaacgugauuaucagagaagaccuccugcgcauugacaauaagaccuguacacuguuugcgaacaaagcugucgcccucgagguggccagauacgugcaugcuuauaucaaugauauugccgaaguuaacuccuacuuccaacuguaucacuacaucaugcagcggaucauuaugaaugagcgcuaugaaaagucuagcggaaaggucuccgaguacuuugacgcugugaacgaugagaaaaaguauaaugacagacuucugaaacuccugugcgugccguucggcuacuguaucccucgguucaagaaccugagcauugaagcccuuuuugaucgcaaugaggcggccaaauucgacaaggaaaagaaaaaggucucugggaacuccuaccccuaugaugugccugacuacgcuuga

SEQ ID NO: 14397 - RNA, 3003 nt, Artificial Sequence
  Cas13d variant__Ruminococcus flavefaciens XPD3002__NLS-RfxCas13d-NLS-HA (CasRx)
augagccccaagaaaaagagaaaaguggaggccuccaucgaaaagaaaaagucuuucgcuaagggcaugggggucaaaagcacccugguuuccggaucuaagguguacaugacaacguuugccgagggcagcgacgcgcggcucgagaaaauuguggaaggggauuccauccgcucugucaacgaaggagaggcuuucagcgccgagauggccgacaagaaugcuggcuauaaaauugggaacgccaaguuuucccacccuaagggauacgcugugguugccaauaacccgcuguauaccggccccgugcagcaagauaugcuuggccugaaagaaacacucgagaagagauacuucggggaaagcgcggacggaaaugauaacaucugcauucaggucauccauaauauccuggacauugagaaaauccuugccgaguauauuaccaacgcugccuacgcugugaauaacaucucuggccuggauaaggacauuaucggguuuggaaaauucuccacaguuuauaccuacgaugaauuuaaggacccugagcaccaucgggccgcguucaauaacaaugauaaacucauuaacgccaucaaggcucaguacgacgaauuugauaauuuccuggacaacccccgccugggcuauuuugggcaggccuucuuuagcaaggagggaagaaacuacaucauuaauuauggcaacgaauguuacgacauccucgcucugcuuucuggccugcggcacugggugguccauaauaacgaggaggaaucccgcauuagcagaacauggcucuauaaucuggauaaaaaccuugacaaugaguacaucucuacccugaacuaucucuacgaucggauuacgaaugaacugaccaacuccuucagcaaaaauuccgccgccaacgugaauuacaucgcugagacacuggggaucaacccugcggaguucgccgaacaauauuuucgcuucucuauuaugaaagagcagaagaaucucggauuuaacaucaccaaacugagagaagugaugcuugaccggaaggauaugagcgagauucgcaagaaccacaaagucuucgacuccaucagaacaaagguuuacaccaugauggauuuugugauuuaucgguacuauaucgaagaggacgcuaaaguggccgccgcuaauaagagccugcccgauaacgaaaaaucucucuccgagaaggacaucuucgucauuaaucugcgcggcagcuuuaacgaugaccagaaggacgcccuuuacuaugaugaggcgaauagaaucuggcggaaacuggaaaacauuaugcacaauaucaaggaguucagagggaacaaaacgcgcgaauacaagaaaaaggacgcuccucggcucccgcgcauucugcccgccggaagagaugugucugccuuuagcaagcugauguacgcucucacaauguuccuggacggcaaagagaucaaugaucuucugaccacacucauuaacaaguuugacaauauccaguccuuccugaaaguuaugccucuuaucggggugaacgccaaguuugucgaggaauaugcuuucuucaaagauucugccaagauugcggacgagcugcggcucaucaagagcuuugccagaaugggagaacccauugcugaugcccgccgggcuauguacaucgacgccauuagaauccugggcaccaaucuguccuaugaugagcucaaggcgcuggccgacaccuucagccuugaugaaaacggcaauaagcugaaaaaggggaaacauggaaugcgcaacuuuaucauuaacaaugugaucucuaacaagcgguuccacuaccucauuagauauggcgacccugcucaucugcacgagaucgccaaaaaugaggcuguugugaaguuuguccuggggcgcauugccgacauccaaaagaaacagggacagaacggcaagaaucagaucgaucgguacuaugaaacaugcauugggaaagacaagggcaaauccgugagcgagaaggucgaugcccuuacgaagaucauuaccggaaugaacuacgaccaauucgauaaaaagagaucugugaucgaagacacaggccgggagaaugcugaacgcgagaaauuuaagaaaauuaucucccucuaccugaccguuaucuaucacauucugaagaacaucgugaauauuaacgcgagauacgucaucggguuccauuguguggagcgggaugcccagcucuauaaggaaaaaggauacgacauuaaucugaagaaacuugaggaaaagggcuuuagcuccguuacaaaacugugcgcugggaucgaugagaccgcccccgacaagagaaaagauguggaaaaggagauggccgagcgcgcuaaggaaucuauugacagccucgaguccgccaacccgaaacuguaugcgaauuacaucaaguauucugaugagaaaaaggcugaagaguucacgcggcagaucaacagagaaaaagccaagacagcccugaaugcuuaccuucgcaacaccaaguggaacgucauuaucagagaggaccuccugcggauugacaauaaaaccuguacacuguuucgcaacaaggccgugcaccucgaaguggcgagauacguucaugcuuauaucaaugauauugccgaggucaacagcuacuuccaacuguaucacuacaucaugcagcggaucauuaugaaugaacgcuaugagaaauccagcggaaaggugucugaguacuuugacgccgugaacgaugagaaaaaguauaaugacagacuucugaagcuccugugcgucccuuucggcuacuguaucccccgguucaaaaaccuguccauugaagcucuuuuugaucgcaaugaagccgcuaaguucgacaaagagaagaaaaaggugagcgggaacucuggcuccggaccuaagaaaaagagaaaaguugccgcggccuaccccuaugaugugcccgacuacgcuuga

SEQ ID NO: 14398 - RNA, 3003 nt, Artificial Sequence
  Cas13d variant__Ruminococcus flavefaciens XPD3002__NLS-dRfxCas13d-NLS-HA (dCasRx)
augagccccaagaaaaagagaaaaguggaggccuccaucgaaaagaaaaagucuuucgcuaagggcaugggggucaaaagcacccugguuuccggaucuaagguguacaugacaacguuugccgagggcagcgacgcgcggcucgagaaaauuguggaaggggauuccauccgcucugucaacgaaggagaggcuuucagcgccgagauggccgacaagaaugcuggcuauaaaauugggaacgccaaguuuucccacccuaagggauacgcugugguugccaauaacccgcuguauaccggccccgugcagcaagauaugcuuggccugaaagaaacacucgagaagagauacuucggggaaagcgcggacggaaaugauaacaucugcauucaggucauccauaauauccuggacauugagaaaauccuugccgaguauauuaccaacgcugccuacgcugugaauaacaucucuggccuggauaaggacauuaucggguuuggaaaauucuccacaguuuauaccuacgaugaauuuaaggacccugagcaccaucgggccgcguucaauaacaaugauaaacucauuaacgccaucaaggcucaguacgacgaauuugauaauuuccuggacaacccccgccugggcuauuuugggcaggccuucuuuagcaaggagggaagaaacuacaucauuaauuauggcaacgaauguuacgacauccucgcucugcuuucuggccuggcccacuggguggucgccaauaacgaggaggaaucccggauuagccgcacauggcucuauaaucuggauaaaaaccuugacaaugaguacaucucuacccugaacuaucucuacgauagaauuacgaaugaacugaccaacuccuucagcaaaaauuccgcugcgaacgugaauuacaucgccgagacacuggggaucaacccugcugaguucgccgaacaauauuuucgguucucuauuaugaaagagcagaagaaucucggauuuaacaucaccaaacugcgcgaagugaugcuugacagaaaggauaugagcgagauucggaagaaccauaaagucuucgacuccauccgcacaaagguuuacaccaugauggauuuugugauuuauagauacuauaucgaagaggacgccaaaguggcugccgcgaauaagagccugcccgauaacgaaaaaucucucuccgagaaggacaucuucgucauuaaucugcggggcagcuuuaacgaugaccagaaggacgcucuuuacuaugaugaggccaaucgcaucuggagaaaacuggaaaacauuaugcacaauaucaaggaguuccgggggaacaaaacgagagaauacaagaaaaaggacgccccucgccucccgcggauucugcccgcuggaagagaugugucugccuuuagcaagcugauguacgcucucacaauguuccuggacggcaaagagaucaaugaucuucugaccacacucauuaacaaguuugacaauauccaguccuuccugaaaguuaugccucuuaucggggugaacgccaaguuugucgaggaauaugcguucuucaaagauucugccaagauugcugacgagcugcgccucaucaagagcuuugcccggaugggagaacccauugcugaugccagacgcgcgauguacaucgacgccauucggauccugggcaccaaucuguccuaugaugagcucaaggcucuggccgacaccuucagccuugaugaaaacggcaauaagcugaaaaaggggaaacacggaaugagaaacuuuaucauuaacaaugugaucucuaacaagcgcuuccauuaccucauucgguauggcgacccugcucaucugcacgagaucgccaaaaaugaggccguugugaaguuuguccuggggagaauugcugacauccaaaagaaacagggacagaacggcaagaaucagaucgaucgcuacuaugaaacaugcauugggaaagacaagggcaaauccgugagcgagaaggucgaugcgcuuacgaagaucauuaccggaaugaacuacgaccaauucgauaaaaagcggucugugaucgaagacacaggcagagagaaugccgaacgggagaaauuuaagaaaauuaucucccucuaccugaccguuaucuaucacauucugaagaacaucgugaauauuaacgcucgcuacgucaucggguuccacuguguggagagagaugcccagcucuauaaggaaaaaggauacgacauuaaucugaagaaacuugaggaaaagggcuuuagcuccguuacaaaacugugcgccgggaucgaugagaccgcucccgacaagcggaaagauguggaaaaggagauggccgagagagcgaaggaaucuauugacagccucgaguccgcuaacccgaaacuguaugccaauuacaucaaguauucugaugagaaaaaggccgaagaguucacgcgccagaucaaccgggaaaaagcuaagacagcccugaaugcguaccuuagaaacaccaaguggaacgucauuauccgcgaggaccuccugagaauugacaauaaaaccuguacacuguuugcuaacaaggccguggcccucgaaguggcucgguacguucaugccuauaucaaugauauugcugaggucaacagcuacuuccaacuguaucacuacaucaugcagcgcaucauuaugaaugaaagauaugagaaauccagcggaaaggugucugaguacuuugacgccgugaacgaugagaaaaaguauaaugaccggcuucugaagcuccugugcgucccuuucggcuacuguaucccccgcuucaaaaaccuguccauugaagcgcuuuuugauagaaaugaagccgcuaaguucgacaaagagaagaaaaaggugagcgggaacucuggcuccggaccuaagaaaaagcggaaaguugccgcugccuaccccuaugaugugcccgacuacgccuga

SEQ ID NO: 14399 - RNA, 3381 nt, Artificial Sequence
  Cas13d variant__Ruminococcus flavefaciens XPD3002__hnRNPa1-dCasRx-HA
augggcagaagcggguccggaaacuucggcgggggacggggcgggggauuuggcggcaaugacaacuucgggcgcggaggcaauuuuucugggagaggaggcuucgggggaagccggggcggcgggggauacggcggguccggagauggcuauaacggguuuggaaaugacggcucuaacuucggcgggggaggcagcuacaaugauuuugggaacuauaauaaccaguccucuaauuucggacccaugaagggcgggaacuuuggcggacgcagcuccggcccuuacgggggaggcgggcaauauuucgccaaaccgagaaaucagggaggcuacgggggcagcagcuccucuucuuccuauggaagcggccggcgcuuuucucccaagaaaaagagaaaaguggaggcuuccaucgaaaagaagaaauccuucgccaaggggaugggagucaaaagcacccugguuucuggcagcaagguguacaugacaacguuugcggagggguccgacgcucggcucgagaaaauuguggaaggagauagcauccgcucugucaacgaaggcgaggccuucuccgccgagauggcugacaagaaugccggguacaagauuggcaacgcuaaauucagccacccuaagggauaugccgugguugcgaacaauccccuguacaccggcccugugcagcaggauaugcuugggcugaaagaaacacucgagaagagauauuuuggagaaucugccgacggcaacgauaauaucugcauucaagucauccauaacauccuggacauugagaaaauccuugcugaguacauuaccaaugccgcuuaugccgugaacaauaucagcgggcuggauaaggacauuaucggauucggcaaauuuuccacaguuuacaccuaugaugaauuuaaggaccccgagcaccaucgggcggccuuuaacaauaacgacaagcucauuaaugcuaucaaagcccaguacgaugaguucgacaacuuucuggauaauccucgccugggguacuucggccaggcuuucuucucuaaggaaggaagaaacuauaucauuaauuacggcaacgaauguuaugacauccucgcccugcuuagcgggcuggcccacuggguggucgcuaacaaugaggaggaaucccggauuagccgcacauggcucuacaaccuggauaaaaaucuugacaacgaguauaucucuacccugaauuaccucuaugauagaauuacgaacgaacugaccaauuccuuuagcaagaacucugcggccaaugugaacuacaucgcugagacacugggaaucaauccggccgaguucgccgaacaguacuuucgguucuccauuaugaaagagcaaaagaaccucggcuucaauaucaccaagcugagagaagugaugcuugaccgcaaagauaugagcgagauucggaagaaccauaaagucuuugacuccaucagaacaaagguuuauaccaugauggauuucgugauuuaccgcuauuacaucgaagaggacgcuaaaguggccgcggcuaauaagucucugcccgacaacgaaaagagccucuccgagaaagauaucuuugucauuaaccugcgggggucuuucaaugacgaucagaaggacgcccuuuauuacgaugaggccaacagaaucuggcgcaaacuggaaaauauuaugcacaacaucaaggaguuucggggaaauaaaacgagagaauauaagaagaaagacgcuccucgccucccccggauucugccugccggcagagaugugagcgcuuucuccaagcugauguacgcccucacaauguuucuggacggcaaagagaucaacgaucuucugaccacacucauuaauaaguucgacaacauccagagcuuucugaaaguuaugccccuuaucggggugaaugcgaaguucgucgaggaauacgccuuuuucaaagauucugcuaagauugccgacgagcugcgccucaucaaguccuuugcucggaugggagaaccgauugccgaugcgagacgggccauguauaucgacgcuauucgcauccugggcaccaaccugagcuacgacgagcucaaagcccuggcugauaccuucucucuugacgaaaaugggaacaagcugaaaaagggaaaacacggcaugagaaauuucaucauuaacaaugugaucuccaacaagcgguuucauuaucucauuagauacggggauccugcccaucugcacgagaucgccaagaacgaggcuguugugaaauucguccugggacgcauugcggacauccagaagaaacaaggccagaauggcaagaaccagaucgaucgguauuacgaaacaugcauugggaaagacaagggaaagagcgugucugagaaagucgaugcccuuacgaagaucauuaccggcaugaauuaugaccaauuugauaaaaagagaagcgugaucgaagacacagggcgcgagaacgcugaaagagagaaauucaagaagauuaucucccucuaccugaccguuaucuaccacauucugaaaaauaucgugaacauuaaugcccgguaugucaucggauuucacuguguggagcgcgaugcccagcucuacaaggaaaaaggcuaugacauuaaccugaagaaacuugaggaaaagggguucagcucuguuacaaaacugugcgcuggaaucgaugagaccgcccccgacaagagaaaggacguggaaaaagagauggcggagcgggcuaaggaauccauugauagccucgaguccgccaauccuaaacuguacgccaacuauaucaaguacucugacgagaaaaaggcugaagaguuuacgcgccagaucaauagagaaaaggccaaaacagcgcugaacgcuuaucuucggaauaccaaguggaacgucauuauccgcgaggaucuccugagaauugacaauaaaaccuguacacuguucgccaacaaggccguggcucucgaaguggcccgguacguucaugcuuacaucaaugauauugccgaggucaacagcuauuuucagcuguaccacuauaucaugcaacgcaucauuaugaacgaaagauacgagaaauccucuggcaaggugagcgaguauuucgacgcggugaaugaugaaaagaaauacaacgaccggcuucugaagcuccugugcguccccuuuggcuauuguauccccagauucaaaaaucuguccauugaggcccuuuucgaucgcaacgaagcugccaaguuugacaaagagaagaagaaagugucugggaauagcggauccggcccuaagaaaaagcggaaaguugcugccgccuacccguacgaugugcccgacuaugcuuga

SEQ ID NO: 14400 - RNA, 2787 nt, Artificial Sequence
  Cas13d variant__Uncultured Ruminococcus sp. __UrCas13d-HA
auggccaagaaaaacaagaugaaacccagagagcugcgggaagcucagaagaaagcccgccaacucaaggcggcugagaucaauaacaaugccgccccugcuauugccgcuaugccggccgcggaagugaucgcccccgcugccgagaagaaaaagagcuccgucaaagcugccggcaugaagucuauucugguuagcgaaaacaaaauguacaucaccuccuucgggaagggaaauucugcggugcuugaguaugagguggacaacaaugauuacaaccagacacagcugagcuccaaggacaauucuaacauucagcucggcggggucaaugaagugaacaucacguuuagcuccaaacacggauucgagagcggcguugaaaucaauaccucuaacccuacacauagauccggggagagcucucccgugcggggagauaugcugggccuuaaguccgagcuggaaaaacgcuuuuucggcaagaccuuugacgauaauauucacauccaacucauuuauaacauccuggacauugagaaaauccuggccgucuacgugacaaacauuguuuaugcucucaauaacaugcugggggugaagggaagcgaaucucaugaugacuucaucggcuaccuuuccaccaauaacaucuaugaugucuuuauugacccugauaauagcucccugucugacgauaaaaaggccaacgugagaaagagccucuccaaauucaaugcucugcuuaagacaaaacggcugggguacuuuggacucgaggaacccaagaccaaagacaaccgcgugagccaggccuacaagaagagagucuaucacaugcuggccaucguuggccagauucggcagugcguguuccaugacaaaucuggggcuaagcgcuuugaucuguacuccuucaucaauaacauugacccugaguauagagauacgcucgacuaccugguggaggaacggcuuaaaagcaucaauaaggauuuuaucgaggacaacaaagucaauauuucucugcucaucgauaugaugaagggauaugaagcggacgauauuauccgccuguacuaugacuucauugugcuuaagagccaaaagaaccugggcuucuccaucaagaaacucagagagaagaugcuggaugaauacggcuuucgguucaaagacaagcaguacgacucuguucgcagcaagauguauaaacugauggauuuucuccuguucuguaauuacuauagaaacgacaucgccgcuggggagucccuugugcggaagcugagauuuagcaugaccgaugacgagaaagaaggaauuuacgccgaugaggccgcuaagcucuggggcaaauuccgcaacgacuuugaaaauaucgccgaucacaugaacggggacgucauuaaggagcugggaaaagcggauauggacuucgaugaaaagauccuugacucugagaagaaaaaugcuuccgaucugcucuauuuuagcaagaugauuuacaugcugacauauuuccuggacggcaaagagaucaacgaccuccugaccacacuuauuucuaaguuugauaauaucaaagaguuccugaagaucaugaaguccagcgccguggacguugaaugcgaacucaccgccggguacaaacuguuuaacgauucccagcggauuacgaaugagcuguucaucgugaagaacauugcuucuaugagaaaaccggccgcuagcgccaaacuuacaauguuccgcgacgcgcucaccauccugggaauugaugacaaaaucacagaugaccggaucuccggcauucugaagcucaaggagaaaggcaaggggauccacggacugagaaauuuuauuaccaacaaugucaucgaaucuagccgcuucguguaccuuauuaaauaugccaacgcucagaagauccgggaggucgccaaaaaugaaaaggugguuauguuugugcugggcgggauccccgauacccaaauugagagauacuauaaguccugugucgaguucccugacaugaacagcucucucggagugaaacgcuccgaacuggcucggaugaucaagaauauuagcuuugaugacuucaaaaacguuaagcagcaggccaaaggcagagagaacguggcgaaggaacgcgccaaagcugucaucgggcuguaccuuacagugauguaucuccuggugaagaaucugguuaacgucaaugcccgguacgugauugcuauccauugccucgagagagauuuuggccuguauaaggaaaucauucccgagcuugccucuaaaaaccugaagaaugacuaccggauccucucccaaacgcugugugaacugugcgacaaaagcccuaaccuuuuccucaagaaaaaugagcgccugagaaaguguguggaggucgauauuaacaaugccgacucuagcaugacccggaaguacagaaacugcaucgcucaccugacagugguucgcgaacucaaagaguauauuggagauaucuguaccguggacuccuacuuuagcauuuaucauuacgucaugcagcggugcaucacaaagagagaaaaugauaccaaacaggaggaaaagaucaaauaugaggacgaucugcuuaagaaccacggcuacacgaaggacuucgugaaagcgcucaauucucccuuuggguauaacauuccgcgcuucaagaaucuguccaucgagcagcuguuugauagaaacgaauaccugacagagaaauacccuuaugacguucccgauuacgccuga

SEQ ID NO: 14401 - RNA, 2787 nt, Artificial Sequence
  Cas13d variant__Uncultured Ruminococcus sp. __dUrCas13d-HA
auggccaagaaaaacaagaugaaacccagagagcugcgggaagcucagaagaaagcccgccaacucaaggcggcugagaucaauaacaaugccgccccugcuauugccgcuaugccggccgcggaagugaucgcccccgcugccgagaagaaaaagagcuccgucaaagcugccggcaugaagucuauucugguuagcgaaaacaaaauguacaucaccuccuucgggaagggaaauucugcggugcuugaguaugagguggacaacaaugauuacaaccagacacagcugagcuccaaggacaauucuaacauucagcucggcggggucaaugaagugaacaucacguuuagcuccaaacacggauucgagagcggcguugaaaucaauaccucuaacccuacacauagauccggggagagcucucccgugcggggagauaugcugggccuuaaguccgagcuggaaaaacgcuuuuucggcaagaccuuugacgauaauauucacauccaacucauuuauaacauccuggacauugagaaaauccuggccgucuacgugacaaacauuguuuaugcucucaauaacaugcugggggugaagggaagcgaaucucaugaugacuucaucggcuaccuuuccaccaauaacaucuaugaugucuuuauugacccugauaauagcucccugucugacgauaaaaaggccaacgugagaaagagccucuccaaauucaaugcucugcuuaagacaaaacggcugggguacuuuggacucgaggaacccaagaccaaagacaaccgcgugagccaggccuacaagaagagagucuaucacaugcuggccaucguuggccagauugcucagugcguguucgcggacaaaucuggggccaagcgguuugaucuguacuccuucaucaauaacauugacccugaguaucgcgauacgcucgacuaccugguggaggaaagacuuaaaagcaucaauaaggauuuuaucgaggacaacaaagucaauauuucucugcucaucgauaugaugaagggauaugaagcugacgauauuauccggcuguacuaugacuucauugugcuuaagagccaaaagaaccugggcuucuccaucaagaaacuccgcgagaagaugcuggaugaauacggcuuuagauucaaagacaagcaguacgacucuguucggagcaagauguauaaacugauggauuuucuccuguucuguaauuacuaucgcaacgacaucgccgccggggagucccuugugagaaagcugcgguuuagcaugaccgaugacgagaaagaaggaauuuacgcugaugaggccgcgaagcucuggggcaaauucagaaacgacuuugaaaauaucgcugaucauaugaacggggacgucauuaaggagcugggaaaagccgauauggacuucgaugaaaagauccuugacucugagaagaaaaaugccuccgaucugcucuauuuuagcaagaugauuuacaugcugacauauuuccuggacggcaaagagaucaacgaccuccugaccacacuuauuucuaaguuugauaauaucaaagaguuccugaagaucaugaaguccagcgcuguggacguugaaugcgaacucaccgccggguacaaacuguuuaacgauucccagcgcauuacgaaugagcuguucaucgugaagaacauugcuucuaugcggaaaccggccgcgagcgccaaacuuacaauguucagagacgcucucaccauccugggaauugaugacaaaaucacagaugaccgcaucuccggcauucugaagcucaaggagaaaggcaaggggauccacggacugcggaauuuuauuaccaacaaugucaucgaaucuagcagauucguguaccuuauuaaauaugccaacgcucagaagauccgcgaggucgccaaaaaugaaaaggugguuauguuugugcugggcgggauccccgauacccaaauugagcgguacuauaaguccugugucgaguucccugacaugaacagcucucucggagugaaaagauccgaacuggcgcgcaugaucaagaauauuagcuuugaugacuucaaaaacguuaagcagcaggccaaaggccgggagaacguggcuaaggaaagagccaaagcugucaucgggcuguaccuuacagugauguaucuccuggugaagaaucugguuaacgucaaugcccgcuacgugauugccauccacugccucgagcgggauuuuggccuguauaaggaaaucauucccgagcuugcuucuaaaaaccugaagaaugacuacagaauccucucccaaacgcugugugaacugugcgacaaaagcccuaaccuuuuccucaagaaaaaugagcggcugcgcaaguguguggaggucgauauuaacaaugcggacucuagcaugaccagaaaguacgccaacugcaucgcugcccugacagugguucgggaacucaaagaguauauuggagauaucuguaccguggacuccuacuuuagcauuuaucauuacgucaugcagagaugcaucacaaagcgcgaaaaugauaccaaacaggaggaaaagaucaaauaugaggacgaucugcuuaagaaccacggcuacacgaaggacuucgugaaagcccucaauucucccuuuggguauaacauuccgcgguucaagaaucuguccaucgagcagcuguuugauagaaacgaauaccugacagagaaauacccuuaugacguucccgauuacgcuuga

SEQ ID NO: 14402 - RNA, 2859 nt, Artificial Sequence
  Cas13d variant__Uncultured Ruminococcus sp. __NLS-UrCas13d-NLS-HA
augagccccaagaaaaagagaaaaguggaggccuccgcuaagaaaaacaagaugaagccucgggaacugcgcgaggcccagaaaaaggcgagacaacucaaagcugccgaaaucaauaacaaugccgcuccggccauugcugccaugcccgcggccgaggucaucgcuccugccgcugaaaagaaaaagucuagcguuaaggccgcgggcaugaaauccauucuggugucugagaacaagauguacaucaccagcuucgggaaaggaaauuccgccgugcuugaguaugaagucgacaacaaugauuacaaccagacacagcugucuagcaaggacaauuccaacauucagcucggcggggugaaugagguuaacaucacguuuagcucuaaacacggauucgaauccggcguggagaucaauaccagcaaccccacacaucggucuggggaguccagcccuguccgcggagauaugcugggccuuaagucugaacuggagaaaagauuuuucggcaagaccuuugacgauaauauucacauccaacucauuuauaacauccuggacauugaaaagauccuggcuguguacguuacaaacauuguguaugcccucaauaacaugcugggggucaaaggauccgagagccaugaugacuucaucggcuaccuuuccaccaauaacaucuaugauguguuuauugaccccgauaauucuagccuguccgacgauaagaaagcuaacgugcggaaaagccucucuaaauucaaugcccugcuuaagacaaagcgccugggguacuuuggacucgaagaaccuaaaaccaaggacaacagagucucccaggccuacaaaaagcggguuuaucacaugcuggcuaucgugggccagauucgccagugcguguuccaugacaaaagcggggcgaagagauuugaucuguacucuuucaucaauaacauugacccggaguaucgggauacgcucgacuaccuggucgaggagcgccuuaagagcaucaauaaagauuuuaucgaagacaacaaggugaauauuucccugcucaucgauaugaugaaaggauaugaggccgacgauauuaucagacuguacuaugacuucauuguucuuaagucucaaaagaaccugggcuucagcaucaagaagcuccgggagaaaaugcuggaugaauacggcuuucgcuucaaggacaaacaguacgacuccgugagaagcaagauguauaaacugauggauuuucuccuguucuguaauuacuaucggaacgacaucgcugccggggagucucuugucagaaagcugcgcuuuuccaugaccgaugacgaaaaagagggaauuuacgccgaugaagcugccaagcucuggggcaaguuccggaacgacuuugagaauaucgcggaucacaugaacggggacgugauuaaagaacugggaaaggcugauauggacuucgaugagaaaauccuugacagcgagaagaaaaaugccucugaucugcucuauuuuuccaagaugauuuacaugcugacauauuuccuggacggcaaggaaaucaacgaccuccugaccacacuuauuagcaaauuugauaauaucaaggaguuccugaaaaucaugaaguccucugccguugacguggaaugcgagcucaccgcuggguacaaacuguuuaacgauagccagagaauuacgaaugagcuguucaucgucaagaacauugccuccaugcgcaagcccgcugccucugcgaaacuuacaauguuccgggacgcccucaccauccugggaauugaugacaagaucacagaugacagaaucagcggcauucugaaacucaaggaaaaaggcaaggggauccacggacugcgcaauuuuauuaccaacaaugugaucgaguccagccgguucgucuaccuuauuaaguaugcuaacgcccagaaaaucagagaaguggcuaagaaugagaaaguugugauguuuguccugggcgggaucccugauacccaaauugaacgcuacuauaagucuuguguggaguuccccgacaugaacuccagccucggaguuaaacggucugagcuggccagaaugaucaagaauauuuccuuugaugacuucaaaaacgugaagcagcaggcgaagggccgcgaaaacgucgccaaagagcgggcuaaggccgugaucgggcuguaccuuacagugauguaucuccugguuaaaaaucuggucaacgugaaugcuagauacgugauugccauccauugccucgaacgggauuuuggccuguauaaggagaucauuccugaacuugccagcaaaaaccugaagaaugacuaccgcauccucucucaaacgcugugugagcugugcgacaagagccccaaccuuuuccucaaaaagaaugagagacugcggaaaugugucgaaguggauauuaacaaugcugacuccagcaugaccagaaaguaccgcaacugcaucgcgcaccugacaguugugcgggagcucaaagaauauauuggagauaucuguaccgucgacucuuacuuuuccauuuaucauuacgugaugcagagaugcaucacaaagcgcgagaaugauaccaagcaggaagagaaaaucaaguaugaggacgaucugcuuaaaaaccacggcuacacgaaggacuucguuaaagcccugaauagcccguuuggguauaacauuccuagauucaagaaucucuccaucgaacagcuguuugaucggaacgaguaccugacagaaaagggaucuggccccaaaaagaaacgcaagguggcugccgccuacccuuaugacguccccgauuacgcuuga

SEQ ID NO: 14403 - RNA, 2859 nt, Artificial Sequence
  Cas13d variant__Uncultured Ruminococcus sp. __NLS-dUrCas13d-NLS-HA
augagccccaagaaaaagagaaaaguggaggccuccgcuaagaaaaacaagaugaagccucgggaacugcgcgaggcccagaaaaaggcgagacaacucaaagcugccgaaaucaauaacaaugccgcuccggccauugcugccaugcccgcggccgaggucaucgcuccugccgcugaaaagaaaaagucuagcguuaaggccgcgggcaugaaauccauucuggugucugagaacaagauguacaucaccagcuucgggaaaggaaauuccgccgugcuugaguaugaagucgacaacaaugauuacaaccagacacagcugucuagcaaggacaauuccaacauucagcucggcggggugaaugagguuaacaucacguuuagcucuaaacacggauucgaauccggcguggagaucaauaccagcaaccccacacaucggucuggggaguccagcccuguccgcggagauaugcugggccuuaagucugaacuggagaaaagauuuuucggcaagaccuuugacgauaauauucacauccaacucauuuauaacauccuggacauugaaaagauccuggcuguguacguuacaaacauuguguaugcccucaauaacaugcugggggucaaaggauccgagagccaugaugacuucaucggcuaccuuuccaccaauaacaucuaugauguguuuauugaccccgauaauucuagccuguccgacgauaagaaagcuaacgugcggaaaagccucucuaaauucaaugcccugcuuaagacaaagcgccugggguacuuuggacucgaagaaccuaaaaccaaggacaacagagucucccaggccuacaaaaagcggguuuaucacaugcuggcuaucgugggccagauugcgcagugcguguucgccgacaaaagcggggcuaagcgcuuugaucuguacucuuucaucaauaacauugacccggaguauagagauacgcucgacuaccuggucgaggagcggcuuaagagcaucaauaaagauuuuaucgaagacaacaaggugaauauuucccugcucaucgauaugaugaaaggauaugaggccgacgauauuauccgccuguacuaugacuucauuguucuuaagucucaaaagaaccugggcuucagcaucaagaagcucagagagaaaaugcuggaugaauacggcuuucgguucaaggacaaacaguacgacuccgugcgcagcaagauguauaaacugauggauuuucuccuguucuguaauuacuauagaaacgacaucgccgcuggggagucucuuguccggaagcugagauuuuccaugaccgaugacgaaaaagagggaauuuacgccgaugaagcggcuaagcucuggggcaaguuccgcaacgacuuugagaauaucgccgaucauaugaacggggacgugauuaaagaacugggaaaggccgauauggacuucgaugagaaaauccuugacagcgagaagaaaaaugcuucugaucugcucuauuuuuccaagaugauuuacaugcugacauauuuccuggacggcaaggaaaucaacgaccuccugaccacacuuauuagcaaauuugauaauaucaaggaguuccugaaaaucaugaaguccucugccguugacguggaaugcgagcucaccgcuggguacaaacuguuuaacgauagccagcggauuacgaaugagcuguucaucgucaagaacauugccuccaugagaaagcccgcggccucugcuaaacuuacaauguuccgcgacgcccucaccauccugggaauugaugacaagaucacagaugaccggaucagcggcauucugaaacucaaggaaaaaggcaaggggauccacggacugagaaauuuuauuaccaacaaugugaucgaguccagccgcuucgucuaccuuauuaaguaugcuaacgcccagaaaauccgggaaguggcgaagaaugagaaaguugugauguuuguccugggcgggaucccugauacccaaauugaaagauacuauaagucuuguguggaguuccccgacaugaacuccagccucggaguuaaacgcucugagcuggcccggaugaucaagaauauuuccuuugaugacuucaaaaacgugaagcagcaggcuaagggcagagaaaacgucgccaaagagcgcgcuaaggccgugaucgggcuguaccuuacagugauguaucuccugguuaaaaaucuggucaacgugaaugcccgguacgugauugcuauccacugccucgaaagagauuuuggccuguauaaggagaucauuccugaacuugcgagcaaaaaccugaagaaugacuaccggauccucucucaaacgcugugugagcugugcgacaagagccccaaccuuuuccucaaaaagaaugagcgccugagaaaaugugucgaaguggauauuaacaaugccgacuccagcaugacccggaaguacgcuaacugcaucgccgcccugacaguugugagagagcucaaagaauauauuggagauaucuguaccgucgacucuuacuuuuccauuuaucauuacgugaugcagcgcugcaucacaaagcgggagaaugauaccaagcaggaagagaaaaucaaguaugaggacgaucugcuuaaaaaccacggcuacacgaaggacuucguuaaagcucugaauagcccguuuggguauaacauuccuagauucaagaaucucuccaucgaacagcuguuugaucgcaacgaguaccugacagaaaagggaucuggccccaaaaagaaaagaaagguggccgcggcuuacccuuaugacguccccgauuacgccuga

SEQ ID NO: 14404 - RNA, 4275 nt, Artificial Sequence
  Cas13d variant__Leptotrichia wadei __NLS-LwCas13a-msfGFP
augaagagacccgccgcuaccaaaaaggccggccaggcgaaaaagaaaaaggggagcaugaaggugacaaaagucgacggaaucucccacaagaaauacauugaggaaggcaagcugguuaaaucuacgagcgaggaaaaccggaccuccgagcgccucucugaacugcuuagcaucagacuggauauuuauaucaagaauccugacaacgcuuccgaggaggaaaaucggauucgcagagagaaccucaagaaauucuuuucuaauaaggugcugcaucuuaaagauagcgugcuguaccucaagaaccggaaagaaaagaaugccguccaagacaaaaacuauuccgaggaggauaucagcgaauacgaccugaagaauaagaacucuuucuccgugcugaaaaagauccuccugaaugaggauguuaacagcgaggaacuugaaauuuuucgcaaagacguggaggccaagcugaauaaaaucaacucucucaaguauuccuucgaggaaaauaaggcuaacuaccagaaaauuaacgagaauaacgucgaaaagguugggggaaaaagcaagagaaauaucauuuaugauuacuaccgggagucugccaaacgcaacgacuauaucaauaacgugcaggaggcuuuugauaagcuguacaagaaagaagacauugagaaacuuuucuuucugaucgaaaauuccaaaaagcacgagaaauauaagaucagagaauacuaucauaagauuaucggccggaaaaacgauaaggagaauuucgccaaaauuaucuacgaagagauucagaacgugaauaacaucaaggagcucaucgaaaagauuccggacaugagcgagcugaagaaaucccaagucuuuuauaaguacuaccuggacaaggaggaacucaaugauaaaaacaucaaguaugcguucugccacuuuguggagauugaaaugucucagcugcuuaaaaauuacguguauaagcgccugagcaacaucuccaacgacaaaauuaagagaaucuucgaguaccagaaucucaagaaacugaucgaaaacaaacuucugaauaaacucgauacauauguccggaacugugggaaguacaauuauuaccugcagguuggagagauugccaccagcgacuuuaucgcucgcaacagacaaaaugaagccuuccugcggaacauuaucggcgugucuuccguggcuuacuucagccucagaaauauucuggagacagagaacgaaaauggcaucaccgggcgcaugcggggaaaaacagucaagaacaauaagggcgaggaaaaauaugugucuggggagguugauaagauuuacaacgaaaauaaacagaacgaggugaaggagaaccuuaaaauguuuuauagcuacgacuucaauauggauaacaagaaugaaaucgaggacuuuuucgccaacaucgaugaagcgauuuccucuaucagacauggaauuguccacuuuaaucuggagcucgaaggcaaggacaucuucgccuuuaaaaacauugcucccagcgagaucuccaagaaaauguuccagaaugagaucaacgaaaagaaacugaaacuuaaaauuuuuaagcagcugaauagcgccaacguguucaauuauuacgagaaggauguuaucauuaaauaucucaagaacaccaaauuuaauuucgugaacaagaauaucccuuuuguccccucuuucacgaaacuguacaacaagauugaagaccugcgcaacacccucaaguucuuuugguccgugccuaaagacaaggaggagaaagaugcucaaaucuaccugcuuaagaauaucuauuacggggaguuccugaacaaauuugucaagaauagcaagguguucuuuaaaauuacaaacgaaguuaucaagauuaauaaacagcggaaccagaagaccggacacuauaaauaccaaaaguucgaaaauaucgagaagacagugcccgucgaauaucucgccauuauccagucuagagagaugaucaacaaucaggacaaagaggaaaagaacaccuacauugauuuuauccagcaaauuuuccugaaaggcuuuaucgacuaucugaauaagaacaaucuuaaauacauugaguccaacaauaacaaugauaacaacgacaucuucagcaagauuaagaucaaaaaggauaauaaagaaaaguacgacaaaauccucaagaacuaugagaaacauaaucgcaacaaggaaauuccucacgagaucaaugaguuugugcgggaaauuaagcugggcaaaauccugaaguacacggagaaccucaauauguucuaucugauucuuaaacugcucaaccauaaggaacugacaaaucugaaagggucccuugagaaguaccagucugccaacaaggaagagaccuuuagcgaugagcucgaacugaucaaucugcucaaccuggacaauaacagaguuacagaggauuucgaacuugaggcuaaugagaucggaaaauuccuggacuuuaacgaaaacaagauuaaagaucgcaaggagcucaaaaaguucgacaccaauaagaucuauuuugacggcgaaaacauuaucaaacaccgggcguucuacaauauuaagaaauaugggaugcugaaccugcuugagaagaucgccgauaaagcuaaguacaagaucucccucaaagaacugaaggaguacucuaauaaaaagaacgagauugaaaagaauuauaccaugcagcagaaccugcacagaaaguacgcccgcccgaaaaaggacgagaaguuuaaugaugaagacuauaaagaguacgaaaaggccaucggaaacauucaaaaauauacacaucucaagaauaaaguggaguucaacgagcugaaucuucugcagggccuccugcugaagauccuucaccggcucgucggguacacgagcauuugggaaagagaucugcgguuucgccugaagggagaguuccccgaaaaccauuauaucgaggaaauuuuuaauuucgacaacuccaaaaacgugaaguacaaaagcggccagaucguggagaaguacaucaauuuuuauaaagagcucuacaaggauaacguugaaaagagaucuauuuauuccgacaaaaaggucaaaaagcugaaacaggagaagaaggaucuuuacauccggaauuauauugcucacuucaacuacaucccucaugccgaaauuagccugcucgaggugcuggagaaucugagaaaacuucugucuuaugaccgcaagcucaaaaacgcgaucaugaaguccaucguggauauucugaaagaauacggcuucgucgcuaccuuuaagaucggggccgacaaaaagauugagauccaaacacucgaaagcgagaagauugugcaccugaaaaaucuuaagaaaaagaaacugaugaccgaucggaacucugaggaacucugcgagcugguuaaggugauguucgaauacaaggcccuggagggaggcgggggaagcggcgggggcggauccggcgggggaggcagcgucucuaaaggggaggaacuuuuuacaggagugguucccauccugguggaacucgacggcgacgucaaugggcacaaguucuccgugagaggcgagggagagggcgaugcuaccaacgggaaacugacgcucaaguuuaucuguacaaccggaaaacugccuguucccuggccgacccuugugacaacccugacauauggcguccagugcuucagccgcuacccugaccauaugaagcagcacgacuuuuucaaguccgccaugcccgaaggguaugugcaggagagaacgauuucuuuuaaagaugauggaaccuacaagacacgggcugaagugaaauucgagggcgacacccucgucaaucgcaucgaacugaaggggauugauuuuaaagaggacggcaacauccugggacauaaacuugaguauaauuucaacagccacaauguuuacauuacagccgauaagcaaaagaacggcaucaaggcgaacuuuaagauuagacacaauguggaagacggguccgugcagcuggccgaucauuaucagcaaaacaccccuaucggagacggccccguccuccugcccgacaaucacuaccucucuacgcagagcaagcuguccaaagauccuaacgagaagcgggaccauauggugcuucuggaguucguuaccgcugccgggaucacacugggaauggaugaacucuacaaguga

SEQ ID NO: 14405 - RNA, 4275 nt, Artificial Sequence
  Cas13d variant__Leptotrichia wadei __NLS-dLwCas13a-msfGFP
augaagagacccgccgcuaccaaaaaggccggccaggcgaaaaagaaaaaggggagcaugaaggugacaaaagucgacggaaucucccacaagaaauacauugaggaaggcaagcugguuaaaucuacgagcgaggaaaaccggaccuccgagcgccucucugaacugcuuagcaucagacuggauauuuauaucaagaauccugacaacgcuuccgaggaggaaaaucggauucgcagagagaaccucaagaaauucuuuucuaauaaggugcugcaucuuaaagauagcgugcuguaccucaagaaccggaaagaaaagaaugccguccaagacaaaaacuauuccgaggaggauaucagcgaauacgaccugaagaauaagaacucuuucuccgugcugaaaaagauccuccugaaugaggauguuaacagcgaggaacuugaaauuuuucgcaaagacguggaggccaagcugaauaaaaucaacucucucaaguauuccuucgaggaaaauaaggcuaacuaccagaaaauuaacgagaauaacgucgaaaagguugggggaaaaagcaagagaaauaucauuuaugauuacuaccgggagucugccaaacgcaacgacuauaucaauaacgugcaggaggcuuuugauaagcuguacaagaaagaagacauugagaaacuuuucuuucugaucgaaaauuccaaaaagcacgagaaauauaagaucagagaauacuaucauaagauuaucggccggaaaaacgauaaggagaauuucgccaaaauuaucuacgaagagauucagaacgugaauaacaucaaggagcucaucgaaaagauuccggacaugagcgagcugaagaaaucccaagucuuuuauaaguacuaccuggacaaggaggaacucaaugauaaaaacaucaaguaugcguucugccacuuuguggagauugaaaugucucagcugcuuaaaaauuacguguauaagcgccugagcaacaucuccaacgacaaaauuaagagaaucuucgaguaccagaaucucaagaaacugaucgaaaacaaacuucugaauaaacucgauacauauguccggaacugugggaaguacaauuauuaccugcagguuggagagauugccaccagcgacuuuaucgcucgcaacagacaaaaugaagccuuccugcggaacauuaucggcgugucuuccguggcuuacuucagccucagaaauauucuggagacagagaacgaaaauggcaucaccgggcgcaugcggggaaaaacagucaagaacaauaagggcgaggaaaaauaugugucuggggagguugauaagauuuacaacgaaaauaaacagaacgaggugaaggagaaccuuaaaauguuuuauagcuacgacuucaauauggauaacaagaaugaaaucgaggacuuuuucgccaacaucgaugaagcgauuuccucuaucgcccauggaauuguccacuuuaaucuggagcucgaaggcaaggacaucuucgcuuuuaaaaacauugcccccagcgagaucuccaagaaaauguuccagaaugagaucaacgaaaagaaacugaaacuuaaaauuuuuaagcagcugaauagcgcuaacguguucaauuauuacgagaaggauguuaucauuaaauaucucaagaacaccaaauuuaauuucgugaacaagaauaucccuuuuguccccucuuucacgaaacuguacaacaagauugaagaccugagaaacacccucaaguucuuuugguccgugccuaaagacaaggaggagaaagaugcccaaaucuaccugcuuaagaauaucuauuacggggaguuccugaacaaauuugucaagaauagcaagguguucuuuaaaauuacaaacgaaguuaucaagauuaauaaacagcgcaaccagaagaccggacacuauaaauaccaaaaguucgaaaauaucgagaagacagugcccgucgaauaucucgccauuauccagucucgggagaugaucaacaaucaggacaaagaggaaaagaacaccuacauugauuuuauccagcaaauuuuccugaaaggcuuuaucgacuaucugaauaagaacaaucuuaaauacauugaguccaacaauaacaaugauaacaacgacaucuucagcaagauuaagaucaaaaaggauaauaaagaaaaguacgacaaaauccucaagaacuaugagaaacauaauagaaacaaggaaauuccucacgagaucaaugaguuugugcgcgaaauuaagcugggcaaaauccugaaguacacggagaaccucaauauguucuaucugauucuuaaacugcucaaccauaaggaacugacaaaucugaaagggucccuugagaaguaccagucugcuaacaaggaagagaccuuuagcgaugagcucgaacugaucaaucugcucaaccuggacaauaaccggguuacagaggauuucgaacuugaggcgaaugagaucggaaaauuccuggacuuuaacgaaaacaagauuaaagauagaaaggagcucaaaaaguucgacaccaauaagaucuauuuugacggcgaaaacauuaucaaacaccgcgccuucuacaauauuaagaaauaugggaugcugaaccugcuugagaagaucgcugauaaagccaaguacaagaucucccucaaagaacugaaggaguacucuaauaaaaagaacgagauugaaaagaauuauaccaugcagcagaaccugcaccggaaguacgccagaccgaaaaaggacgagaaguuuaaugaugaagacuauaaagaguacgaaaaggcuaucggaaacauucaaaaauauacacaucucaagaauaaaguggaguucaacgagcugaaucuucugcagggccuccugcugaagauccuucaccgccucgucggguacacgagcauuugggaacgggaucugagauuucggcugaagggagaguuccccgaaaaccauuauaucgaggaaauuuuuaauuucgacaacuccaaaaacgugaaguacaaaagcggccagaucguggagaaguacaucaauuuuuauaaagagcucuacaaggauaacguugaaaagcgcucuauuuauuccgacaaaaaggucaaaaagcugaaacaggagaagaaggaucuuuacaucgccaauuauauugcgcacuucaacuacaucccucaugcugaaauuagccugcucgaggugcuggagaaucugagaaaacuucugucuuaugaccggaagcucaaaaacgccaucaugaaguccaucguggauauucugaaagaauacggcuucgucgccaccuuuaagaucggggcugacaaaaagauugagauccaaacacucgaaagcgagaagauugugcaccugaaaaaucuuaagaaaaagaaacugaugaccgauagaaacucugaggaacucugcgagcugguuaaggugauguucgaauacaaggcccuggagggaggcgggggaagcggcgggggcggauccggcgggggaggcagcgucucuaaaggggaggaacuuuuuacaggagugguucccauccugguggaacucgacggcgacgucaaugggcacaaguucuccgugcgcggcgagggagagggcgaugcuaccaacgggaaacugacgcucaaguuuaucuguacaaccggaaaacugccuguucccuggccgacccuugugacaacccugacauauggcguccagugcuucagccgguacccugaccauaugaagcagcacgacuuuuucaaguccgccaugcccgaaggguaugugcaggagagaacgauuucuuuuaaagaugauggaaccuacaagacacgcgcggaagugaaauucgagggcgacacccucgucaauagaaucgaacugaaggggauugauuuuaaagaggacggcaacauccugggacauaaacuugaguauaauuucaacagccacaauguuuacauuacagccgauaagcaaaagaacggcaucaaggcuaacuuuaagauucggcacaauguggaagacggguccgugcagcuggccgaucauuaucagcaaaacaccccuaucggagacggccccguccuccugcccgacaaucacuaccucucuacgcagagcaagcuguccaaagauccuaacgagaagcgcgaccauauggugcuucuggaguucguuaccgcugccgggaucacacugggaauggaugaacucuacaaguga

SEQ ID NO: 14406 - RNA, 2868 nt, Artificial Sequence
  Cas13d variant__Anaerobic digester metagenome 15706__AdmCas13d-HA
augaauaacaaacgcaaaacuaaagcaaaagcagcaggacuaaaaagcguguucuuugaucaaaaacaagcuguacucacaacauucgcaaaaggcaacaacucucaaauugaaaagaaaguaguaaacagcgaaguaaaagacuuaagacaaccaccagcauucgaccuagaauuaaaagaaaagacauucuauaucuccgguaaaaacaacauuaauacaucaagagaaaacccauuagcaagcgcaucauuaccauuaucaaaaagacaacgcauccgggccgaaagaauaaaacgagcaagagaagaaaaccguccauaccauaacguaaaacgaguaggagaagacgaucuccgagcaaaagcggaccuagaaaaacacuacuucggaaaagaauauucagauaacuuaaaaauacagauaaucuacaauauacuagacauaaacaaaaucauaucaccauauaucaacgauauagucuacucaaugaacaaucuagcaagaaacgacgaauauauagacggaaaaaucgacguaauaggaucuuuaucuuccacaacggacuacuccucauucaugucucccaauaaagaucuagaaaaagagaagaaauuuucauuccaccgagaaaacuacaaaaaguucguagaggcuuccaaaccauacaugagauauuauggcaaagucuucauacgagacguaaagaaaucaaaacuuuccacuggaaaaggagagaaaauagaagucauguacagauccgacgaagaaauauucaccauauuccaaauauuaucuuacguuagacagucaauaaugcauaacgacauaggaaacaaaucaucuauauuagcuaucgaaaaauacccagccagauuugugggauucuuaagugaccuacucaaaacaaaaacaaacgacgucaaccguauguucauagauaacaacucacaaacuaauuucugggugcuauucaguaucuucgguuuacaagaucauacaucaggagccgauaaaauuugcagaaauuuuuacgacuucguaauaaaagccgacagcaaaaaucuagguuucucacuaaagaaaauuagagaacucaugcuagacuuaccaaaugcuaacaugcuaagagaccaccaauuugacaccguaagaucaaaauucuauacacuauuagacuucauaauauaucaacacuaccuagaagaaaaaucucguauagacaacaugguagaaaaacuaagaaugacacuaaaagaagaagaaaaagaaguacucuaugcagcagaagcuaaaauaguauggaacgcuauuggagcuaaaguaaucaacaagcucguucccaugaugaacggagacgcacucaaagaaauaaaacggaaaaacagagaccgaaaacuuccccaauccguaauagcaacuguucaagucaauucugacgcaaacgucuuuuccggacuaauauauuucuuaacacuuuuccucgauggaaaagaaauuaacgaaauggucucuaaccucauaacaaaguucgaaaacauagacucccuacuccacgucgaccgagaaaucuauaaauccgacgaaaaagaccuugacuuagaaaucgaaaaacuagcacuauuuuucaaagguguaguaagaccgaacgcaaaaacagacacaggagcaggcgaaauaucaaaguccuuuucaauauuccaaucugccgaaagaauaauagaagaacucaaauucauuaaaaaugucacacggauggauaaugaaauauuuccaagugaaggaguauuccucgacgccgcaaacguauuaggaguaagaggagaugacuuugacuuuucaaacgaauuuguaggcgaugaccuacacuccgacgcaaauaagaaaauaauaaacaaaauaaacggcacaaaagaagacagaaaucuuagaaacuuuauaauaaauaauguaguaaaaucccgcagauuucaauacauagcaagacacaugaauacacacuaugucaaacaacuagcaaacaacgaaacucuuaacagauucgucuuaaacaaaaugggugaugcaaaaauaaucaacagauacuacgaaucaauaagcgguaauacaccaaacauagaaguacgcucccaaaucgacuauuuaguuaaacgccuacgaucauucucauuugaagaccuuaaugaugucaaacaaaaaguacgaccaggaaccaaugaaucuauagaaaaagaaaagaagaaagcccuugucggacucuguuuaacaauccaauauuuaguguauaaaaacuuaguaaacauaaaugcacgauauacuacagcguuuuacugucuugaacgagacucuaaauuaaaaggauucggaguugacguauggcgagacuucgaaaguuauaccgcauuaacuaaccacuuuauaaaagaaggcuacuuacccguaagaaaagcagaaaucuuacgagccaacuuaaaacacuuagacugugaagacggauuuaaauauuacagaaaucaagugacucaccuaaacgcaauaagaguugcuuacaaauacauuaaugaaauaaaaaguguacauucguacuucgcccuuuaccauuacauaaugcaacgacacuuauacgacuccuuacaagcaaaagcaaaagacucaucaggauucguaaucgacgcucucaagaaaaguuucgaacacaaaauauauagcaaagaccuccuacacguacuacauucaccuuuuggauauaacaccgcaagauauaaaaaccucucuauagaagccuuauuugauaaaaacgaaucuagaccugaagucaauccacuaaguacaaaugacuaccccuacgacguaccagacuaugccuga

SEQ ID NO: 14407 - RNA, 2868 nt, Artificial Sequence
  Cas13d variant__Anaerobic digester metagenome 15706__dAdmCas13d-HA
augaacaauaaacgaaaaacaaaggcuaaagcagcuggucuaaaaucuguauucuucgaccaaaaacaagcaguacucaccacguuugccaaaggaaacaauucacagaucgaaaaaaaaguuguaaauagcgaaguuaaagaccuccgacaaccaccugcguucgaccucgaacuaaaggaaaaaacuuucuacauaaguggaaaaaauaauaucaacacuuccagggaaaacccacuagcaagcgcaucauuaccauugucaaagagacaaagaauaagagcagaaagaauaaagagggcaagagaagagaacagaccauaucauaacguaaaaagaguuggagaagacgaucuaagagcaaaagccgaccucgaaaaacauuauuucggaaaagaauauucugacaauuuaaaaauacaaauaauauauaauauacucgauauaaauaaaauaauuagucccuacauaaacgacauuguauauagcaugaacaauuuagcccgcaaugacgaauauauagacggcaaaauagacguaaucggaucucuaaguucuacuacagacuauagcucauuuaugucuccaaacaaagaucuugagaaagaaaaaaaauucagcuuucacagagagaauuacaaaaaauucguagaagcaagcaaaccuuauaugagauacuacggcaaaguauuuauaagagacgucaaaaagaguaaacuauccaccgguaaaggugaaaaaauagaaguuauguacagaagugacgaagaaauauuuacaauauuccaaauucucucauauguugcacaaucaauaauggcaaacgacauaggaaacaaaucaucaauccuagcaauagaaaaauauccagcuagauucguaggauuuuuaucagacuuacuaaaaaccaagacaaaugacguaaacaggauguucauugacaauaauagucaaacuaacuuuuggguacucuucagcaucuuuggacuacaagaucacacaucaggcgccgauaaaauaugccguaauuuuuacgacuucguaauaaaagcagacuccaaaaaccuaggauuuucucugaaaaaaauaagagaacucauguuagaccucccuaacgcaaacauguuaagagaccaucaauuugauaccgucaggucgaaauuuuauacucuauuagacuucauaauuuaucaacauuaccuagaagaaaaaucccgaaucgauaacaugguagaaaaauuaagaaugacacugaaagaagaagaaaaggaaguauuauaugcagcagaagcgaaaauagucuggaacgcuaucggcgcaaaaguaauaaacaaauuagucccaaugaugaauggagaugccuuaaaagaaauaaaaagaaaaaacagagaucgaaaauuaccacaaagcgucauugcaacaguucaaguaaacucagacgcaaauguauucucaggacugaucuacuuccuaacauuauuccuagacggaaaagaaauaaacgaaauggucaguaaccuaauuacaaaauuugaaaacaucgacucauuguuacacguagacagagaaaucuacaagucagacgaaaaagaccuagaccuagaaauagaaaaacucgcacuauucuuuaaaggaguagucagaccaaaugcaaaaacugacacuggcgcgggagaaauaucaaaaucauuuuccauauuucaaucugcagaacgcauaauagaagaacuaaaauuuaucaaaaauguuacaagaauggacaaugaaaucuuuccaucagagggagucuucuuagacgcagcaaacguacuaggaguuagaggcgacgacuucgacuuuucuaaugaguucguaggcgacgaccuucacagcgacgcaaauaaaaaaauaauuaacaaaauaaauggaaccaaagaggauagaaacuuaagaaacuucaucauaaauaauguaguaaaaaguagaagauuccaauauaucgcccgacauaugaacacucacuacgucaaacaauuagcuaauaacgaaacauuaaauagauuuguacucaauaaaaugggcgacgcaaaaauuauaaacagauacuacgaaagcauaucagguaacacacccaacauugaggugcgaucacaaauagauuauuuagucaaacgacuaagaaguuuuagcuucgaagaccuaaaugacgucaaacaaaaaguccgaccagguacgaacgaauccauagaaaaagaaaaaaagaaagcccuaguuggacugugccugacaauacaauaccuagucuauaaaaacuuaguaaauaucaaugcaagauauacaacagcauuuuauugucucgaaagagauucaaaacuaaaaggauuuggcguagaugucuggagagauuucgaaucauacaccgcguuaacaaaccauuuuauaaaggaaggauaccuaccagucagaaaagccgaaauacuacgagccaaccugaaacauuuagacugcgaagacggauuuaaauacuaugcuaaccaagucacagcauuaaacgcaauaagaguugcauauaaauacaucaaugaaauaaaaucaguucacuccuacuucgcauuauaccauuacauaaugcaaagacaccuauacgauaguuuacaagcaaaagcuaaagacucauccggcuucguuaucgacgcauuaaaaaaaucauuugaacacaaaauuuauaguaaagaccuucuacacguacuccacagcccauucggauauaauacagcaagauauaaaaauuuaucaauagaagcauuauucgauaaaaacgaaagccgaccugaaguuaacccucuaucuacaaacgauuauccauacgauguaccugauuacgcauga

SEQ ID NO: 14408 - RNA, 2940 nt, Artificial Sequence
  Cas13d variant__Anaerobic digester metagenome 15706__NLS-AdmCas13d-NLS-HA
augagccccaaaaaaaaaagaaaaguagaagcaucuaacaacaaacgaaaaacaaaagccaaagcagcaggacucaaaucagucuucuuugaccaaaaacaggcaguuuuaacuacauucgcaaagggaaacaauucacaaauagaaaaaaaagucgucaacucagaaguaaaagacuuacgccaaccaccugccuucgaucuagaacuaaaagaaaaaacuuuuuauaucagcggaaaaaauaacaucaacacaagccgugaaaauccacuagcuagcgccucauuaccacugucaaaaagacaaaggauacgagccgaaagaauaaaacgagcacgagaagaaaaucgaccauaccacaacguaaaaagagucggcgaagaugaccucagagcaaaagcugaucuggagaaacacuacuucggcaaagaauauagcgauaaccuaaaaauucaaauuauauacaacauauuagauaucaacaaaauuauauccccauauauaaacgacauaguuuacucaaugaacaaccuagcgagaaacgaugaauauaucgacgguaaaauagauguaauaggaucucuuuccucaacaaccgauuacucaucauucaugucuccaaacaaagaccuagaaaaagaaaaaaaauucagcuuccauagagaaaacuacaaaaaauucguagaagcauccaaaccauauaugcgauacuacggaaaaguauucauaagagacgucaaaaaaaguaaauuaucaacuggaaaaggagaaaaaauagaaguaauguacagaagcgacgaagaaauuuuuacaaucuuccaaauuuuaaguuacguaagacaaucaauaaugcacaaugauauuggaaacaaaucaucgauacucgcuauagaaaaauauccagcaagauuuguaggauuucucucagaccuacuaaaaacaaaaacaaacgauguaaacagaauguucaucgacaacaacucccaaaccaauuuuuggguccuauuuagcaucuucggauuacaggaucacacuagcggagcagacaaaaucugccgaaauuucuacgacuucguaauaaaagcugauuccaaaaaccuaggauucuccuuaaaaaaaauacgagaacuaaugcuagaccuaccgaacgcaaauaugcuaagagaucaccaauucgacacaguaagaucaaaauucuacacccuauuagauuuuauaauauaccaacacuacuuggaagaaaaaucaagaaucgauaauaugguagaaaaacuccggaugacacuaaaagaagaagaaaaagaaguucuuuaugccgcagaagcaaagauaguauggaaugcaauaggcgcuaaaguaauuaauaaacuagucccaaugaugaacggagaugcauuaaaggaaauaaaaagaaaaaaccgcgacagaaaacuuccacagucaguuaucgcaacaguacagguaaacucagaugcaaauguauucucagggcuaaucuacuucuuaacucucuuucuagacggaaaagaaauaaacgaaaugguaucaaaucuaauaacaaaauuugaaaauaucgacaguuuacuccacguagauagagaaauauacaaauccgacgaaaaagacuuagaccuagaaauagaaaaacuugcauuauucuuuaaaggaguugucagaccaaacgcuaaaacagauacaggagccggagaaaucaguaaaagcuuuucaauauuccaaagcgcagaaagaauuauagaagaacuaaaauucaucaaaaauguaacaagaauggacaacgagaucuucccgucugaagguguauuccucgacgcugcaaauguauuaggagucagaggcgacgauuuugauuucucaaacgaauucguaggugaugaucuucauucugacgccaacaaaaaaauaauaaacaagauaaauggcacaaaagaagauagaaaucuacgaaauuucauaauaaauaacguaguaaaaagcagaagguuccaauacauagcacgucacaugaacacccauuauguaaaacaguuagcaaacaacgaaacacucaauagauuuguccuuaauaaaaugggugaugcaaaaaucauaaaccgauacuacgaaucuaucagcggaaacacaccaaauauugaaguccgaucucaaaucgacuaucuuguaaaacgacuacguucauucucauucgaagaccuaaacgauguaaaacaaaaaguaagacccggcacaaaugaaucuaucgaaaaagaaaaaaaaaaagcauugguuggacuuugucuaacuauccaauaccuagucuacaaaaauuuaguaaacauuaacgcacgauacacuacagcuuuuuauugcuuagaaagagauucaaaacuaaaaggauuuggaguagacguauggagagauuucgaauccuauacggcucucacaaaucacuucauaaaagaagguuaccuuccaguucgaaaagcugagauacuaagagcaaaucuaaaacacuuagauugcgaagacggauuuaaauauuaucguaaccaagugacucacuugaaugccaucagaguagcuuauaaauacauaaacgaaaucaaauccguucacuccuauuucgcuuuauaccacuacaucaugcaaaggcaucuuuacgauagccuacaagccaaagcaaaagacucuucaggauucguaauagacgcucuaaaaaaauccuuugaacauaaaauuuacucaaaagauuuacuccauguacuacacucacccuucggauauaacaccgcacgauacaaaaauuuaaguauagaagcacuguucgacaaaaaugaaucaagaccagaagugaacccacucucaacaaacgauggcucaggcccaaaaaaaaaaagaaaagucgcagcugcauaccccuaugauguaccagauuaugcuuga

SEQ ID NO: 14409 - RNA, 2940 nt, Artificial Sequence
  Cas13d variant__Anaerobic digester metagenome 15706__NLS-dAdmCas13d-NLS-HA
augucaccaaaaaaaaaacgaaaaguagaagccucaaacaacaaaagaaaaacaaaagcaaaagcagcaggacuuaaaucaguauuuuuugaccaaaaacaagcaguacucacaacauucgcaaaaggaaacaacucacagaucgaaaaaaaaguaguaaacucugaaguaaaagauuuacgccaaccacccgcauucgacuuagaauuaaaagaaaaaacuuuuuauauaagcggaaaaaacaacauaaacacaucucgagaaaacccacuagcaagugccucccuaccgcuauccaaaagacaaagaauacgagcggaacgaauaaaaagagcgcgagaagaaaauagaccauaccauaacguaaaaaggguaggagaagaugacuuaagagcaaaagcagaucuagagaaacauuacuucggaaaagaauauagugacaauuuaaaaauacagauuauauacaauauacucgauauaaauaaaauaauuuccccauauauuaacgacauaguauacucuaugaacaacuuagcccguaacgaugaauacauugauggaaaaaucgacguaauagguucacucucaucaacaacagauuauucgucauucauguccccaaacaaagaccuagaaaaggaaaaaaaauuuucauuccacagagaaaacuacaaaaaauucguugaagcaucaaaaccuuauaugagauacuaugguaaaguuuucauacgagacgucaaaaaaucgaaacuaucaaccggaaaaggggaaaaaauagaaguaauguaucgaucagaugaagaaauauuuacaauauuccaaaucuuaucauacguagcucaaucuauaauggcaaaugacauaggaaauaaaucaaguauacuugcaauugaaaaauacccagcacgauucguuggauuccuaucagauuuacuaaaaacuaaaacaaacgaugucaaccgaauguucauugacaacaacagucaaaccaacuucuggguccuauucucaauauucggacuucaagaccacaccucuggagcagacaaaauaugucgcaacuucuaugacuucguuaucaaagccgacucgaaaaaucuaggauucucacuaaaaaaaauacgagaguuaaugcuagauuuaccgaacgcgaacaugcuacgagaucaccaauucgauacaguacgcucaaaauuuuacacguuauuagacuuuauaauuuaccaacacuacuuagaagaaaaaucgagaauugacaacaugguugaaaaacuuagaaugacacuaaaagaggaagaaaaagaaguacuauacgcugccgaagcaaaaauaguauggaacgcaauaggcgcaaaaguuauaaacaaauuaguaccaaugaugaacggcgaugcacucaaagaaauaaaaagaaaaaauagagacagaaaacuaccacaaaguguuauagcaacuguacaagucaauucagaugcaaacguauuuucuggucuaaucuacuuccuaaccuuauucuuagacggaaaagaaauaaaugaaaugguaucaaaucuaauaacuaaauucgaaaacaucgauucauuauuacacgucgaucgagaaauauauaaaucugaugaaaaagaccuagaccuugaaauagaaaaauuagcacucuuuuuuaaaggcguaguuagaccaaacgcuaaaaccgacaccggugcgggcgaaauaucaaaaucauucucuauauuccaaagugcagaacgcaucauagaagaacuaaaauucauaaaaaauguuacacgcauggauaaugaaauauuccccucagaagguguauuccucgaugcugccaauguccucggaguuagaggagacgacuuugacuucucaaacgaauucguaggagacgacuuacacucugaugccaacaaaaagauuaucaauaaaauaaauggaacaaaagaagaccgaaaccugcgcaauuuuauaauaaacaacgucguaaaaucaagacgauuccaauacauagcccgacacaugaauacacauuacguaaaacagcucgcuaacaaugaaacacuaaacagauuuguacuaaacaaaaugggcgaugcaaaaauuauaaauagauauuaugaaucuauaucuggcaacacaccgaauauagaaguacgaagucagauagauuauuuaguaaagagacugagaagcuucucauucgaagaccuaaacgauguaaaacaaaaaguaagaccaggcacaaacgaaucaauagaaaaagaaaaaaagaaagcacuagugggauuaugccuaacaauacaauaccucguauauaaaaacuuaguaaacauaaaugcaagguauacaacugcauucuauugucuagaaagagacucaaaacuaaaaggauucggcguugacguauggcgagacuucgaaaguuauacggcauuaacaaaccauuucaucaaggaaggauaucuaccaguaagaaaagcugaaauacucagagcuaaccuaaaacaccuagauugcgaagacggauuuaaauauuacgccaaccaaguaacggccuugaacgcaauaagagucgcuuauaaauauauaaacgaaauaaaauccguacauuccuacuucgccuuauaucauuacauaaugcaaagacauuuauacgacagucuacaggccaaagcaaaagacaguucagguuucguaauagaugcacuaaaaaaaucauuugaacauaaaauauauucaaaggaucuacuccacguacugcacuccccauucggauauaacacagcuagauacaaaaaccuaucaaucgaagcauuauucgacaaaaacgaaucaagaccagaaguaaauccacuaucuaccaacgauggaagcggaccaaaaaaaaaaagaaagguagcugcagcauacccauaugaugucccugauuacgccuga

SEQ ID NO: 14410 - RNA, 2892 nt, Artificial Sequence
  Cas13d variant__Eubacterium siraeum DSM15702__EsCas13d-HA
augggaaaaaaaauacaugcaagagaucucagagaacagcgaaaaacagauagaacagaaaaauucgcugaucaaaacaaaaaaagagaggcagagagggcagucccaaaaaaagacgcagcagucuccgucaaaaguguaucaagcgucucaucaaaaaaagacaaugucaccaaaagcauggcaaaggcggcaggaguuaagucaguauuugcuguaggcaauacuguauauaugacuucauuuggaagaggcaacgacgcaguauuagaacagaaaauaguggacacaagccaugaaccacuuaacauagacgacccagccuaccaacuaaacguagucacaaugaaugguuauucaguaacaggucacagaggcgaaaccguuucagcaguuacagacaacccccuaagacgauuuaauggaagaaagaaagaugagccugaacaaucagugccaacggacaugcuaugcuuaaaaccaacauuagaaaaaaaauuuuucgguaaagaauucgaugacaauauacacauacaauuaauauauaauauauuagauauagaaaaaauuuuagcgguauacaguacgaacgcuauauaugccuuaaauaauaugucagcagacgaaaacauagaaaacagcgacuuuuuuaugaaaagaacaacagaugaaacauuugaugauuuugaaaaaaaaaaagaaucaacaaauaguagagagaaagcagauuucgaugcauuugaaaaauucauuggaaauuacagacuugcauacuucgcggacgcauuuuacgugaacaagaaaaaucccaaaggaaaggccaaaaauguauuaagagaagacaaagaacuauauaguguucuaacacucauaggaaaauuacgacacuggugcguacacucagaagagggaagggcagaauucugguuauacaaauuagacgaacuaaaagaugauuucaaaaacgugcuugauguagucuauaauaggccaguagaagaaauaaauaaucgcuucaucgagaacaacaaagugaauauacaaauauuaggcucuguguacaaaaacacagacauugcagaacuuguaagaucauacuaugaauuccuaauaacaaaaaaauacaaaaauauggguuucucuauaaaaaaacuaagagaaucaaugcucgagggaaaagguuaugcugauaaagaauacgauucaguaaggaacaaacuuuaucaaaugaccgacuuuauacucuacacagguuauauuaacgaagauucagauagggcagacgauuuaguaaacacauuaagaagcucguuaaaagaagaugauaaaacuacaguauacugcaaagaagcugauuaucuauggaaaaaauacagagaaucuauaagagaaguagccgaugcacuugacggagauaacauaaaaaaacuuaguaaaucaaauauagaaauccaggaagacaaacuaagaaaaugcuuuauaucauaugcagauucagugagugaauucacaaaacuaaucuauuuauuaacgagguucuuaucaggaaaagaaauaaacgaucucguaacaacucuaauaaacaaauucgacaacauaagaucuuucuuggaaauuauggacgaacucggcuuggauagaaccuucacggcagaauacagcuucuuugaagggucaaccaaauaucuugccgaauuaguagaauugaacucauuuguaaaaucuugcucauuugacauaaacgcaaaaagaacaauguacagagaugcccuugauauacuagguauagaaagcgacaaaacagaagaagauaucgaaaagaugauagauaacauacuacaaauagacgccaauggagacaaaaaacuaaaaaaaaacaacggcuuacgcaacuucaucgcaagcaacgucauagacagcaauagauuuaaauaucuaguuagauacgguaauccaaaaaaaauaagagaaacagcuaaguguaaaccagcagugagauucguacucaacgaaauaccugacgcacaaauagaaagauauuacgaagcuuguugcccaaaaaacacagcauuauguucggcuaacaagaggagagaaaaacuagccgacaugauugcggaaauaaaauuugaaaacuucucagacgcuggaaacuaccaaaaagcaaacguaacaucaagaaccagugaagcagaaauaaaaaggaaaaaccaggcaauaauacgccuauaccuaacaguaauguauauaaugcucaagaaucuagucaacguaaacgcuagauacguaaucgcuuuucacuguguagaaagagacacuaaauuauacgcggaaucagguuuagaaguaggaaacauagaaaaaaacaaaaccaacuuaaccauggcaguuaugggaguaaaacuagaaaacggaauaauaaaaaccgaauuugauaaaucauuugcagagaacgcagcaaaucgcuaccugagaaacgccaggugguauaagcuuauacuagauaaccuaaaaaaaagugaaagagcaguagucaaugaauuuagaaacacagucugccacuuaaaugcaauacggaacauuaacauaaacauaaaagaaauaaaagaaguagaaaauuacuucgcauuauaucacuacuuaauacaaaaacaccucgaaaacagauucgcggacaaaaaaguagaaagagacaccggagauuuuauaucaaagcuagaagaacacaaaacguacugcaaagauuucguaaaagcauacuguacccccuuuggauauaaccuaguaagauauaagaaccuaacaaucgaugguuuauuugacaagaauuacccaggaaaagaugauucagacgaacaaaaauauccauaugacguaccagauuacgcauga

SEQ ID NO: 14411 - RNA, 2892 nt, Artificial Sequence
  Cas13d variant__Eubacterium siraeum DSM15702__dEsCas13d-HA
augggaaagaaaauacaugccagagaccuaagagaacagcgaaaaacagauagaacagagaaauuugcugaccaaaacaaaaagcgagaggcagagcgagcugugcccaaaaaagaugcugcaguaucgguuaaaucuguaucaucagucucaucuaaaaaagacaacguaaccaaaagcauggcaaaagcagcaggagucaaaucaguuuuugccguaggaaacacaguauacaugaccaguuuuggaagaggcaaugaugcagucuuagaacaaaaaauaguggauacaucccaugaaccacuaaauaucgacgacccagcauaccaauuaaacguagugacaaugaacggguauucaguaaccggacaccgaggagagaccguauccgccgucacggacaacccucugagaagauuuaacggacgaaagaaagaugaacccgaacaaagcguccccacagauaugcuuugccuuaaacccaccuuagaaaaaaaauuuuucggaaaagaauucgacgauaacauacacauccaacuaauuuauaacauacucgauauugaaaaaauacuugccguuuacagcaccaacgcuauauacgcccuaaauaauaugagcgcagaugaaaacauagaaaauagugauuucuuuaugaaacgaaccacugacgaaacauucgaugacuucgaaaaaaaaaaggaaucaaccaauucaagagaaaaagcagacuuugacgcguuugagaaauucauaggaaauuacagauuagcauauuucgcugacgcauuuuacguaaacaaaaaaaacccaaaagguaaagccaaaaacgucuuaagagaggauaaagaacuauacucaguacucacuuuaauuggcaaacuggcccauuggugcguggcaucugaagaaggaagagcagaauuuuggcuuuacaaacuagacgaauuaaaagacgacuuuaaaaacguauuagauguaguauauaaccgcccaguagaggaaaucaacaauagauucaucgaaaauaacaaagucaacauacaaauacuaggaucagucuacaaaaacacugacauagcagagcuagucagaucauacuaugaauuuuuaauaacaaaaaaauacaaaaauauggguuuuuccauaaaaaagcuaagagaaaguauguuagagggaaaaggauaugcugauaaagaguaugacagcguaagaaacaaacuauaucaaaugacagacuucauuuuauacaccggauauauaaaugaagacagugaccgggccgaugacuuaguaaacacacuaagaucgucacuaaaagaagacgauaaaacuacaguuuauuguaaagaagcagacuacuuauggaaaaaauauagagaaagcauacgagaaguagccgacgcacuagacggagacaauauaaaaaaacuuucaaaaaguaauaucgaaauucaagaagacaaacuacguaaaugcuucauuaguuaugcagacucuguaagcgaauuuacaaaacuuauauacuuacugacaagauuuuuaucagguaaagaaauaaaugaccuuguaacaacccuaauuaauaaauucgacaacauaagaucauucuuagagauaauggaugaacuuggacuagauagaacauucaccgcagaguacucauuuuucgaaggcagcacaaaauaucuugccgaauuaguagaacuaaacagcuucguaaaaaguugcucauuugacauaaaugcuaaaagaacaauguauagagaugcgcuagauauauuaggaauugaaucugacaaaacugaagaagauauagaaaaaaugaucgauaacauauuacaaauagacgccaacggagacaaaaaacuaaaaaaaaacaacggacuaagaaauuucauagcaaguaauguuauagauucuaacagauucaaauacuuaguaagauacggcaaucccaaaaaaaucagagaaacugcgaaauguaagccugcaguacgguucguacuaaacgaaauaccagacgcucaaauagaaagauacuaugaagcauguugccccaaaaacacagcacuaugcucagcaaacaaaagaagagaaaaauuagcagauaugauagcagaaauuaaauucgaaaacuucagugacgcuggcaacuaccaaaaagcaaauguaacaucccgcacaucagaagcagaaauaaaaagaaaaaaccaagcaauaaucagauuguaccuaacaguaauguauauaaugcuaaaaaaucuuguaaauguuaaugcacgauacgucauagccuuucauuguguugaaagagacacuaaauuauacgcagaaaguggacuagaagugggcaacauagaaaaaaacaaaacaaacuuaacaauggcuguaaugggcgugaaacuggaaaacggaauuauaaaaacagaguucgacaaaagcuucgccgaaaaugcugcaaaccgauaccuuagaaaugcaagaugguauaaauuaauucuagacaacuuaaaaaaaucagaaagggcaguaguaaacgaauuugcaaauacaguaugcgcacucaacgcaauacgcaauauaaacauaaacauaaaagaaauaaaagaaguagaaaauuacuucgcuuuauaccacuaccuaauacaaaaacacuuagaaaaccgauucgcagacaaaaaaguagaaagagacacaggugauuucauaagcaaacuagaagagcauaaaacuuacugcaaagauuuuguaaaagccuacuguacaccauucggauacaaccuuguacgcuacaaaaaccuaacgauagauggacuuuuugauaaaaacuauccaggaaaagaugauucugacgaacaaaaauauccuuaugauguaccagacuaugccuga

SEQ ID NO: 14412 - RNA, 2964 nt, Artificial Sequence
  Cas13d variant__Eubacterium siraeum DSM15702__NLS-EsCas13d-NLS-HA
augucacccaaaaaaaaaagaaaaguagaagcgucagggaaaaaaauacaugcgcgagaccuaagagaacaacgaaaaacugacagaaccgaaaaauucgcagaccaaaauaaaaaaagagaagcagaaagagcaguaccaaaaaaggaugcugcuguuucugucaaaagcguaucaucagugucaucaaaaaaagacaauguaaccaaaucaauggcaaaagccgcaggaguaaaaagcguguucgccgucggaaacacagucuauaugacgucauuuggaagaggaaacgaugcuguauuagagcaaaaaauaguggacacaagucacgaaccacuaaauauagacgauccagccuaccaauugaauguuguuacaaugaacgguuacucaguuacaggacacagaggagaaacaguaagcgcagucacagauaacccauugcggagauucaauggcagaaaaaaggacgaaccagaacaaucgguaccaacagauaugcuaugccuaaaacccacacuagaaaaaaaauuuuuuggaaaagaauucgacgacaauauccacauucaacuaauuuauaacauauuagacaucgaaaaaauauuagcagucuacucaacaaaugcaauuuacgcauuaaacaauaugucagcagaugaaaacaucgaaaacagugacuucuuuaugaaaagaaccacagacgaaacauucgacgacuucgaaaaaaagaaagaaaguacaaauagccgagaaaaagcagacuucgaugcauuugagaaguuuauaggcaauuacagauuagcauauuucgcagaugcauucuauguaaauaaaaaaaauccuaaaggaaaagcuaagaauguguuaagagaagauaaagaacuauauucaguacuaacauugauagguaaauugcgucauuggugcguacauucagaagaaggacgagcagaauucuggcuuuauaaacuggacgaacucaaagacgauuuuaaaaacguacucgacgucgucuacaauaggccgguagaggaaauaaacaaucgguucauagaaaacaacaaaguaaauauacaaauccucggaaguguauacaaaaauacagacauagcagagcuaguuagaucauacuaugaauuccuaauaacuaaaaaauauaaaaauaugggauuuuccauuaaaaagcuacgugaaucaaugcuagaaggaaagggcuaugcagacaaagaguacgacuccguaagaaacaaacuauaccaaaugacugacuucauauuauacacaggcuacauaaacgaagacagcgauagagcggaugauuuaguuaacacacuacgauccucacuaaaagaagaugacaaaacuacaguuuauuguaaagaagcagacuauuuauggaaaaaauaccgugaaaguauaagagaaguugccgaugcccuagacggcgauaacauaaagaaacuaaguaagucuaacauugaaauacaagaagacaaacugagaaaauguuucaucagcuacgcagacuccgucagugaauuuacaaaauuaauauacuuacuuacaagauuccugucaggcaaggagauaaacgaucuaguaaccacuuuaauaaacaaauucgauaacauaagaagcuuccuugagauaauggacgaauuaggcuuagacagaacuuuuacagcagaauauaguuuuuucgaaggcucgacuaaauaucuugcagaacuaguagaauuaaauagcuucguaaaaucaugcucauucgacauuaaugcgaaaagaacaauguaccgugacgcauuggauaucuuaggaaucgagucagacaaaacugaagaagacaucgaaaaaaugauagauaauauacuacagauagacgcaaacggagacaaaaaauuaaagaaaaauaacggauuaagaaauuucaucgcauccaaugucauagacaguaauagauuuaaauaucuuguccgauauggaaauccuaaaaaaaucagagaaacugccaaauguaaaccagcggucagauucguauuaaacgaaauacccgaugcacaaaucgaacgauauuaugaagccuguugcccaaaaaauacagcacugugcucagcaaacaaacgccgagagaaacuagcggauaugauagccgaaaucaaauucgaaaauuuuagcgacgcagggaacuaucaaaaagcuaauguaacuucacgaacaagcgaagccgagauaaaaagaaaaaaucaagcaauaauuagacucuaccuaacaguaauguacauaaugcuaaaaaauuuagucaacguaaaugcaagauacguaauagcguuccacugcguagaacgagauacaaaacuauacgccgaaucaggacuagaaguagggaacauugaaaaaaacaaaacuaauuuaacaauggcaguaaugggagugaaauuagaaaacggaauaauaaagacagaauuugacaaaucguuugccgaaaacgccgcaaacagauaucugagaaaugccagaugguacaaacuaauacuugauaaucuaaaaaaaagugaaagagcaguaguaaacgaauuuagaaacacgguaugucaucuaaaugccaucagaaacaucaacauaaauauaaaagaaauaaaagaaguagaaaacuauuuugcacuauaucacuaucuaauucaaaaacaccuagaaaacagauuugcggacaaaaaaguggaaagagauaccggagacuuuauaucaaaauuggaagaacacaaaacauacuguaaagauuucguaaaagccuauugcacaccuuucgguuauaaccucguaagauacaaaaaucuaacaauagacggacuauucgauaaaaacuauccaggaaaagacgacucugacgaacaaaaaggauccgguccaaaaaaaaaacguaaagucgccgcagcauacccauacgauguacccgacuacgccuga

SEQ ID NO: 14413 - RNA, 2964 nt, Artificial Sequence
  Cas13d variant__Eubacterium siraeum DSM15702__NLS-dEsCas13d-NLS-HA
augagcccaaaaaaaaaacgaaaaguugaagcaucuggaaaaaaaauccacgcgcgagacuuacgagaacaacgaaaaacugacagaacagaaaaauuugcagaucagaauaaaaaaagagaagcagaaagagcaguaccuaaaaaagacgcagcaguaagcgucaaaaguguaucauccguaucaagcaaaaaagauaacguaacaaaaucaauggcgaaagccgcaggaguaaaaagcguguucgcugucggcaauacaguauacaugaccagcuucggacgagggaaugacgcaguacuugaacaaaaaauaguagacacuucacacgaaccacuaaauauugaugacccagcauaucaacucaacguaguaacaaugaacggguauucuguaacuggucaccgcggugaaacagugucugcaguaacagacaauccauuacgcagauucaauggacguaagaaagaugaaccagaacaaucagucccuacagacaugcuuugccuaaaaccaacacuagaaaaaaaauuuuucggaaaagaauucgaugacaacauacacauacaacuaauuuacaauauacuagauaucgaaaaaauauuagccguuuacaguacaaacgccauauacgcacucaacaacauguccgcagacgagaauauugaaaacagugauuucuuuaugaaaagaacuacagaugaaaccuucgacgauuucgaaaaaaaaaaggaaaguacaaauagcagagaaaaagcugacuuugaugcauucgaaaaauucaucggaaauuaucguuuagcauauuucgcugacgcauuuuauguaaauaaaaaaaaccccaaaggaaaagcaaaaaacguauuacgagaggacaaagaauuauauagcguucucacacuuauuggaaaacucgcgcauuggugcguugcaucagaagaagguagagcugaauuuuggcucuacaaacuagaugaacucaaagacgauuuuaaaaauguacuagacguaguauacaauagaccuguagaagaaauaaacaauagauucauagaaaauaauaagguuaacauacaaauacuaggauccguauauaaaaacacagauauagcagaacucguaagaucauacuacgaauuccuaauaacgaagaaauacaaaaacaugggcuuuaguauuaaaaaacuuagagaauccauguuagaaggcaaaggguaugcagacaaagaauaugacucagucaggaauaaauuauaccaaaugacggacuucauccuuuauacaggauacauaaacgaggacuccgacagagcagacgaccuaguaaauacccugcgcucuagucuaaaagaagacgacaaaacaacgguauacuguaaagaagccgacuaucuauggaaaaaauaucgagaaucaauuagagaagucgcugacgcacuagauggugacaacauaaaaaaacuauccaaaucgaacauagaaauacaagaggauaaacuaagaaaauguuucauaucauaugcagauucaguaagugaauucacuaaacucauauacuuacugaccagauuccuaucaggaaaagaaaucaaugaucuaguaacuacauuaauaaacaaauucgacaauauaagaucauucuuagagauaauggaugaauuaggacuagacagaaccuuuacagcagaauauucauucuucgaagguucaaccaaauacuuggcagaauuaguggaacuaaacaguuuugucaaaucauguagcuuugacauaaaugccaaaagaacaauguaccgagacgcauuagacaucuuaggaaucgaaagcgauaaaacagaggaagacauagaaaaaaugauagacaacauauuacaaauagacgcaaacggagacaagaaacuuaaaaagaacaacggcuuaaggaacuucauagcgucaaauguuauagauuccaacagauuuaaauaccuaguucgauauggaaauccaaaaaaaauacgugaaacugccaaaugcaaacccgcaguuagauucguacuaaacgagauuccagacgcacagauagaaagguacuaugaagcauguugcccaaaaaauacagcccuaugcucggcaaauaaacgaagagaaaagcuagccgacaugaucgcagaaauaaaauuugaaaauuucagugacgcagguaauuaucaaaaggcaaacguaacaucacgaacaagcgaagcagaaauuaaaagaaaaaaucaagcgauaauacgauuauacuuaacaguaauguacauuaugcucaaaaacuuaguuaacguaaacgccagauacgucauagcauuucacuguguagaaagagacacaaaacuguacgccgaaaguggacuagaagucgggaacauagaaaaaaauaaaacuaaucuaacaauggccguaauggggguaaaacuggaaaacgguauaauaaaaacagaauucgacaaaaguuuugcagaaaacgcagcuaauagauauuuaagaaacgcaaggugguacaaacuuaucuuagacaaucuaaaaaaaagcgaaagagccguaguuaaugaauucgcuaauacaguaugugcacuaaacgcaaucagaaacaucaacauaaacauuaaagaaauaaaggaaguagagaacuacuucgcauuauaccacuacuuaauacaaaaacaccuugaaaauagguuugcagacaaaaaaguagagagagauaccggagauuuuauaucaaaacucgaagaacacaagaccuauugcaaagacuuugugaaagcauacuguacaccauuuggcuauaaccucguaagauacaaaaaccuaacaauugacggauuguucgacaaaaacuacccuggaaaagaugauagcgacgaacaaaaagguagugguccuaaaaaaaaaagaaaaguugcagccgccuacccuuacgauguaccagauuacgcuuga

SEQ ID NO: 14414 - RNA, 3402 nt, Artificial Sequence
  Cas13d variant__Eubacterium siraeum DSM15702__PspCas13b-NES(HIV)-3xHA
augaauauaccugcgcuaguagaaaaccaaaagaaauacuuuggcacauauagcguaauggcaauguuaaacgcacaaaccguauuagaccauauucaaaaagucgcagauauagagggagaacaaaaugaaaacaaugaaaaucuaugguuccauccagucaugucucaucucuauaacgcgaaaaauggauacgauaaacaaccugagaaaacaauguuuauaauagaaagauuacaaucauauuuuccauuucuuaaaauaauggcagaaaaucaaagagaauacaguaacgguaaauauaaacaaaaccguguagaagucaacucaaaugacauauucgaaguauuaaaaagagcauucggcguccuaaaaauguacagggaccuaacgaaccacuauaaaacuuacgaagagaaacuuaaugauggaugcgaauuuuuaaccuccaccgaacagccacuuagcgggaugauuaacaauuacuacacuguagcacuuagaaauaugaacgagagauacggcuacaaaacagaagacuuagcauucauacaagacaaaagauucaaauuugugaaagaugcauacgggaaaaagaaaucacaagucaacacaggauucuuuuuaucuuuacaggauuacaauggugacacucaaaagaaacuucaucucucgggaguaggcaucgcauuacucauaugccuauuuuuagauaaacaauauaucaauauauuuuuaaguagacuaccaauauuuuccaguuauaaugcacaaucugaggaaagacgaauuauaauaagaucauuuggaaucaauagcauaaaauuaccgaaagacagaauacacucggaaaaauccaacaaaucaguagcaauggacauguugaaugaaguuaaacgaugcccagacgaauuauuuacgacauuaucagcagaaaaacaaucaagguucagaauuauaucugaugaccacaaugaagugcucaugaaaaggucuagugauagauucgucccauuacuuuuacaauauauagauuauggaaaacucuuugaccacauaagauuucacguaaauaugggaaaacucagauaccuacuaaaagccgacaaaacaugcaucgacggccaaacaagaguaagaguaauugaacagccauugaacgguuucggucguuuagaggaagcagaaaccaugagaaaacaagaaaacgggacuuuuggaaacuccggcauucgaauuagagauuuugaaaacaugaaacgagacgacgcaaauccagcaaauuacccuuauaucguagauacauacacacacuauauauuagaaaauaauaaaguagaaauguucauuaacgacaaagaagauagugcaccauuacuaccaguaauagaagaugauagauacguagucaaaacaauaccauccuguaggaugucaacacuugaaauacccgcaauggcauuccauauguuucuauuuggaaguaagaaaacggaaaaacuaauaguagauguucacaaccgauauaaaagacuauuucaggcuaugcagaaagaagaaguaacagcugaaaacauagcaaguuucggaauugcagaaucagauuuaccccagaaaauauuagaucuaauaucaggaaaugcccacgguaaagacgucgacgcauuuauacgccuaaccguagaugauauguuaacugauacggaacgacguauaaaaagauucaaagaugacagaaaaucaauacgauccgcagauaauaaaaugggaaaaaggggcuuuaaacaaauaucaacaggaaaauuagcggauuucuuagcaaaagacaucguauuauuccaaccuaguguaaaugauggcgaaaauaaaauaacgggacuuaauuauagaauaaugcaaagugcaaucgcaguauaugacucaggagacgacuaugaagcaaaacaacaauucaaacuaauguucgaaaaagcccgauugauaggcaagggaacaaccgaaccgcauccauuccuauauaaaguguucgcacgauccaucccugcaaacgccguagaauuuuacgaaagauacuuaauugaaaggaaauuuuauuuaacuggauuaaguaaugaaaucaagaaaggaaaucgcguagauguaccauucauaagacgagaucagaauaaauggaaaacaccagccaugaaaacauuaggaagaauauauucugaagacuuaccaguagagcuaccuagacaaauguuugacaacgagauaaaaagccaucucaaaucgcucccacaaauggaaggcauugauuuuaacaacgcaaacguaacuuaccuuauagcagaauauaugaaacguguguuagacgaugacuuucaaaccuuuuaucaauggaacagaaacuacagguauauggacaugcuaaaaggggaauaugacagaaaaggcagcuugcaacauuguuucaccagcguagaagagagagaaggacuauggaaggaacgagcuucacguacagaaagauauagaaaacaagcaucaaacaaaauacggucaaaccgacaaaugcguaaugcuaguucugaagaaaucgaaacaauauuagacaaaagacucuccaacagcagaaacgaauaccaaaagucagaaaaaguaauaagacgauauagaguccaagaugcucuacucuuuuuacucgcuaagaaaacucuaaccgaacucgcagacuucgacggagaacgcuucaaacuaaaagaaauaaugccggaugccgaaaaagggauucuaagcgaaauaaugcccaugucauucaccuucgaaaaaggaggaaagaaauauacaauaacuagcgaaggaaugaaacuuaaaaacuauggagauuucuuuguauuagcaagcgauaaaaggaucggaaauuuacuugagcuaguaggaagugauauuguaucaaaagaagauauaauggaagaguucaauaaauacgaccaaugucgaccugaaauaucaucaauaguauuuaaccuagaaaaaugggcuuucgauacauauccagaauuaucagccaggguugaccgagaagaaaaaguagacuucaaaucaauucuaaaaauacuacuuaacaauaaaaacaucaauaaagaacaaucagauauacuuagaaaaauaagaaaugcauucgaccauaacaauuacccugacaaaggaguugucgaaaucaaagcauugcccgaaauagcaaugucaaucaagaaagcauucggagaauacgcaauaaugaaaggaagucuacaacuaccuccguuagaacgccuaacccuaggaucaagcuacccauacgacguuccagauuaugcauauccauaugacguaccagauuacgcauaucccuacgacguaccagacuaugcauga

SEQ ID NO: 14415 - RNA, 2748 nt, Artificial Sequence
  Cas13d variant__Gut metagenome assembly P1E0-k21__P1E0Cas13d-HA
auggaaagagaaguaaagaagcccccaaaaaagagucuagcuaaagcggcaggauuaaaaucuaccuucgucauaucaccacaagaaaaagaacuggcaaugaccgccuuugguaggggaaaugacgcguuacuccaaaaaagaauaguagacggaguugucagagauguagcaggagaaaaacaacaauuccaaguccaacgacaagacgaaagucgcuuuagauuacaaaauucacgcuuagccgaucgaaccguuaccgcagacgauccauuacaucgagcagaaacaccacgaagacaaccucucggcgcagggauggaucaauuaagacgaaaagcaauacuagaacaaaaauauuuugguagaacuuuugaugacaauauacauauacagcuaauauacaacaucuuagacauccauaaaauguuagcagucccagcaaaucauauaguacauaccuuaaaucuauugggagguuacggagaaacugauuuuguagguauguuaccggcagguuuaccguacgauaaacuaagaguaguaaaaaaaaaaaacggugacacaguagauauuaaagcggacauagcagcauacgcaaagaggccucaauuggcauauuuaggagcagcauuuuaugacguaacacccggaaaaucaaaaagagaugcugcacgaggcagaguaaaaagagaacaagacguuuaugcaauuuuaagucuaaugagcuuguugagacaauuuugugcccaugacucaguaagaauauggggacagaauacaaccgcagcacuguaccauuuacaagcauuaccacaagauaugaaagacuuacuagaugauggcuggagaagagcacuaggaggaguaaacgaucacuuucuagacaccaauaaagugaaccuuuuaaccuuauuugaauauuauggagcagaaaccaaacaagcucgagucgcacuaacgcaagacuuuuacagauuuguagugcucaaagaacaaaaaaauauggguuucagucuaagaagacuaagagaagaacuauuaaaauuaccagacgcagcauaccuaacaggacaagaauacgacaguguacgacaaaaacuauacauguuacuggacuuccuccugugucgacuguacgcacaagaaagggcagaccgaugugaagagcuaguaucggcauuaagaugugcacuaagcgacgaagaaaaagacacuguuuaucaggcagaagccgcggcuuuauggcaagcucuaggagacacauuacgaagaaaauuacuaccauuauuaaaaggaaaaaaacuccaagacaaggauaaaaaaaaaucagaugaguuaggauuaucacgcgauguauuagauggaguauuauuucgccccgcucaacaaggaucaagagcuaaugcugauuacuuuugcagauuaaugcauuuaucaacaugguuuauggacggaaaagaaaucaacacgcuuuuaacaacuuuaauauccaaacuagaaaacauugacucacuaaggucagugcuagaaagcaugggauuagcauacagcuucguacccgcauacgcuauguucgaucauagucgauauauagcaggccaacuacgugugguaaacaauauagcuagaaugcgaaaaccugcaauaggagccaaacgggaaauguauagagcggcaguaguacuucuaggaguagauucaccagaagcggcagcugcaauaaccgacgaucuucuucaaauugauccagaaacagguaaagucagaccaaggagugacagcgccagggacacuggacucagaaauuuuauagcaaauaauguaguugaaucaagaagauuuacuuauuuauuaagauauaugaccccugaacaggcaaggguucuagcacaaaaugagaaacuaauagcauuuguauuaaguacaguaccugacacacaacuugaaagguacugcagaacauguggucgagaagauauaacaggaagaccagcccaaauaagauauuuaacggcacaaauaaugggcguaagauaugaaucuuuuacggauguagaacaaagaggcagaggugauaauccaaagaaagaaagauauaaagcacugaucggauuauaccuuacaguauuguacuuagcaguaaaaaacaugguaaauuguaacgcaagguacguaaucgcauuuuauuguagagauagagacacagcacucuaucaaaaagaaguaugcugguacgacuuagaggaagauaaaaaaaguggaaaacaaaggcaagucgaagacuauacagcacuuacacgguauuuuguaucacaaggguaucucaacagacaugccuguggauauuuaagaucaaauaugaauggaauuucaaauagucuauuaacggcauacaggaacgcgguugaucauuuaaacgccauuccucccuuaggaagccuauguagagacaucggaagaguagauucauauuuugcacuauaucacuacgcaguucaacaauaccuaaacggaagauauuauaggaaaacaccaagagaacaagaacuuuucgcagccauggcacaacauagaaccugguguucagacuuaguaaaagcacuaaacacaccuuucggauauaaccuagcacgauauaaaaacuuaagcauugacggauuauucgauagagaaggugaccauguaguuagagaggauggugaaaaaccagccgaauauccuuaugauguaccagacuacgcauga

SEQ ID NO: 14416 - RNA, 2748 nt, Artificial Sequence
  Cas13d variant__Gut metagenome assembly P1E0-k21__dP1E0Cas13d-HA
auggaaagagagguaaaaaaaccuccaaaaaaaucuuuagcgaaagcagcagggcucaaaucaacauucguaauaucaccccaagagaaagaauuagccaugacugcauucggaagaggaaacgacgcacuacuccagaaaagaauagucgacggcguuguacgagacguugcuggagaaaaacaacaauuucaaguccaaaggcaagaugagucacguuucagauuacaaaacaguagacucgccgauagaacaguaacagcugaugauccucuacauagggcagaaacaccccgacgacaaccauuaggagcagguauggaucaacuucgucguaaggcaauauuagaacaaaaauauuucggccgcacauuugaugacaacauacacauccaauuaauuuacaauauacuagacauacacaaaauguuggcaguaccagcuaaucauauaguacauacacuuaaccuauuaggagguuacggugaaacagauuuuguaggaaugcuaccagccggauuaccauaugauaaauuacgagucguuaaaaaaaaaaacggagacaccguagauauaaaagcugacauagcagccuaugcgaaaagaccacaacuagcauacuuaggagcagcguuuuaugacguuacaccugguaaaagcaaaagagaugcagcuagagggcgagucaaacgggaacaagacguauaugcgauacucucacuuaugagucuacuagcgcaauucugugcugcagacagugucagaauauggggccaaaauacaacagcugcacuauaucauuuacaagcacucccacaagacaugaaagaucuauuagaugauggcuggagacgagcucuaggaggaguuaaugaccauuucuuagauacaaauaaaguaaaucucuuaacgcuguuugaauacuacggagcugaaacuaaacaagcacgaguagcucuaacacaagacuucuacagauucguaguccuaaaagagcaaaaaaacaugggauucucauuaagaagacuccgugaagaacuuuuaaaauuaccagaugcagcauaucuuacuggucaagaguacgauucagugagacagaaauuauauauguuacucgauuuuuuacuuugcagacuauaugcucaagaaagagcagacagaugcgaagaacuaguaucagcccuaagaugugcauuaagugaugaagaaaaagacacuguauaccaagcagaagcagccgcacuauggcaagcauuaggggacacacuuagacguaaacuacuaccucuacucaaagguaaaaaauuacaagauaaagauaaaaaaaaaucggaugaguuaggcuuaagcagagacguauuagacggaguccucuuucgaccagcucagcagggcucaagagccaacgcggacuauuuuugucguuugaugcauuugucaacaugguuuauggacggcaaagaaauaaacacacuucuaacaacccuuauauccaagcuagaaaacauagacucacuucgaucagucuuagaaucaauggguuuagcauauucuuucguaccagcuuaugcaauguuugaccacagucgauacauagccggccaacuaagaguagucaacaacauagcacgaaugaggaaaccagcaauaggagcuaaacgagaaauguacagggcugcagugguauuacuaggaguugauucuccagaagcagcugcagccauaacggaugaccuauuacaaaucgauccugaaacgggaaaaguaagaccaagauccgacagcgcacgcgauacgggacuaagaaauuucauagcaaacaaugucguugaaaguagaagguuuacauacuuacuaagauauaugacaccggaacaagcaagaguauuagcacaaaaugaaaaauuaauagcuuuuguauuaaguacaguaccugauacacaacucgaacgauauugucgaacauguggaagagaagacauuacuggacgaccagcacaaauaagauaucuaacugcacaaauaaugggagucagauaugagagcuuuacagauguggaacaaagaggaaggggagacaacccaaaaaaagaaagauacaaagccuugauuggauuauaucucaccguauuauaucuagcaguaaaaaacaugguuaauuguaacgcaagauacgugauagcauuuuacuguagagauagagauacagcacuauaucaaaaagaagucugcugguaugacuuagaagaagauaaaaaaucaggaaaacaaagacaaguugaagauuauacugcuuugacaagauacuuuguaucccaaggcuaccuuaauagacaugccuguggcuaucuacgcagcaauaugaacggcauaucaaauucauuauuaaccgcuuaugcuaaugcagucgaugcguugaaugcgauaccgccauugggcucauuaugucgugacauaggaagggucgacucauauuucgcacuauaucauuaugcaguucaacaauaucuaaacggaagauauuacagaaaaacaccucgagaacaagaguuauuugccgccauggcacaacauagaacuugguguucagaucucgugaaagcacugaauacacccuuuggauauaauuuagcaagauauaaaaaucucucuauagauggcuuauuugacagagaaggugaucacguuguaagagaagacggugaaaaaccagcagaauaccccuaugacguaccagauuacgcauga

SEQ ID NO: 14417 - RNA, 2820 nt, Artificial Sequence
  Cas13d variant__Gut metagenome assembly P1E0-k21__NLS-P1E0Cas13d-NLS-HA
augagucccaaaaagaaaagaaaagucgaagccucagaaagagaaguaaagaaaccaccaaagaaaucacuugcaaaagcugcaggucuaaaaaguaccuucguaauuucaccacaagaaaaagaacuagcuaugaccgcuuuuggucggggaaacgaugcccuacuacagaaaagaauuguagauggagucguuagagacguggcaggagaaaaacaacaauuucaaguacaaagacaagaugaaaguagauuuagauuacaaaacaguagguuagccgauagaaccgugacugcugaugacccauuacaucgcgcagagacaccaagaagacaaccucuaggagcaggaauggaucaacuucgcagaaaagcaauauuagagcaaaaauauuucggucgaacuuucgacgauaauauacacauacaacuaauauacaauauacuugacauacauaaaauguuagccguuccugcaaaccauauaguacacacacugaaucuuuuaggugguuacggugagacagacuucguagguauguugccugcuggcuuaccauaugauaaacuaagaguugugaaaaagaaaaauggugacacaguagauaucaaagcugauauagcggcguacgcaaaacgaccacaauuagcauaucuaggcgcggcuuuuuacgacguaaccccggguaaaagcaaaagagacgcagcaagaggaagaguaaaacgcgaacaagauguuuaugcuauucucucacuaaugucccuauuacgccaauucugugcucaugauaguguacgaauuuggggacagaacaccaccgcagcucuauaucaccuucaagcacuaccacaagauaugaaagauuuauuggaugacggauggcguagagcucuuggaggaguaaaugaccauuuccuagacaccaauaaaguaaaccugcuaacauuauuugaauauuauggagcagaaacuaaacaagcucgaguagcauuaacccaagacuucuaccgauuuguaguucuaaaagaacagaaaaauaugggauucagucuucgacgacuuagagaagaacuucuaaaauuaccagaugcagcauaccuaacgggacaagaauaugauucaguucgacaaaaacuauacaugcuauuagacuuuuuauuaugccgacuauacgcccaagaaagagccgauagaugcgaggagcuaguaucagcacuaagaugcgcauuguccgaugaagaaaaagauacaguuuaucaagcagaagcagcagcuuuauggcaagcauuaggagauacauuaaggagaaaacuauuaccauuauuaaaaggaaagaaauuacaagacaaagacaaaaagaaaucagacgaacuaggacuuucaagagauguacuagauggcguauuauuucgaccagcacaacaaggcucacgagcaaacgcggauuauuucugcagauuaaugcauuuaaguacgugguucauggacggaaaagaaauaaauacccuacuaacaacuuuaaucaguaaacuagaaaauauagauagucuacguucgguuuuggaaucaauggggcuggcauacucauuugucccugcauaugcaauguucgaccacucaagguacauugcuggucaacuaagaguagucaauaauauagcuagaaugcguaaacccgcaauaggcgcaaaaagagaaauguacagagcagcagucguccuauuaggcguugacagcccugaagcagcagccgccauaacagaugacuuauuacaaauugacccggaaacugguaaaguacgaccaagaucugauucugcacgugauacaggacugagaaacuuuauagcaaauaaugucguugaaucacgaagguuuacuuauuuauugagauauaugacuccagaacaagcacgaguacuugcucaaaaugaaaaauuaauagcuuuuguacuuucuacaguuccagauacgcaauuagaacgcuacuguagaacaugcggaagagaagauaucacaggaagaccagcacaaauaagauauuuaacagcucaaauaaugggagucagauacgaaaguuucacugacguagaacaaagaggaagaggagacaacccuaagaaagaacguuauaaggcuuugauaggccuauaucuuaccguauuauacuuagcaguuaaaaauaugguaaauuguaaugccagauauguuauagcuuucuacugcagagaucgcgauacugcauuauaccaaaaagaaguauguugguacgauuuagaagaagauaagaaaucaggaaaacaaagacaggucgaagacuauacggcuuuaacaagauauuucguaucacaaggauauuuaaacagacacgcauguggauauuuaagaucaaacaugaauggaauaucaaacucacuacuaacagcauacagaaaugccguagaccacuugaacgcaauaccaccacuaggaagucucuguagagacaucggaagaguagauucguauuuugcacuauaucauuaugcaguacaacaauaccuuaacgggagauauuauagaaaaacaccaagagaacaagaacuauuugcagcaauggcccaacaccguacauggugcucagaccuggugaaagcacuaaacacuccauucgguuauaaucuagcaagauacaaaaacuuaucaauagaugguuuauuugaucgagaaggagaccauguagucagagaagauggagaaaaacccgcagagggauccggucccaaaaagaaaagaaaaguggcagcagcauauccauacgauguaccagacuaugcauga

SEQ ID NO: 14418 - RNA, 2820 nt, Artificial Sequence
  Cas13d variant__Gut metagenome assembly P1E0-k21__NLS-dP1E0Cas13d-NLS-HA
augucacccaaaaaaaaacgaaaaguagaagccucagaaagagagguaaaaaagcccccuaaaaaaaguuuagcaaaagcugccggauugaaaucuacauuuguuauaagcccacaagaaaaagaauuagcaaugacagcauucggcagaggaaacgacgcacugcuacaaaaaagaauaguagauggaguagugcgugacguagcaggcgaaaagcaacaauuucaaguacaacgacaagaugagaguagauuucgacuccaaaacucaagauuagcugaucgaacuguaacagccgaugaccccuugcauagagcagaaacaccgcgaagacaaccccuaggagcuggaauggaccaacuaagaagaaaagcaauacuagaacaaaaguacuuuggaaggacauuugaugauaauauacauauccaacucauauacaacauacuagauauacauaaaaugcuagcaguacccgcgaaccacauaguucauacuuuaaaucuacuaggaggauacggcgaaaccgacuuuguagggaugcuaccagcaggccuaccauacgacaagcuuagaguaguaaaaaagaaaaacggcgauacaguagauauuaaagcugacauugcagcauaugcaaaaagaccucaauuagcauauuuaggcgcugccuuuuaugauguaacaccagguaaaucuaaacgggaugcagcuagagguagaguaaaacgagaacaagaugucuaugcaauacucucauuaaugucauuauuagcacaauucugcgccgcagacucugucagaauuuggggacaaaauacaacggccgcucuauaucaucuacaagcacuuccccaggauaugaaagauuuauuggaugacggauggagaagagcacuaggugguguaaaugaccauuuucuagacacuaauaaagucaaucuauuaacccuauuugaauauuacggcgcagaaacuaaacaagcaagaguagcacugacacaagacuuuuauagauuugugguuuugaaagaacaaaagaacaugggcuuuucccuucguagauuaagagaagaguuauuaaaacuuccagaugccgccuauuuaaccggacaagaguacgacaguguacgacaaaaacuuuauaugcuuuuagacuucuuacuaugucgacuauaugcucaggagagagcagacagaugcgaagaacuugugucagcacuaagaugugcgcuaucagacgaagaaaaagacacggucuaccaggcugaagcagcagcauuauggcaagcacuaggagauacacuaaggagaaaacuacugccucuacuaaagggcaaaaaauuacaagauaaagauaaaaaaaaaucugaugaauuaggacuaucuagagauguauuagauggaguauuauuuagaccugcacaacaaggaagcagagccaaugcagauuauuucugucggcuaaugcaucuuucuaccugguucauggauggaaaagagauaaacacauuacuaacaacauuaaucucaaaauuagaaaacauugacucacuaagaucaguauuagaaagcaugggauuagcauauucuuuuguaccugcauaugcaauguuugaccacagcagauacauagcagggcaauuaagagucguaaauaauaucgcaagaaugagaaaaccugcaaucggagcaaaaagagaaauguacagagcugcaguaguauugcuagggguggacagcccugaagcggcggcugccauaacagacgaucuuuuacaaauagauccagaaacugguaaaguaaggccacgaagcgacucagcaagagauacagggcuuagaaacuuuauugcaaauaacguuguugaaucgagacgguucacauauuugcuuagauacaugaccccagaacaagccagaguccuugcacaaaacgaaaaauuaaucgcguucguauugaguacuguaccugauacacagcucgaacgauauuguagaacaugcggaagagaagauauaacuggaagaccagcucaaauuagauaucugaccgcccaaauaaugggaguucgauacgaaucuuuuacagacguagaacagcgagguagaggagacaauccaaaaaaagaaagguacaaagcacuaauaggacuauacuuaacaguguuauaucuagcaguuaaaaauauggucaauugcaaugcaagauauguaauagcauucuacuguagggaucgugauacagcauuauaucaaaaagagguauguugguacgauuuagaagaggauaaaaaaagcgguaaacaaagacaaguagaggauuauacagcuuuaacaagguauuuuguaagccaaggauacuuaaauagacacgcuuguggauacuuaagaucaaauaugaacgguauuaguaacucucuucuaacagcguacgcaaacgcagucgaugcacuaaaugcuauacccccuuugggaucacuauguagagauauagguagaguagauucguauuuugcccuauaccauuacgcuguacaacaauauuuaaauggaagauacuaucgaaaaacaccaagagaacaagaacuauuugcggcuauggcccagcaucgaacaugguguuccgacuuaguuaaagcucuuaacacgccuuucggauauaauuuagcacgguacaaaaaccucagcauagauggacuauucgauagagaaggagaucacguaguccgagaagauggagaaaaaccugcagaaggaucagguccaaaaaaaaaacguaaaguugcagcagcauauccauacgacgugcccgacuaugcauga

SEQ ID NO: 14419 - RNA, 2862 nt, Artificial Sequence
  Cas13d variant__Ruminococcus albus __RaCas13d-HA
auggccaaaaaaucaaaaggaaugucucuacgugaaaaacgagaauuagaaaaacaaaaaagaauacaaaaagccgccguaaacaguguuaaugauacccccgaaaaaacagaagaagcaaauguuguguccgucaauguaagaaccucggcagaaaacaagcacagcaagaaaucagccgcaaaagcccuaggacuaaaaagcggacuuguuauaggagacgaacuauaucuaacaaguuuuggacgaggcaaugaagccaaauuagaaaaaaagauaucaggagacacagucgaaaaacuaggaaucggagcauuugaaguagcagaaagagacgaauccacauuaacauuagaaagcggaagaauaaaagauaaaacugcaagacccaaagacccacgacauauuacuguagauacacaaggaaaauucaaagaagacaugcuaggaauaaggagcgucuuggaaaaaaaaauauucgguaaaacauucgacgauaauauacauguucaauuagcauacaauauccuggauguagaaaaaauaauggcacaauauguaucagacauaguuuacaugcuacauaauaccgacaagacugaaagaaaugacaaucucaugggauacaugucaauaaggaacacauacaaaacauucugugauacgucaaaccuaccagacgauacaaaacaaaaaguagaaaaucagaaaagagaauucgacaaaauaauaaaaagugggagguuaggcuauuuuggagaagccuucaugguaaacaguggaaacaguaccaaacuacgaccagaaaaagaaaucuaccauauauuugcccuaauggcaucacuaaggcaaagcuacuuccacggcuacgucaaagauacagacuaucaagguaccacaugggccuauacccuagaagauaagcuaaaagggccaagucacgaauuuagagaaacaauugacaaaauuuuugaugaaggauucaguaaaauaagcaaagacuuuggaaaaaugaacaaaguaaaccuccaaauauuagagcaaaugauaggagaacucuauggauccaucgaacgacaaaaccuaacaugugacuacuaugacuuuauacaauuaaaaaaacauaaauaucuaggguucucaauuaaaagacuaagagaaaccauguuagaaacgacccccgcagaaugcuacaaagcagaaugcuauaacagcgaaagacaaaaacuauacaagcuaauagauuuccucaucuacgauuuauauuacaaccguaagcccgcgagaauagaagaaauaguagauaaauugagagagucaguaaaugacgaagaaaaagaaaguauauacucgguugaagcaaaauacguauaugaaagcuuaucaaaaguauuagacaaaagccuaaaaaacaguguuucaggagaaacaaucaaagaccuacaaaaaagauacgacgacgaaacagccaauagaaucugggacauaagccaacacucaauuuccggaaacgucaacugcuuuuguaagcuaauauauauaaugacacucauguuagacgguaaagaaauuaacgacuuacuaacuacacuaguaaauaaauuugacaacauagcaucauuuauagauguaauggaugaacuaggauuggaacacagcuuuacagauaauuauaaaauguuugcugacuccaaggcuauaugccuggaccuacaguucaucaauaguuucgcacguaugucuaaaauagacgacgaaaaaagcaagagacaacuauucagagacgcauuaguuauauuagacauagguaacaaagaugaaacauggauaaacaacuacuuagacagugauauauuuaaacuagacaaagaaggaaauaaacuuaaaggcgcacgucaugauuucagaaacuuuaucgcuaauaacguaauaaaaagcucaagguucaaauaccuaguaaaguacucaagcgcagacggaaugauaaaauuaaaaacaaacgaaaaacuaauuggguucguauuagacaaacuaccagaaacacagauagauagauacuacgaaaguugcggcuuagauaacgcuguuguagacaaaaaaguacguauagaaaagcucucuggccuaauuagagauaugaaauucgacgacuuuaguggcguaaaaacaucuaauaaagcuggcgacaacgacaaacaagacaaagccaaauaucaagcaaucauaaguuuauaccucaugguauuauaucaaauaguaaagaauaugaucuacguaaauucacgauauguuaucgccuuucacugucuggaacgagauuucgguauguacggaaaagauuucggaaaauauuaucaaggaugcagaaaacuaacagaccacuucauugaagaaaaauauaugaaagaaggaaaacuuggauguaacaaaaaaguaggaagguaccuaaaaaacaacaucagcuguugcacagacggauuaauuaauacauacagaaaccaaguagaucacuuugcaguagugagaaaaauaggaaauuacgcagcuuacauaaagucaauagguaguugguucgaacuguaccauuaugugauacaacguauaguauucgaugaauaccgauuugcacucaacaacacagaaagcaacuacaaaaacucaauaauaaaacaccauacauauugcaaagacaugguaaaagccuuaaauaccccauuuggguaugaucuuccacgauacaaaaauuuaucaauaggugauuuguucgauagaaacaauuauuuaaauaaaacaaaagaaucaauagaugccaauucaucaauugauagucaauacccauacgauguaccagacuaugccuga

SEQ ID NO: 14420 - RNA, 2934 nt, Artificial Sequence
  Cas13d variant__Ruminococcus albus __NLS-RaCas13d-NLS-HA
augucaccaaaaaaaaaaaggaaaguagaagcaucugcuaaaaaaaguaagggaaugucauugcgagaaaaacgagaauuagaaaaacaaaaaagaauacaaaaagccgcaguaaacucaguuaacgacacuccagaaaaaacagaagaagccaacguaguaucuguuaacguaagaacaucggccgaaaauaaacacaguaaaaaaucagcugcuaaagcacuaggauuaaaaucaggauuagucauaggcgacgaacuuuaucuaacaaguuucggucgggguaaugaagcaaaacuagagaaaaagauauccggagauacaguagaaaaacuagguauuggagcauuugagguagccgaaagagacgaaaguacauuaacacuagaaucaggaagaauaaaagauaaaacagcucgacccaaagauccaaggcacauaaccguugacacgcaaggaaaauuuaaagaagacauguuaggaauaagaucgguauuagaaaaaaaaauuuuuggcaaaacuuucgacgauaacauacacguacaacuggcauauaacauauuagacguagaaaaaaucauggcacaauacguuucagauauagucuauaugcuacacaacacagacaaaacagaacgaaacgacaauuuaaugggauauaugucaauacgaaacacuuacaaaacuuucugcgauacaucuaacuuaccagacgacaccaaacaaaaaguagaaaaccaaaaacgggaauucgauaaaauuaucaaauccggacgacuagguuauuucggagaagcuuucaugguaaacucaggaaacuccacaaagcuacguccagaaaaagaaauauaccacauauuugcccuaauggccagccuucgacaaaguuauuuucauggauauguuaaagauacagauuaccaaggaacaacaugggcauacaccuuagaagacaaacuaaaaggcccaagccacgaauucagagaaacaauugacaaaauauuugaugaaggcuucagcaaaauauccaaagauuucggaaaaaugaauaaaguaaacuuacagauacuagaacaaaugaucggagaacucuacggaucaauugaacgacagaacuuaacaugcgauuacuacgauuuuauacaauuaaaaaaacauaaguauuuaggauuuuccauaaagcgacucagagaaaccauguuagagacaacaccagcugaaugcuacaaagccgaauguuauaauagcgaaaggcagaaacuuuacaaacuaauagacuuucuuauauaugaucucuauuacaaccgaaagcccgcacgaauagaagaaauugucgauaagcuaagagaaucuguuaacgacgaagagaaagaaucaaucuacucaguagaagccaaauacguauacgaaagccuaucuaaaguuuuagacaaaucauuaaaaaauagcgucagcggagagaccaucaaggaccuacaaaaaagauaugacgacgaaacagcuaaccgaauaugggacaucucacaacacaguauaucaggaaacguaaauugcuuuuguaaacuaauauauauuaugacauuaaugcucgacggaaaagagauaaacgauuuauuaacaacauuaguaaacaaauucgacaauaucgcaucauuuauagauguaauggacgaacuaggccucgaacacaguuucacagacaacuacaaaauguucgcugacaguaaagcaaucugccuugaccuacaauuuauaaacuccuuugcacgaaugaguaaaauagaugaugaaaaaaguaaacgccagcucuuuagagacgccuuaguuauacuagauaucgguaauaaagaugaaacauggauaaacaacuauuuggacagugacauauuuaaauuagauaaagaaggaaacaagcucaaaggugcaagacacgacuucagaaacuuuauagcaaauaauguaauuaaauccagcagauuuaaauacuuaguaaaauacucaagugcagacggaaugauuaaacugaaaacgaacgaaaaauuaauaggguucguauuagauaaacuaccagaaacacaaaucgaucguuauuacgaaagcugcggacuagacaaugcaguaguagacaaaaaaguacguaucgagaaacuguccggacuaaucagagauaugaaauucgaugauuucucaggaguaaaaacaucaaauaaagcaggagauaacgauaaacaagacaaagccaaauaccaagcaauaaucucuuuauaucucaugguauuauaccaaauaguuaaaaacaugaucuacguuaacucaagauacguaaucgcauuccauugcuuagaaagagauuucggaauguacggaaaagauuuuggaaaauauuaucaaggaugucguaaauuaacugaccauuucauagaagaaaaauacaugaaagaagguaaauuaggauguaauaaaaaagucggaagauaccucaaaaauaauauaagcugcuguaccgacgguuuaaucaacaccuauaggaaucaaguagaccacuucgcagugguaagaaaaaucggcaauuacgcagcauacaucaaaagcauaggaucaugguuugaacucuaucacuauguaauacaacgaauaguauuugacgaauacagauucgcacuaaacaauacugaaucuaacuauaaaaacucaauaauaaaacaccacacauacugcaaagacaugguaaaagcauuaaauacaccauucggauacgaucugccacguuacaaaaaccuuaguauaggcgaccuauuugaucgaaauaauuaccucaacaaaacaaaagaaaguauagacgcaaauaguucaauagauagccaaggaaguggaccgaagaaaaaaagaaagguagccgcagcuuacccguaugacgucccagacuaugcauga

SEQ ID NO: 14421 - RNA, 2829 nt, Artificial Sequence
  Cas13d variant__Ruminococcus flavefaciens FD1__RffCas13d-HA
augaagaaaaaaaugucauuacgugaaaaaagagaagccgaaaaacaagccaaaaaggccgcauauucugccgcaagcaaaaacacagacucgaaaccagcugaaaaaaaagcagaaacucccaaaccagcagaaauuauaagcgacaacucaagaaacaaaacagcaguaaaagcagccggacuaaaaucaacuauaaucagcggagacaaacuauacaugaccucauuugguaaaggaaaugcagccguaaucgaacaaaaaauagauauuaacgauuauucauucucagcaaugaaagacacacccagucuggaaguagacaaagcugaaaguaaagaaauaagcuucucuucacaccacccauuuguaaaaaaugauaaauuaaccaccuauaauccacucuauggagguaaagacaacccagaaaaaccaguugguagagacauguuaggacuaaaagacaaauuagaagaaagauauuuuggauguacuuuuaacgacaacuuacacauacaaauuauauacaauauacuagacaucgaaaaaauacuagcgguacacagcgcaaacauaacaacagcccuugaccacauggucgacgaagaugaugaaaaauaucuaaacagcgacuacaucggauacaugaauacaaucaauaccuacgacguauucauggauccauccaaaaacucaucauuaaguccaaaagaucgcaaaaauauagauaauagucgagcaaaauucgaaaaacuacuaagcaccaagcgucuaggauacuucggcuuugauuacgaugcuaauggcaaagacaaaaaaaaaaaugaagaaauaaaaaaaagacuauaccaccuuacggcauuugccggucaauuacgacaauggaguuuucacucagccgguaacuacccaagaacauggcuauacaaacuagacucacuagauaaagaguacuuagauacacucgaucacuacuuugacaaaagauucaacgacaucaacgacgacuuuguaacaaaaaacgcaacaaauuuauacauccuaaaagaaguauuuccagaagcaaauuuuaaagauaucgcagaccuauacuaugacuucauaguaaucaagucccauaaaaauaugggcuuuuccauaaaaaaacuaagagaaaaaauguuagaaugugacggugcagacagaauaaaagaacaagacauggauagcguaagaagcaaauuauacaaacucauugacuucugcaucuuuaaauauuaccacgaauuccccgaacuuucagaaaaaaacguagauauucuaagagccgcuguuuccgacacaaaaaaagauaacuuauacuccgacgaagcagcaagauuaugguccaucuucaaagaaaaauuccucggauucugcgacaaaauaguaguauggguaacaggcgaacacgaaaaagauauaacuagugucauagacaaagacgcauaccguaauagaaguaacguauccuauuucuccaaacuaauguacgccaugugcuuuuucuuagacggaaaagaaauaaacgaucuuuuaacaaccuuaauaaacaaauucgacaauauugcaaaccaaauuaaaacagcaaaagaauuaggaaucaauacugcauucguuaaaaauuacgauuuuuucaaccacucagaaaaauauguagacgaacugaacauuguaaaaaauauugcgcgaaugaaaaaacccagcagcaaugcaaaaaaagcaauguaccacgaugcauugacaauacuuggaaucccagaagacauggacgaaaaagcuuuagaugaagaacuagaccugauucucgaaaaaaaaacagaucccgugacaggaaaaccguuaaaaggaaaaaacccacuacgaaacuucauagcuaacaacgucauagaaaacucacgauucauauaccuuauaaaauuuugcaacccggagaacguaagaaaaauaguaaacaauacuaaaguaacagaauuugugcuaaaaagaaucccagacgcccagaucgaacgauacuacaaaaguuguacugauagcgaaaugaauccaccaacagaaaaaaaaauaacugaacuagcuggaaaauuaaaagauaugaacuuuggcaacuuuagaaacguuagacaaucugcaaaagaaaacauggaaaaagaacgauucaaagcaguuauaggcuuauacuugacagucguuuauagaguaguaaaaaaucucgucgauguaaacucacguuauauaauggccuuccauucccucgaacgagacagucaacuauacaacguaucugucgauaaugauuacuuggcacuaacagauacgcuaguuaaagagggugauaacucuagauccagauaucuagcaggaaacaaaagauuaagggacugcgucaaacaagauauagacaacgcaaaaaaaugguuugucagcgacaaauauaacaguauaacaaaauauagaaauaauguugcccaccuaacagcaguucggaacugcgcugaauuuauaggagacauaacuaaaauagacucauacuucgcacucuaccacuacuuaauacaaagacaauuggcaaaaggacuagaucacgaaagaucaggauucgauagaaacuacccacaguaugcuccacuauucaaauggcauacauauguuaaagacgucguaaaggcacuuaaugcacccuuugguuauaacauaccaagauucaaaaaucuaucaauagaugcauuauucgauagaaaugaaauuaaaaaaaaugauggagaaaaaaaauccgacgacuacccauacgacgucccagacuacgcauga

SEQ ID NO: 14422 - RNA, 2901 nt, Artificial Sequence
  Cas13d variant__Ruminococcus flavefaciens FD1__NLS-RffCas13d-NLS-HA
augucgcccaagaagaaacgaaaaguggaagccucaaaaaaaaaaaugucauuacgagaaaaacgugaagcagaaaaacaagcaaaaaaagcagcauauuccgccgcgucaaaaaauacagauucaaaaccagcagaaaagaaagcugaaacaccaaaaccugcagaaauaauaagcgacaacaguagaaauaaaacagcaguaaaagcagcagguuuaaaaucaaccauaaucagcggagauaaacucuacaugacaucguuugguaaaggaaaugcugcagucauagaacaaaaaauagauauaaaugacuauucguucucagccaugaaagacacaccaucucuugaaguagauaaagcagaauccaaagaaauaagcuuuucaucacaccacccguucguaaaaaacgacaaauuaacaaccuacaacccauuauauggaggaaaggauaacccagaaaaaccagucgguagagacauguuaggacugaaagacaaacuagaagaaagauacuuuggaugcacauucaaugacaaccuccacauacaaauuauauacaauauucucgacauagaaaagauauuagcgguacacagugcuaauauaacaacagcauuagaucacaugguagacgaagacgacgaaaaauacuuaaacucugacuacauaggcuacaugaauacaaucaacacuuaugauguuuucauggacccaucaaaaaauucaucauuaucuccaaaggauaggaaaaauaucgacaacaguagagcaaaauucgaaaaacugcuaagcacaaaacgauuaggauacuucggauucgauuaugaugcaaauggcaaagacaaaaaaaaaaacgaagaaauaaaaaaaagauuauaccaucuuacagcauuugccggccaauuaagacaaugguccuuccacagugcaggaaauuacccccgaacaugguuauacaaacucgacagcuuagauaaagaauaccuagauacuuuagaccauuacuuugacaaaagguucaaugacauaaacgaugacuuuguaaccaagaacgcgacaaauuuauacaucuugaaagaaguguuuccagaagccaacuucaaagacauugccgaccuguacuaugauuuuauuguuauuaaaucucacaaaaacaugggauuuucaauaaaaaaacuacgagaaaaaaugcuagaaugugacggagccgauagaauaaaagaacaagacauggacagugucagaaguaaacuauauaaacuaauagauuucugcauauucaaauacuaccaugaauuuccagaacuaagugaaaaaaauguagacauauuacgagcagcaguaagugacacgaaaaaggacaacuuguauagcgaugaagcagcacgauuauggaguauuuucaaagaaaaauuccuaggauucugcgacaaaauaguagucuggguaaccggagaacaugaaaaagauauaacuucaguaauagacaaagaugcauauagaaacagaucaaacguaucauacuuuagcaaacucauguaugccauguguuuuuucuuagacggaaaagaaaucaaugacuugcucacuacacucauaaauaaauucgacaauauagcaaaucaaauaaaaaccgcaaaagaacuaggcauaaacacagcauucguuaaaaacuaugacuucuuuaaccacagcgaaaaauacguagaugaacuaaauauaguaaaaaauauugcgcgaaugaaaaaaccuagcuccaaugcaaaaaaagcaauguaccaugaugcuuuaacuauccuaggaauuccagaagauauggaugaaaaagcacuagacgaagaacuagaccuaauuuuagaaaaaaaaacagacccagucacaggcaaaccacuaaaaggaaaaaacccauuaagaaauuucaucgcaaacaauguaauagaaaauucaagauucauauaucuaauuaaguuuugcaaccccgaaaacguaagaaaaauaguaaacaauacgaaagucacugaauucguccugaaaagaauaccagacgcacagauagaaagauacuauaagaguugcacggacucggaaaugaacccaccgaccgaaaaaaaaaucaccgaacuugcaggaaagcucaaagacaugaauuucggaaacuucaggaaugucagacaaagcgcuaaagaaaauauggaaaaagaaagauuuaaagcaguuaucggacuauaccugacggucguauauagaguagucaaaaacuuagucgacguaaauucaagauauauaauggcauuccauucauuagaaagagauucacaacucuacaacgugaguguagacaaugauuauuuagcacuaacugacacucucgugaaagaaggagacaauagcagaagccguuaccuagcaggaaacaaacgacuacgagacugugugaaacaagacaucgacaaugcaaaaaaaugguucgucucagauaaauacaauucaauaacuaaauacagaaauaauguugcccaccuaacagcaguccgaaauugcgcagaauucauaggagauauaacaaaaaucgacucauacuuugcucuauaccacuauuuaauucaaagacaauuggcaaaaggauuagaccacgagagaaguggauuugacagaaauuauccgcaauaugcaccacuauuuaaauggcauacauauguaaaagauguagugaaagcacucaacgcaccauuuggcuauaacauaccuagauucaaaaaccuaagcaucgacgcuuuauucgauagaaaugaaaucaaaaaaaacgauggugaaaagaaaagugaugacggaucagguccaaaaaaaaaaagaaaaguugccgcagcauacccauaugauguaccagacuacgcauga

SEQ ID NO: 14423 - RNA, 2931 nt, Artificial Sequence
  Cas13d variant__Ruminococcus flavefaciens XPD3002__RfxCas13d-HA
augauagaaaaaaaaaaaucauucgcaaaaggaauggggguaaaaagcacacuaguaaguggaagcaaaguuuacaugacaacauucgccgaaggaucagaugcaagauuagaaaaaauaguagaaggagacucaauucguagcguaaaugaaggagaagcguucagcgcagaaauggcagauaaaaacgcgggauauaaaauagggaacgcaaaauuuucacauccaaaaggauaugcaguuguugccaacaacccguuauauaccgggcccguacaacaagacaugcucggucuaaaagaaacacuagaaaaaagauauuuuggagagagcgcggacgggaacgacaacauaugcauacagguaauacacaauauucuggacaucgaaaaaauauuagcggaguacauuacaaacgccgcauacgcaguaaauaauauaagcggauuagauaaagauauaauuggauuuggaaaauucucaacuguauauacuuacgacgaauucaaagaucccgaacaucacagagcugcauuuaacaauaacgacaaauuaauaaacgcaauaaaagcccaauacgacgaauucgauaauuuucuugacaacccuagauuaggcuacuucggccaagcauucuuuaguaaagaaggaagaaauuacauaaucaacuacggaaacgaaugcuacgauauauuagcauuauugucuggccuaagacacuggguagugcacaauaacgaagaagagucucgaauaaguaggacauggcuguacaacuuagacaaaaacuuagauaacgaauacaucucaacauuaaauuacuuauacgauagaauaacaaacgaacuaacaaacucuuucucaaaaaauagcgcagccaauguaaacuacauagcagaaacucucggcauaaacccagccgaauuugcagaacaauauuuccguuuuagcaucaugaaagaacaaaaaaaucuaggauucaacauaaccaaauuaagagaaguaaugcuagacagaaaagacaugucagaaauaaggaaaaaucauaaaguauuugacaguauaagaaccaaagucuauacaaugauggacuucguuauauacagauauuauauagaagaagaugcuaaagucgcagcagcaaauaaaucauuacccgacaaugaaaaaucucuaucagaaaaagauauuuuuguaauaaaucuccgaggaagcuuuaaugacgaccaaaaagacgcucuauauuacgacgaggcaaauaggauuuggagaaaguuggaaaacauaaugcauaacaucaaagaauuuagaggaaacaaaaccagagaauauaaaaaaaaagacgcaccaagauuacccagaauauuacccgcaggcagagacguaucagcauucucuaaacucauguacgcacuaacaauguuuuuagauggaaaggaaauaaaugaucuauuaacuacgcugauaaauaaguucgauaacauacaauccuucuuaaaagugaugccucuaauaggaguaaacgcaaaauucguugaagaauacgcauucuucaaagauucagcaaaaauagcagaugaacucagacuaauaaaaucauuugcaagaaugggagaaccaauagcagacgcgagaagagcaauguauauagacgcaauacgcauauuaggaacaaaccuaaguuacgacgaauuaaaagcuuuggccgauacauucaguuuagacgaaaacggaaacaaauuaaaaaaaggaaaacauggaaugaggaauuucauaauuaacaacguaauaucaaauaaaagauuccauuaucuaauuagauauggugacccagcucaccuccacgaaauugcaaaaaacgaagccguaguaaaauuuguccuaggaagaauagcagauauacagaaaaaacaagggcaaaauggaaaaaaccagaucgauagauauuacgaaaccugcauaggaaaagacaaaggcaaaucgguaucggagaaaguagaugcgcuaacuaaaauaauaacaggaaugaauuacgaucaauucgauaaaaaaagaagcgugauagaagacacaggaagggaaaacgcagaaagagaaaaauucaaaaaaauaauaagccuauacuuaacagucauauaucauauauuaaagaauauagucaauaucaacgcacgguauguaauaggauuccauugcguugaaagagacgcccaacuauauaaagaaaaaggcuaugauaucaaccuuaaaaaacuggaagaaaaagguuucaguucgguuacaaaacuuugugcaggaaucgacgagacagcacccgacaaacguaaggacguagaaaaggaaauggcagaaagggccaaagaaucgauagauagcuuagaaagugcgaacccaaaauuauacgcaaacuauauaaaauacucagacgaaaagaaagcagaggaauuuaccaggcaaauaaaccgagagaaagcaaaaacagcauuaaacgcauaucuaagaaauacuaaauggaauguaauaauacgcgaagaucuacuuagaauugacaauaaaaccugcacccuauuucgcaacaaagccguacaucuagaaguugcuagauauguacacgcauacauaaacgacauugccgaaguaaauucauauuuucaauuauaucacuacauaaugcaaagaauaauaaugaacgaaagauaugaaaaaucaagcggaaaaguaucagaauacuucgaugcaguaaacgacgaaaagaaauauaacgauagacuguuaaaacuacucugugucccauuuggauacuguauuccccgguuuaagaauuuaaguauagaagcccuauucgaccggaaugaagcagccaaauucgacaaagaaaaaaaaaaagucaguggcaauagcuauccauacgacgucccagauuacgcauga

SEQ ID NO: 14424 - RNA, 2931 nt, Artificial Sequence
  Cas13d variant__Ruminococcus flavefaciens XPD3002__dRfxCas13d-HA
augauagaaaaaaaaaaauccuuugcuaaagguaugggaguuaaaagcacacuaguaaguggaucaaaaguauacaugacaaccuuugcugaaggaucggacgcaagacuagaaaaaauaguagaaggagacucaauaagaagcguaaaugagggcgaagcguucucagccgaaauggccgauaaaaacgcaggauacaaaauagggaaugcaaaauucagucauccaaaaggauacgcgguaguugccaauaacccacucuacaccgguccaguacaacaagauaugcuuggauuaaaagaaacauuagaaaaacgauacuucggcgaaucagcugacggaaacgauaacauaugcauacaaguaauacacaacauucuagauauagaaaaaauucuggcagaauacauuacuaaugcagcuuacgcaguuaacaauauaucaggucuagacaaagauauaaucggauucggaaaauucaguacaguauauaccuaugacgaauucaaagaucccgaacaccacagagcagcuuucaauaauaaugauaaauuaauaaacgccaucaaagcacaauacgaugaauucgauaacuuccuagauaacccuagacuaggauauuucggacaagcauucuuuagcaaagaaggacgaaacuauauaauuaauuacggcaacgaaugcuaugauauacuggcacuccuaaguggccuagcacauugggugguugcaaacaacgaagaagagucuagaauaagccgaacuugguuauacaacuuggauaaaaaucuagacaaugaauauaucuccacacucaauuauuuauaugacagaauaacuaaugaacuaacaaauaguuuuucgaaaaauucagcugccaaugugaauuauauagcagagacucuuggaaucaauccugcagaauucgccgaacaguacuuuagauuuaguauaaugaaagaacaaaaaaaccucggcuuuaacauaacaaaauuaagagaaguaauguuagauagaaaagacaugagcgaaauaagaaaaaaucauaaaguuuucgacagcauacgaacuaaaguauacacgaugauggacuuuguaaucuauagauauuacaucgaagaagaugcaaaaguagcagcagccaauaaaagucuucccgacaacgaaaaaucucuauccgagaaggacauauuuguuauaaaccuuagaggaagcuuuaacgaugaucaaaaagacgcacuauauuacgacgaagcuaaccgaauauggagaaaauuagaaaauauuaugcacaauaucaaagaguucagaggaaacaaaacaagagaauacaaaaaaaaagacgccccucgucuuccaagaauucucccagccggaagagacgucagugcauucucaaaacuaauguaugcacuaacaauguuucuagauggaaaagaaauaaacgaccuccuaacaacacugauuaauaaauuugauaacauucaauccuucuuaaaaguaaugccacuaauuggcguaaaugcaaaauuuguggaagaauacgccuuuuucaaagacagugccaaaauagcagacgaauuaagauuaaucaaauccuuugcgagaaugggggaaccaauagcagacgcacguagagcaauguauauugaugcuauccgaauacucggaacaaaucuaucguaugacgaguuaaaagcacuagcagacacauucucucuagaugaaaacggaaacaaacucaaaaagggaaaacacggaaugagaaacuucauaauaaauaacguaauaagcaauaaaagauuucauuaucuaauccgcuauggagauccagcccaccuacaugaaauagcaaaaaacgaagcaguaguaaaguucguauuaggacgaaucgcugacauccaaaaaaaacaaggacaaaauggaaaaaaccaaauagauagauacuacgaaacaugcauuggaaaagacaaaggaaaaucaguaucugaaaaaguagaugcucuaacaaagauaauaacaggcaugaacuaugaccaguuugauaaaaaacgaaguguaaucgaagacacaggaagagaaaacgcagaaagagaaaaauucaaaaaaauaaucagcuuauaucuuacaguaauauaucauauacuuaaaaacaucguaaauauaaaugcacgauauguaaucgguuuccacugcgucgaaagagacgcucaacuauacaaagaaaaaggauaugauauaaaccuuaaaaaauuagaggaaaaaggauuuuccucaguaaccaaacuuugugcaggaaucgacgaaacagcaccagauaaaagaaaagacguagaaaaagagauggccgaacgugcaaaagaaaguauagauagucuagaaucagcaaaccccaaacuauaugcaaauuacaucaaauacagugaugaaaaaaaagcugaagaauucacaagacaaauaaauagggaaaaagccaaaacugcauuaaaugcauacuuaagaaauaccaaauggaauguaauaauacgagaagaccuauugcgaauugacaacaaaacaugcacacuauuugcgaacaaagcagucgcacuagaagucgcacgauacguccaugcauacauaaaugauauagcagaaguaaauucuuauuuucaacuauaccauuacaucaugcaaagaauaauaaugaacgaaagguacgaaaaaucaucuggaaaaguaucagaauacuucgacgccguaaaugacgaaaaaaaauauaaugaucguuuacuuaaacucuuaugcguaccauuuggauacugcauaccucgauuuaaaaaucuaucuauagaagcccuguuugacagaaaugaagcagcaaaauuugacaaagaaaaaaagaaaguuagcggaaacucuuacccuuacgaugucccagacuaugcauga
